United States Patent 12,747,451 (RNA ENCODING AN ANTIBODY) - sequence listing, part 5

SEQ ID NO: 23250 - RNA, 1371 nt, synthetic construct
  misc_feature 1..1371: note = derived and/or modified sequence opt3 from Galiximab_HeavyChain1
  source 1..1371: mol_type = other RNA
caagtgcaactgcaggagagcggccccgggctcgtcaagccttccgaaaccctttctctgacatgcgccgtttcaggaggtagtatcagcggcgggtacggatggggctggattagacagccaccgggtaaagggttggagtggataggatccttctattcttcgtcaggcaacacttactataatcccagcttaaagagtcaggtgacgatctccaccgacacatctaaaaaccaatttagcctgaagctaaattccatgactgctgcagataccgccgtatactattgtgtgagggaccggcttttctcagtcgtgggcatggtttacaacaattggtttgatgtgtgggggcctggagtcctggtgacagtaagtagcgcgtctaccaaaggtccatccgttttcccccttgctccttcaagcaagagtacttctggcgggacagccgcactgggatgcttggtgaaggactattttccagaacccgtcaccgtgtcctggaacagcggcgccctcacgtcgggtgtgcacactttccctgctgtcctgcagtcttccgggctgtactcactcagtagcgttgtgaccgtaccatcctctagcttaggaacacagacttacatttgtaatgtgaaccataaaccgtcaaataccaaggtcgataaaaaggcagagcccaaaagttgcgacaagacacacacctgtcctccatgccccgcccctgaactgcttggcggcccatccgtgtttttgtttcccccgaagcctaaagatacgctgatgatcagccgcactcccgaggttacatgtgtggtcgtggacgtatctcatgaggatccagaagttaagtttaactggtatgtggacggggtcgaggtgcacaatgctaaaaccaagcctcgagaggaacagtacaactcaacttatcgtgtcgtgagtgttctaacagtgctccatcaagattggctgaatggaaaagagtacaagtgcaaagtaagcaacaaggcccttcccgcgccaattgaaaagaccatctccaaagcaaagggtcagcccagagagcctcaggtctatacgctgccaccgtctagggacgaattgaccaaaaatcaggtgtcgctcacatgtctggttaagggcttctaccccagcgatatagccgtggagtgggaatccaacgggcaacctgagaacaattataaaactaccccacccgtcttagactcagacggaagtttcttcctgtactctaagctcacagtggataagagccggtggcagcagggcaacgtattttcctgctcagtgatgcacgaggctctccacaatcattacactcagaaaagcctgtctttgtcccctggtaag

SEQ ID NO: 23251 - RNA, 648 nt, synthetic construct
  misc_feature 1..648: note = derived and/or modified sequence opt3 from Galiximab_LightChain1
  source 1..648: mol_type = other RNA
gagagcgccctgacccagcccccttccgtgtctggcgctccagggcaaaaggtcacaatctcatgcactggaagtacgagcaacattggtggctacgacctccactggtatcagcagcttccggggaccgcacccaaactgttgatatacgatatcaataagagaccttccggaatttctgacaggttctcgggctcaaaaagcggtacagccgcgagtttagctatcactgggctgcagaccgaagatgaggccgactattactgtcaatcctatgattctagcctaaacgcacaggtttttggaggcggcacacggctcaccgtgctggggcagccaaaggccgctcccactgtaacacttttccctccatcctcagaggaactgcaggcaaataaagccaccttggtgtgcctcattagtgacttttaccccggagctgtcacggtggcctggaaggcggatagctctcctgttaaggccggtgtggaaactaccacaccatccaaacaatcaaacaataagtatgcagctagcagttacctgtctctgactccggagcagtggaaatcccatcgcagctactcgtgtcaggtcacccacgagggctctacagtggaaaagaccgtagcccccacggagtgctcc

SEQ ID NO: 23252 - RNA, 1347 nt, synthetic construct
  misc_feature 1..1347: note = derived and/or modified sequence opt3 from Ganitumab_HeavyChain1
  source 1..1347: mol_type = other RNA
caggtgcaactgcaggagagcggccccgggctcgtcaagccttccggaaccctttctctgacatgcgccgtttcaggtggcagtatcagctcctctaactggtggtcgtgggtgagacagccaccggggaaaggattggaatggattggcgagatataccactcaggtagcactaattataaccccagtttaaagtccagggtaacgatctctgtggacaaaagcaagaatcagttctccctgaaactatcaagtgtcaccgctgcagatacagccgtgtactattgtgcgcggtggactgggcgcaccgacgcttttgatatttggggacaaggcacaatggttaccgtgagctctgcctccactaagggcccttcagtcttcccactcgcacccagcagtaagtctacatccgggggaaccgccgctctgggttgccttgtgaaagactactttcctgaaccagtaacggttagctggaactcgggcgcactgacttctggggtgcataccttccccgccgtcttgcagtcctcaggactctatagtctgagctccgtggtgacagtcccttctagctcactgggcactcagacctacatctgtaatgttaaccacaagccaagtaatacaaaagtggataagaaagtagagccgaagtcctgcgacaagacccatacgtgtcccccttgcccagctcccgaactcttaggtgggcctagcgtgtttctgttcccacccaaaccgaaggatactcttatgatttctcgaacacctgaggtcacctgtgtggttgtggacgtctcacacgaggatcccgaagtgaaatttaactggtatgtagacggagttgaggtgcataatgccaagactaaaccacgtgaagaacagtacaacagtacatacagagtcgtgagcgtcttgaccgtgctgcaccaagattggctaaatggcaaggagtataaatgcaaggtttccaacaaggcgctccctgcacccatcgagaaaacgatatctaaggccaaaggccagccaagggagccccaggtgtacaccctgcctccatcgcgggacgaacttacaaagaatcaggtaagcctgacttgtttggtcaaagggttctatccgtccgatatcgctgtggagtgggaatcaaacggacaacccgagaataactacaagaccacacctccagttctcgacagtgacggtagctttttcctgtattctaagttaactgtggataaatcccgctggcagcagggcaacgtcttttcatgcagcgtgatgcacgaggccctgcataatcactacacccaaaagtctctctcccttagtcccgggaaa

SEQ ID NO: 23253 - RNA, 657 nt, synthetic construct
  misc_feature 1..657: note = derived and/or modified sequence opt3 from Ganitumab_LightChain1
  source 1..657: mol_type = other RNA
gacgtggtcatgacccagagccccctgtccctccctgttacaccaggcgagccggcctctatctcatgcagaagtagccaatcccttctgcactctaacgggtacaattatttggattggtacttacagaagcccggacagtcgcctcagctgctaatttatctcggttcaaacagggctagcggcgtgccagaccggttcagtgggtccggatctggcactgattttacgctgaaaataagccgcgtagaagcagaggacgtgggtgtctactattgtatgcaagggacccattggccccttacattcggacagggcactaaggtggaaatcaaacgaaccgttgccgcgccttccgtgtttattttcccaccctcagatgagcagctgaagagtggcacagctagcgtcgtgtgcttgctcaataacttttaccctcgtgaagccaaagtacagtggaaggttgacaatgcactgcaatctgggaactcccaggagtcagtgaccgagcaggatagcaaggacagtacttattctctgtccagcacactcaccttatcgaaagccgattacgaaaagcacaaagtctacgcttgtgaggtgacgcatcagggactgtcttccccagtgactaagtcattcaatagaggtgaatgc

SEQ ID NO: 23254 - RNA, 1368 nt, synthetic construct
  misc_feature 1..1368: note = derived and/or modified sequence opt3 from Gantenerumab_HeavyChain1
  source 1..1368: mol_type = other RNA
caggtggagctggtcgaaagcggcgggggactcgttcaacccggtggctcccttagactgtcttgcgccgcttcagggttcacctttagtagctacgcaatgtcctgggtgaggcaggcccctggaaagggcttggagtgggtatctgcgatcaacgcttcgggtacacggacttattacgccgactcagtgaaagggcgcttcacgattagccgagataatagtaagaacaccttatatctgcagatgaactccctacgtgcagaagacacagccgtctactattgtgctagaggaaaaggcaatactcacaagccatacggctatgtgaggtactttgatgtttgggggcagggaaccctcgtgacagtctctagcgcatccaccaaaggtccgtcagtgttccccctggcccctagtagcaagtctacttccggcgggacagctgcccttggatgcctggtaaaggactactttccagagcccgttaccgtgtcatggaatagcggcgcgttgacgagtggtgtccatactttccctgcagtgctccaatcttccgggctgtatagcctgtcgtctgtggtcaccgttccatcctcaagtctcggaacacagacttacatatgtaacgtgaatcacaaacccagcaacaccaaggtagataaaaaggtggaacctaaatcctgcgacaagacacatacctgtccaccgtgccccgcccctgagttactgggcggcccatctgtctttctttttccccctaagccaaaagatacgttgatgatcagccggactcccgaggtgacatgtgttgtggtcgacgtgtcacacgaagatccggaggtaaagttcaattggtatgttgacggggtggaagtccataacgctaaaaccaagcctcgcgaggagcagtacaatagtacttatagagtggtctccgtgctgacagttctacaccaggattggctcaacggaaaagaatacaagtgcaaagtgagcaataaggccctgcccgcaccaattgagaagaccatctctaaagctaagggtcaacctagggaaccccaggtatatacgcttccaccctcacgggacgagctgaccaaaaaccaggtcagtttgacatgtctcgtgaagggcttctaccctagcgatattgccgttgaatgggagtccaatgggcagccagagaacaactacaaaactaccccgcccgtgctggactctgacggatcgtttttcttatatagcaagctgacagtcgataagtcccgctggcaacagggcaatgtgttttcatgcagtgtaatgcacgaagcgctccataaccactacactcagaaatctcttagcctgtcccctggtaag

SEQ ID NO: 23255 - RNA, 645 nt, synthetic construct
  misc_feature 1..645: note = derived and/or modified sequence opt3 from Gantenerumab_LightChain1
  source 1..645: mol_type = other RNA
gacatcgtgctgacccagagccccgccacactctccctttctcctggcgagagagctactctgtcatgcagggcaagtcaaagcgtctcctcttcgtacttggcctggtatcagcagaagccagggcaggcgccgcggttactgatttacggagcttcaagccgcgccacgggtgttcccgcacgattcagtggctccgggtctggaaccgattttacactaactataagctccctcgaacctgaggacttcgccacctattactgtctgcaaatctataacatgccaattacatttggccagggtaccaaagtggaaatcaagcgtactgtagctgcaccctcagtgttcatttttcctccaagtgatgagcagcttaaaagcgggacagcctctgtcgtgtgcctgttgaataacttctaccccagagaagctaaggttcagtggaaagtggacaatgccctccaatccggaaactcacaggagagcgtcaccgagcaggatagtaaggactctacgtattccctgagctcgactctgaccctctctaaggcggattacgaaaaacacaaggtgtacgcatgtgaggtaacacatcagggcttatcctcacctgttactaaaagttttaataggggcgaatgc

SEQ ID NO: 23256 - RNA, 348 nt, synthetic construct
  misc_feature 1..348: note = derived and/or modified sequence opt3 from Gemtuzumab_HeavyChain1
  source 1..348: mol_type = other RNA
caggtgcaactgcagcagagcggcgccgagctcgctaagcccggggcatccgtcaaaatgtcttgcaaggcctcaggatacaccttcacaagttatagaatgcactgggttaaacagaggcctggtcaaggccttgaatggatcgggtacattaacccaagcactggatatacggagtacaatcagaagtttaaagacaaggcgaccctgacagctgataagtcctcttcgactgcctatatgcagttgagctcattaaccttcgaagacagtgcagtgtactattgtgcccggggcggtggggtatttgattactggggacagggcacaaccctgactgtgtcctct

SEQ ID NO: 23257 - RNA, 351 nt, synthetic construct
  misc_feature 1..351: note = derived and/or modified sequence opt3 from Gemtuzumab_HeavyChain2
  source 1..351: mol_type = other RNA
caggtgcaactggtccagagcggcgccgaggttaagaaacccgggtcctctgtgaaggtatcatgcaaagctagtggaggtaccttcagcagatccgcaatcatttgggtgaggcaggcccctggccaggggctcgaatggatgggaggcatagtcccaatgtttggtccgcccaactacgcgcaaaagttccaggggcgggtgacaatcactgctgacgagtctacgaataccgcctatatggaactttcgtcactgcgcagcgaggatacagcattttacttctgtgccggaggctatggcatttacagtcctgaagagtataacgggggattggttactgtgtcctct

SEQ ID NO: 23258 - RNA, 321 nt, synthetic construct
  misc_feature 1..321: note = derived and/or modified sequence opt3 from Gemtuzumab_LightChain2
  source 1..321: mol_type = other RNA
gacatccagatgacccaaagcccctccacactgtctgcctcagtgggcgatagagtcactattacgtgcagggctagtcagagcataaacacctggctcgcatggtaccagcagaagcctgggaaagccccaaaacttctgatgtataaggcgtcctctttggagtcgggagttccgtcacggttcatcggtagcggcagtgggacagaatttactttaaccatttcctctctgcaacccgacgatttcgctacatactattgtcagcagtacaatagcgactccaagatgtttggacagggcaccaaagtggaggtaaag

SEQ ID NO: 23259 - RNA, 318 nt, synthetic construct
  misc_feature 1..318: note = derived and/or modified sequence opt3 from Gemtuzumab_ozogamicin_LightChain1
  source 1..318: mol_type = other RNA
cagatcgtgctgacccaaagccccgccattatgtccgcttctcctggcgagaaggtcacaataacttgctcagcaagtagctccatctcttacatgcactggttccagcagaaaccagggacgtcgccgaagctctggatttataccacatcaaaccttgccagcggagttcccgcgagatttagtggttccggctctgggactagctactccctgaccatctcaaggatggaagctgaggacgccgcaacatattactgtcatcagcggagtacctatcctttgactttcggaagcggcacaaaattagaactgaag

SEQ ID NO: 23260 - RNA, 1335 nt, synthetic construct
  misc_feature 1..1335: note = derived and/or modified sequence opt3 from Gevokizumab_HeavyChain1
  source 1..1335: mol_type = other RNA
caggtgcaactgcaggagagcggccccgggctcgtcaagccttcccagaccctttctctgacatgctcattcagtggatttagcttgtccacttctggtatgggcgttgggtggatcagacagccatcgggaaaaggcttagaatggctggcccacatttggtgggacggtgatgagtcatacaacccgagcctaaagagtaggctcacgatatccaaagacacctctaagaatcaagtgagcctgaaaatcacatccgtaactgctgcagataccgccgtgtatttctgtgcgcggaaccgctacgatcccccttggtttgtcgactgggggcagggaacacttgtgaccgtttcaagtgctagcactaagggcccatctgtgttccccctggccccttgctcccgatcaacaagcgaaagtaccgcagccttgggctgtctcgtcaaggactattttccagagcccgtgacggtatcttggaatagcggggctctgactagcggagttcataccttccctgcagtgctgcagtcgtctggtctctactccttatcaagtgtcgtgacagtgactagctccaactttggcacccagacatatacctgcaatgtcgatcacaaaccatctaacacgaaggttgacaaaactgtggaacgtaagtgttgcgtagagtgtccgccctgccctgccccacccgtggctgggcctagcgtcttcctgtttccacccaaaccgaaggatacacttatgatttcaagaacccctgaggtgacttgtgttgtggtcgacgtgagtcatgaagatcccgaggtacaattcaattggtacgttgacggaatggaagtgcacaacgccaagacaaaaccaagggaggagcagtttaattccaccttccgggtcgtgagcgtcttgacggtggttcatcaggattggctgaacggcaaggaatataaatgcaaggtgtctaataaaggtctacctgcgcccatcgagaagaccatttcaaaaacaaaggggcagccacgcgaaccccaagtatacactctccctccaagtagagaggaaatgaccaagaaccaggtcagcctgacatgtcttgtgaaaggattttacccgtccgacatcgcagttgagtgggagtctaatggccagcccgaaaacaattataagactacccctccaatgctggactcggatggcagcttcttcttgtactccaaactcacagtggacaagtcaaggtggcaacaggggaacgtctttagttgctctgtgatgcacgaggccctgcacaaccattatacccagaaatccttatccctgtcacccgga

SEQ ID NO: 23261 - RNA, 642 nt, synthetic construct
  misc_feature 1..642: note = derived and/or modified sequence opt3 from Gevokizumab_LightChain1
  source 1..642: mol_type = other RNA
gacatccagatgacccaaagcacatcctctctgtcagccagtgtgggcgatagagtcactattacgtgcagggctagccaggacatatccaactacctctcttggtatcagcagaagcccgggaaagcagttaaacttctgatctactatacctcgaagttgcactcaggagtgcctagccggttcagtggttccggctctgggacagattacactttaaccattagctccctgcaacaggaggactttgccacatatttctgtctacagggaaagatgctcccatggacctttggccagggtactaaactggaaatcaagcgcacagtagcggctccgtcagtgttcatttttccccctagtgatgagcaacttaagagcgggaccgcctctgtcgtgtgcctgttgaataacttctacccacgagaagcaaaagttcagtggaaggtggacaatgccctccagtccggaaactcacaggagagcgtcacggaacaagatagtaaagactctacttattccctgagctcgaccctgacactctctaaggctgattacgagaaacataaggtgtacgcatgtgaggtaactcaccagggcttatcctcacccgttaccaagagttttaatcgtggcgaatgc

SEQ ID NO: 23262 - RNA, 1347 nt, synthetic construct
  misc_feature 1..1347: note = derived and/or modified sequence opt3 from Girentuximab_HeavyChain1
  source 1..1347: mol_type = other RNA
gacgtgaagctggtcgagagcggcgggggactcgttaaacttggtggctccctgaagttgtcttgcgccgcttcagggttcacctttagtaactactatatgagctgggtgagacaaacacccgagaaaaggttagaactggtagcagccatcaattccgatggaggcattacttactatctagacacggtgaagggtcggttcaccatatctcgcgataacgcgaaaaatacactctacctgcaaatgtcgtcacttaagagcgaagacactgctctgttttattgtgcccgacaccgtagtgggtacttctccatggattattggggacagggcacctctgtcacagtgagctccgcatcaaccaagggccctagtgtttttccattggccccgagctctaaatccacttcagggggaacagctgcactcggttgcctggtgaaggactacttccccgagcctgtcaccgtgagctggaacagtggcgccctgacgtctggggtacatacttttccagctgttctccagtccagcggattatactcgctgtcttccgtggtcaccgtgccctcaagtagccttggcacacagacttatatctgtaatgtgaaccacaaaccttccaataccaaggtcgataaaaaggttgaaccaaagtcttgcgacaaaacacatacctgtcccccttgcccagccccggagttgctgggtgggcccagcgtgttcctatttcctccaaagcccaaagatacgctcatgatttcaagaactcctgaggtaacatgtgtggtcgtggacgttagtcacgaagatccagaggtgaagttcaactggtacgtcgacggagtggaagtacataatgcgaaaaccaagcccagggaggagcaatataactccacttaccgggttgtgagcgtcctgacagtgcttcaccaggattggctgaatggcaaagaatataagtgcaaggtctctaacaaagcattgccggcccctatcgagaagaccatttcaaaagctaagggccagccccgcgaaccacaggtgtacacgctccctcccagtagagacgagctgaccaaaaatcaagttagcttaacatgtctggtgaaggggttttatccatccgacatcgccgtagaatgggagtctaacggacagcccgagaataactacaagactacccctccagtcctcgattcggacggtagcttctttctttactccaaactgacagtggataagtcaaggtggcagcagggcaacgttttcagttgctctgtgatgcacgaagcattgcataatcactatactcagaaaagcctatccctgtcaccggggaag

SEQ ID NO: 23263 - RNA, 642 nt, synthetic construct
  misc_feature 1..642: note = derived and/or modified sequence opt3 from Girentuximab_LightChain1
  source 1..642: mol_type = other RNA
gacatcgtgatgacccagagccaaagattcatgtccacaactgtcggcgatagggtttctattacgtgcaaggcctcacagaacgtggtaagtgctgtggcatggtaccagcagaaacccgggcaaagccctaagctgctcatatattccgcctctaatcggtacaccggagtcccagaccgctttacaggttcgggctcagggactgatttcacccttacaatcagcaacatgcagagtgaggacctggcggactttttctgtcagcagtattccaattacccgtggacctttggaggcggtactaaattggaaattaagcgaacagtggctgccccctctgttttcatctttcctccaagcgatgagcaattaaaatccgggaccgcatcagtggtctgcctgctaaacaatttctatccccgtgaagccaaggtgcagtggaaggtagataacgctctccagagtggaaatagccaggagtctgttacggaacaagactccaaagattcaacttacagcctgagttctacccttacactgtccaaggcagactatgagaaacacaaggtgtacgcctgtgaggtcactcatcagggcttgagctcgcctgtgaccaaatcttttaacagaggcgaatgc

SEQ ID NO: 23264 - RNA, 1335 nt, synthetic construct
  misc_feature 1..1335: note = derived and/or modified sequence opt3 from Glembatumumab_HeavyChain1
  source 1..1335: mol_type = other RNA
caggtgcaactgcaggagagcggccccgggctcgtcaagccttcccagaccctttctctgacatgcactgtttcaggaggtagtatcagctccttcaactactattggtcttggattagacaccatccaggcaaagggttggaatggataggatacatctattactcgggctcaacgtatagcaatccgagtttaaagtccagggtgaccatttctgtagacacaagcaaaaaccagttttccctgactctatcaagtgtgaccgccgctgatacagcagtctactattgtgcccggggttacaattggaactacttcgactattgggggcaaggaaccctcgtgactgttagctctgcgtccacaaagggcccctcagtgtttcctctggctccatgcagccgcagtacctctgagtccacggccgcacttggctgtctggtcaaagattacttccccgaacctgtgactgtaagctggaactcgggggccttgacctctggagttcacacatttccagctgtgctccagtcctcaggtctgtatagtctgagctccgtcgtgactgtgccctctagcaatttcggcacccagacatatacctgcaatgtcgaccataagccttcaaacacgaaggttgataaaactgtggagcgaaagtgttgcgtagaatgtccaccgtgccccgcacctccagtggccgggcccagtgtctttctcttccctccaaaacccaaggacacattaatgatctcccgtaccccggaggtgacttgtgttgtggtcgatgtgagccacgaggaccctgaagtacagtttaattggtacgttgatggagtggaggtccataacgctaaaacaaagcccagagaggaacaattcaattctacctttagggtggtctcagtgctgacggttgtgcaccaggactggcttaacggcaaggagtacaaatgcaaggtaagtaataaaggtttgccagcccctattgaaaagaccatcagcaaaacaaaggggcagccccgggagccacaggtctatactctgcccccttcccgcgaagagatgaccaaaaaccaagtgtctctaacatgtctcgttaagggattctacccatcggatatagcggtggaatgggagagcaatggccagccggagaacaactacaagactacaccccctatgctggactccgatggctcatttttcctttatagtaaactgaccgtcgacaagtctagatggcagcaagggaatgtgttcagctgctccgtaatgcacgaagcattgcataaccactacacccagaaatcactcagcctgtctccaggaaag

SEQ ID NO: 23265 - RNA, 645 nt, synthetic construct
  misc_feature 1..645: note = derived and/or modified sequence opt3 from Glembatumumab_LightChain1
  source 1..645: mol_type = other RNA
gagatcgtgatgacccagagccccgccacactgtccgtctctcctggcgaaagagctactctctcatgcagggcaagtcaaagcgttgacaacaatcttgtgtggtaccagcagaagccagggcaggccccgcggctgttgatttatggagcgtccacgcgcgctaccggtatacccgcccgattctctggctcggggtcaggaacagagtttactttaaccatcagcagtctgcaatccgaagatttcgcagtatactattgtcagcagtacaacaattggcctccatggacatttggccagggtaccaaagtggagattaagcgtactgtcgccgctccctctgtgttcatctttcctccaagcgacgaacaactaaaatccgggacagcatcagttgtgtgcctcctgaacaatttctatcccagagaggccaaggtccagtggaaagtggataacgcccttcagagtggaaatagccaggagtctgtaaccgaacaagactccaaggattcaacgtacagcctgagttctactttgaccctctccaaggctgactatgagaaacacaaggtttacgcgtgtgaagtgacacatcagggcctgagctcgcctgtcactaaatcttttaacaggggcgagtgc

SEQ ID NO: 23266 - RNA, 1332 nt, synthetic construct
  misc_feature 1..1332: note = derived and/or modified sequence opt3 from Goilixiab_HeavyChain1
  source 1..1332: mol_type = other RNA
gaggtgcagctggtcgaaagcggcgggggactcgccaagcccggtggctcccttagactgtcttgcgctgcatcagggttcaggtttaccttcaacaattactatgactgggttcggcaagcccctggacagggcttggagtgggtgagtcgcatcagctcctctggtgatccaacatggtacgcggactcggtaaaagggcgatttactatttcacgtgaaaacgctaagaatacgttattcctgcagaacagcctaagagccgaggataccgcagtgtattactgtgccagtctcacaactggatccgactcttggggccagggcgtcctggtgaccgttagctccgcttcaacaaaagggccgagtgtgtttccccttgcacctagctctaagtccacctcaggaggtactgccgctctgggctgcttggtcaaagattatttcccagaacccgtgacagtaagctggaatagtggggccctcacctctggagttcacacgtttcctgcggtgctgcaatccagcggcctgtactcgctctcttccgtcgtgactgtgccatcaagtagcttaggtacccagacatatatatgtaacgtcaatcataagccctccaacactaaggttgacaaaaaggtggagcctaaatcttgcgataagacccacacatgtccaccgtgccccgcacctgagctgcttgggggaccaagcgtattcttgtttccccctaaaccaaaggacaccctgatctcaaggacgcccgaagtgacttgtgtcgtggttgatgtgagtcatgaggacccggaagtcaagttcaattggtacgtggatggcgtagaggttcacaacgccaaaacaaagcctcgggaggaacagtacaattccacctatcgcgtggtcagcgtgctaactgtcctccatcaggactggctgaacggcaaagagtacaagtgcaaagtgtctaataaggcccttcccgctccaattgaaaagacaatctcaaaggcaaaggggcaacctagagagccccaggtttataccctgccacccagtagggatgaattgacgaaaaaccaggtgagcctcacctgtctggtaaagggattttacccttccgacattgctgtcgagtgggagtctaatggtcagccagaaaacaactataaaacaactccgcccgtgttagactcggatggcagcttctttctgtactccaagctcaccgttgacaaatcacggtggcaacaggggaatgtgttcagttgctctgtccacgaggcccttcacaaccattatacacagaaaagcctgtccttgtcacctggaaag

SEQ ID NO: 23267 - RNA, 639 nt, synthetic construct
  misc_feature 1..639: note = derived and/or modified sequence opt3 from Goilixiab_LightChain1
  source 1..639: mol_type = other RNA
gacatccagacccaaagcccctcctctctgtcagccagtgtgggcgatagagtcacaattacttgcagggctagccaggacatacggtactatctcaactggtaccagcagaagcctgggaaagcaccaaaacttctgatctatgttgcctcctctttgcaatcgggagtgccgtcacgcttcagcggtagtggctccgggacggagtttaccttaacagtatctagcctgcagcccgaagatttcgcgacttactattgtctacaggtgtactccacccctcgaacatttggacagggcaccaaggtcgagattaagcgtactgtggctgccccatcagttttcatctttccccctagtgacgaacaactcaaaagcggtacagcatctgtggtctgcctgcttaataacttctatccaagagaggccaaggtgcagtggaaggtagataatgctctgcagtccgggaactcacaggaaagcgttaccgagcaagacagtaaagattctacgtactccttgagctcgactctcaccctgtctaaggcagactacgagaaacacaaggtgtatgcctgtgaagtcacacatcagggactgtcctcacccgtgactaaaagttttaataggggcgagtgc

SEQ ID NO: 23268 - RNA, 1338 nt, synthetic construct
  misc_feature 1..1338: note = derived and/or modified sequence opt3 from Guselkumab_HeavyChain1
  source 1..1338: mol_type = other RNA
gaggtgcagctggtccaaagcggcgccgaagttaagaaacccggggagtccctcaagatctcttgcaaaggatcaggttacagtttcagcaactattggattggctgggtgagacagatgcctgggaagggacttgaatggatgggcataatcgacccatccaattcttacaccaggtattcgccgtcatttcagggtcaggtaacaattagcgctgataaaagtatctccactgcatacctgcaatggtctagcttgaaggcctccgacacggcgatgtattactgtgctcggtggtattacaagcccttcgatgtgtgggggcagggaaccttagtcacagtgtcaagtgccagcactaaaggcccttctgtttttccactggcaccctcctcaaagagcaccagtggcgggacagccgctctaggatgcctcgtgaaagactacttccctgagccagtcaccgtgtcttggaactccggtgcactgactagcggcgtacacacatttcccgccgttcttcagtcgtctgggctgtattccttgtcaagtgtggtcaccgtgcctagctcctctctcggaacgcagacttacatttgtaatgtgaaccataagccaagcaataccaaagtcgataagaaggttgaaccgaaatcatgcgacaagacacacacttgtcccccttgcccagctcccgagctgctgggcggtcctagtgtgttcctctttccacccaaaccgaaggataccttaatgatctcccgcacacctgaggtaacctgtgtggtcgtggacgttagccatgaagatcccgaggtgaaattcaactggtatgtcgacggggtggaagtacacaatgccaagacgaaaccacgagaggagcaatacaactctacttatcgtgttgtgtcagtcctgacagtgcttcatcaggattggttgaatggaaaggaatacaagtgcaaagtcagtaacaaggcgctgcctgcacccatagagaaaaccatcagcaaggccaaaggccagccaagagaaccccaggtgtatactctacctccatccagggacgagctcacaaagaatcaagtttctctgacctgtcttgtgaagggcttttacccgtcggatattgctgtagaatgggagagcaacgggcagcccgagaataactacaaaacgacccctccagtcctggactccgacggatcattctttttgtatagtaagctcacagtggataaatctcggtggcagcaaggtaatgttttcagctgctccgtgatgcacgaagccctgcacaaccattacactcagaagtcattaagcctgtctcccggc

SEQ ID NO: 23269 - RNA, 651 nt, synthetic construct
  misc_feature 1..651: note = derived and/or modified sequence opt3 from Guselkumab_LightChain1
  source 1..651: mol_type = other RNA
cagagcgtgctgacccaacccccttccgtctctggcgccccagggcagagagttacaatctcatgcactggaagtagctccaacattggttctggctacgacgtgcactggtatcagcagctcccggggacggctcccaagttgctgatatacggaaattcgaaaaggccttcaggcgtaccagatcggttcagcggtagtaagtccgggacctctgcaagccttgccatcacaggattacaatccgaggacgaagcggattattactgtgcttcatggactgacggcctgagtctagtggtctttggcgggggaaccaaactcacagtgctgggtcagcccaaggccgcacctagcgttacccttttcccaccctcttccgaggaactgcaggccaacaaagctactttggtgtgcctcatttcagatttttatcctggcgcagtcacagtggcctggaaggctgacagcagtccagtaaaggccggggttgagaccacgactccgtctaaacagtccaataacaagtacgcggcaagctcgtatctgtctctgacccccgaacaatggaaatcccatcgctcatacagttgtcaggtgacacacgagggaagcactgtcgagaagaccgtggcccctacagaatgctcc

SEQ ID NO: 23270 - RNA, 360 nt, synthetic construct
  misc_feature 1..360: note = derived and/or modified sequence opt3 from HuMab-001_HeavyChain_VDJ-Region
  source 1..360: mol_type = other RNA
caggtgcaactgcagcagtggggcgccgggctccttaagcccagcgagaccctgtccttgacatgcgctgtctacggaggttctttctcaggctattactggaactggatcagacagcctccagggaaaggattagaatggattggcgagataaatcacagtggtagcactaactataatccgtccctgaagtctagggttacgatctcggtggacaccagcaaaaaccaattttcactaaagctcagttccgtaacagcagccgatactgcggtgtactattgtgctcgggggaattacggatctggctattactacttcgacctgtggggccgcgggacccaggtcacagtgagctcc

SEQ ID NO: 23271 - RNA, 321 nt, synthetic construct
  misc_feature 1..321: note = derived and/or modified sequence opt3 from HuMab-001_LightChain_VJ-Region
  source 1..321: mol_type = other RNA
gacatccagatgacccaaagcccctcctctctgtcagccagtgtgggcgatagagtcacaattacttgcagggctagccaggggatatcctcttggctcgcatggtaccagcagaagcctgagaaagccccaaagtcgcttatcttcgcggcttcaagcctgcaaagtggagttccgtcccggttttctggtagcggctccgggacggacttcaccttgacaatttcaagtttacagcccgaagattttgccacttattactgtcagcagtatatcagcttccctattacctttggacaaggcacacgcctggagatcaaa

SEQ ID NO: 23272 - RNA, 366 nt, synthetic construct
  misc_feature 1..366: note = derived and/or modified sequence opt3 from HuMab-005_HeavyChain_gamma-Chain_VDJ-Region
  source 1..366: mol_type = other RNA
gaggtgcagctggtccaaagcggcgccgaagttaagaaacccggggagtccctcaagatctcttgcaaggcttcaggatacagtttccacttttattggattggttgggtgagacagatgcctggcaaagggcttgaatggatgggaagcatatacccaggcgactccgataccaggtatcggccgtctttccagggtcaggtaacaatctcggcagacaaatcaattagcactgcctacctgcaatggacgagtttgaaggcgtccgataccgctatctattactgtgcccgccagcgaggggactattactacttttatggaatggatgtgtggggccagggcacaactgtcaccgtgtctagc

SEQ ID NO: 23273 - RNA, 321 nt, synthetic construct
  misc_feature 1..321: note = derived and/or modified sequence opt3 from HuMab-005_LightChain_VJ-Region
  source 1..321: mol_type = other RNA
gagatcgtgctgacccagagccccggcacactctccctttctcctggggaaagagccactctgtcatgcagggctagtcaaagcgtctcctcttcgtacttggcatggtatcagcagaagccaggacaggttccgcggttactgatttacggtgcctcaagccgcgcgacgggcatacccgaccgattcagtgggtccggatctggcaccgattttacactaactatcagccgtctcgagcctgaagacttcgctgtgtattactgtcaacagtatggttcctcactgacctttgggggaggcacaaaagtagagattaag

SEQ ID NO: 23274 - RNA, 357 nt, synthetic construct
  misc_feature 1..357: note = derived and/or modified sequence opt3 from HuMab-006_HeavyChain_VDJ-Region
  source 1..357: mol_type = other RNA
gaggtgcagctgctcgaaagcggcgggggacttgtccaacccggtggctccctgagattgtcttgcgccgcttcagggttcacctttagtaactacgcattaatctgggttaggcaggcccctggaaagggcctggagtgggtgagcattatacggggtggggcgggatccacatattacgctgactctgtaaaaggccgcttcactatctcgcgagataattcaaagaacacgctatatctccagatgaatagcctgcgtgccgaagacaccgcagtgtactattgtgccaaagctagaatttggggcccactttttgattactgggggcagggaacactggtcactgtgagttcc

SEQ ID NO: 23275 - RNA, 324 nt, synthetic construct
  misc_feature 1..324: note = derived and/or modified sequence opt3 from HuMab-006_LightChain_VJ-Region
  source 1..324: mol_type = other RNA
gagatcgtgctgacccagagccccgccacactctccctttctcctggcgaaagagctactctgtcatgcagggcaagtcaaagcgtctcctcttacttggcctggtatcagcagaagccagggcaggcgccgcggttactgatttacgacgcttcgaaccgcgccacgggaatacccgcacgattctcaggtagcggcagtgggaccgattttacactaactatctcctctctcgagcctgaagacttcgccgtttattactgtcaacagcgtagcaattggccacccctgacctttggaggcggtacaaaagtggagattaag

SEQ ID NO: 23276 - RNA, 360 nt, synthetic construct
  misc_feature 1..360: note = derived and/or modified sequence opt3 from HuMab-019_HeavyChain_VDJ-Region
  source 1..360: mol_type = other RNA
caggtgcaactgcagcagtggggcgccgggctccttaagcccagcgagaccctgtccttgacatgcgctgtctacggaggttctttctcagactattactggaactggatcagacagcctccaggcaaagggttagaatggattggagagatacaccatgttggcagtactaattataacccgagcctgaagtccagggtgacgatctctgtagatacctcgaaatcacaatttagcctaaagctcagttccgtgacagcagccgacactgcggtctactattgtgctcggggttactatgattctggggtgtactacttcgactattgggcccagggaaccctggttacagtgagctcc

SEQ ID NO: 23277 - RNA, 360 nt, synthetic construct
  misc_feature 1..360: note = derived and/or modified sequence opt3 from HuMab-021_HeavyChain_VDJ-Region
  source 1..360: mol_type = other RNA
caggtgcaactgcagcagtggggcgccgggctccttaagcccagcgagaccctgtccttgacatgcgctgtctacggaggttctttctcagactattactggaactggatcagacagcctccaggcaaagggttagaatggattggagagatacaccatagtggcagcactaattataacccgtccctgaagtctagggttacgatctcggtggataccagcaaaaatcaattttcactaaagctcagttccgtaacagcagccgacactgcggtgtactattgtgctcggggttactatgcctctggggtctactacttcgattattggggacagggcaccctggtgacagttagctcc

SEQ ID NO: 23278 - RNA, 321 nt, synthetic construct
  misc_feature 1..321: note = derived and/or modified sequence opt3 from HuMab-021_LightChain_VJ-Region
  source 1..321: mol_type = other RNA
gacatccagatgacccaaagcccctcctctctgtcagccagtgtgggcgatagagtcacaattacttgcagggctagccaggggatatcctcttggctcgcatggtaccagcagaagcctgagaaagccccaaagtcgcttatctatgcggcttcaagcctgcaaagtggagttccgtcccggttctctggtagcggctccgggacggactttaccttgacaatttcaagtttacagcccgaagatttcgccacttactattgtcagcagtacaacagctatcctatcacctttggacaaggcacacgcctggagattaaa

SEQ ID NO: 23279 - RNA, 360 nt, synthetic construct
  misc_feature 1..360: note = derived and/or modified sequence opt3 from HuMab-025_HeavyChain_VDJ-Region
  source 1..360: mol_type = other RNA
caggtgcaactgcagcagtggggcgccgggctccttaagcccagcgagaccctgtccttgacatgcgctgtctacggaggttctttctcagactattactggaactggatcagacagcctccaggcaaagggttagaatggattggagagatacaccatagtggcagcactaattataacccgtccctgaagtctagggttacgatctcggtggataccagcaaaaatcaattttcactaaagctcagttccgtaacagcagccgacactgcggtgtactattgtgctcggggttactatgattctggggtctactacttcgactattgggcccagggaaccctggtgacagttagctcc

SEQ ID NO: 23280 - RNA, 321 nt, synthetic construct
  misc_feature 1..321: note = derived and/or modified sequence opt3 from HuMab-025_LightChain_VJ-Region
  source 1..321: mol_type = other RNA
gacatccagatgacccaaagcccctcctctctgtcagccagtgtgggcgatagagtcacaattacttgcagggctagccaggggatatcccggtggctcgcatggtaccagcagaagcctgagaaagccccaaagtctcttatctatgcggcttcgtcactgcgcagcggagttccgagtcgattctccggttctggcagcgggacggactttaccttgacaatttcctcattacaacccgaagatttcgccacttactattgtcagcagtacaacagttatcctatcacctttggacagggcacacgtctggagattaaa

SEQ ID NO: 23281 - RNA, 360 nt, synthetic construct
  misc_feature 1..360: note = derived and/or modified sequence opt3 from HuMab-027_HeavyChain_VDJ-Region
  source 1..360: mol_type = other RNA
caggtgcaactgcagcagtggggcgccgggctccttaagcccagcgagaccctgtccttgacatgcgctgtctacggaggttctttctcagactatttttggaactggatcagacagcctccaggcaaagggttagaatggattggagagatacaccatagtggcagcactaattacaacccgtccctgaagtctagggttacgatctcggtggataccagcaaaaatcaattctcactaaacctcagttccgtaacagcagccgacactgcggtgtattactgtgctcggggtctgattgggtctggatattactattttgattactgggaccagggcacccttgtcacagtgagctcc

SEQ ID NO: 23282 - RNA, 360 nt, synthetic construct
  misc_feature 1..360: note = derived and/or modified sequence opt3 from HuMab-032_HeavyChain_VDJ-Region
  source 1..360: mol_type = other RNA
caggtgcaactgcagcagtggggcgccgggctccttaagcccagcgagaccctgtccttgacatgcgctgtctacggaggttctttctcaggctattactggagttggatcagacagcctccagggaaaggattagaatggattggcgagataaaccacagcggtgacactaattataacccgtccctgacgtctagggttaccatctcggtggatacatcaaagaatcaatttagcctaaaactcagttccgtaactgcagccgacaccgcggtgtactattgtgctcggctgttctacgggtctggaatttattactttgattactggggccagggcacacttgtcaccgtgagctcc

SEQ ID NO: 23283 - RNA, 321 nt, synthetic construct
  misc_feature 1..321: note = derived and/or modified sequence opt3 from HuMab-032_LightChain_VJ-Region
  source 1..321: mol_type = other RNA
gacatccagatgacccaaagcccctcctctctgtcagccagtgtgggcgatagagtcacaattacttgcagggctagccaggggatatcctcttggctcgcatggtaccagcagaagcctgagaaagccccaaagtcgcttatctatgcgacgttccggctgcaatcaggagttccgagccgctttagtggttccggctctgggaccgacttcacattgactattagctccttacagcccgaagattttgctacctactattgtcagcagtacaactcattccctccaacatttggacaaggcaccaaagtggagatcaag

SEQ ID NO: 23284 - RNA, 363 nt, synthetic construct
  misc_feature 1..363: note = derived and/or modified sequence opt3 from HuMab-033_HeavyChain_VDJ-Region
  source 1..363: mol_type = other RNA
caggtgcaactggtcgagagcggcgggggagttgtgcagaccggtagatccctcaggctttcttgcgccgcttcaggcttcacatttagtagccacgcaatgcattgggtacggcaggcccccgggaagggactggaatgggtggcggctatctcctacgacggctctaacaaatattacgccgattcggtcaagggtcgcttcactatttcacgagacaatagcaaaaacacgttgtatttacagatgaatagtctgcgtgcagaggataccgccgtgtactattgtgctagaggggactacatatcctctagcggagtttttgattattggggccaaggcactctagtgacagtctcctca

SEQ ID NO: 23285 - RNA, 360 nt, synthetic construct
  misc_feature 1..360: note = derived and/or modified sequence opt3 from HuMab-035_HeavyChain_VDJ-Region
  source 1..360: mol_type = other RNA
caggtgcaactgcagcagtggggcgccgggctccttaagcccagcgagaccctgtccttgacatgcgctatctacggaggttctttctcaggctattactggagttggattagacagcctccagggaaaggattagaatggataggcgagatcaaccacagcggtgacactaattataacccgtccctgacgtctagggtcaccatttcggttgatacatcaaagaatcaatttagcctaaaactcagttccgtgactgcagccgacaccgcggtatactattgtgctcggctgttctacgggtctggaatctattactttgattactggggccagggcacacttgtgaccgtcagctcc

SEQ ID NO: 23286 - RNA, 360 nt, synthetic construct
  misc_feature 1..360: note = derived and/or modified sequence opt3 from HuMab-036_HeavyChain_VDJ-Region
  source 1..360: mol_type = other RNA
caggtgcaactgcagcagtggggcgccgggctccttaagcccagcgagaccctgtccttgacatgcgctgtctacggaggttctttctcagactattactggagttggatcagacagcctccaggcaaagggttagaatggattggagagataaaccacagcggctccactaattataacccgtctctgaagtcgagggttacgatctcagtggataccagcaaaaatcaatttagtctaaagctctcctctgtaacagcagccgacactgcggtgtactattgtgctcggctgtactatggtagcgggacctactacttcgattattggggacagggcacacttgtcaccgtgtcctca

SEQ ID NO: 23287 - RNA, 321 nt, synthetic construct
  misc_feature 1..321: note = derived and/or modified sequence opt3 from HuMab-036_LightChain_VJ-Region
  source 1..321: mol_type = other RNA
gacatccagatgacccaaagcccctcctctctgtcagccagtgtgggcgatagagtcacaattacttgcagggctagccaggggatatcctcttggctcacgtggtaccagcagaagcctgagaaagcaccaaagtcgcttatctatgccgcgtcacggctgcaaagcggagttccgagtcgcttctccggttctggcagcgggaccgactttacattgactatttcctcattacagcccgaagatttcgctacctactattgtcagcagtacaacagttttcctccaacattcggacaaggcaccaaagtggagatcaag

SEQ ID NO: 23288 - RNA, 366 nt, synthetic construct
  misc_feature 1..366: note = derived and/or modified sequence opt3 from HuMab-041_HeavyChain_VDJ-Region
  source 1..366: mol_type = other RNA
gaggtgcagctggtccaaagcggcgccgaagttaagaaacccggggagtccctcaagatctcttgcaaaggatcaggttacagtttcaccagctattggattggctgggtgagacagatgcctgggaagggacttgaatggatgggctccatatacccaggtgactctcacacaaggtatcggccgtcgtttcaggggcaggtaactatctcagctgataaaagcattagtacggcatacctgcaatggtcctctttgaaggccagcgacaccgcgatgtattactgtgctcgccagaagggagatttctattactttttcggcttagacgtgtggggccaggggacagccatcactgtctcctca

SEQ ID NO: 23289 - RNA, 366 nt, synthetic construct
  misc_feature 1..366: note = derived and/or modified sequence opt3 from HuMab-044_HeavyChain_VDJ-Region
  source 1..366: mol_type = other RNA
gaggtgcagctggtccaaagcggcgccgaagttaagaaacccggggagtccctcaagatctcttgcaaaggatcaggttacagattcagtagctattggattggctgggtgaggcagatgcctgggaagggacttgaatggatgggctccatatttccaggtgactctgatacccggtactcgccgtcattccaggggcaggtaacaatcagcgctgacaaaagtattactacggcatatctgcaatggtcctctttgaaggccagcgataccgcgatgtactattgtgctcgccaggccggagactactattactacaacggcatggatgtgtggggccaggggacaactgtcaccgtgtcctca

SEQ ID NO: 23290 - RNA, 357 nt, synthetic construct
  misc_feature 1..357: note = derived and/or modified sequence opt3 from HuMab-049_HeavyChain_VDJ-Region
  source 1..357: mol_type = other RNA
gaggtgcagctgctcgaaagcggcggggaccttgtccaacccggaggttccctgagattgtcttgcgccgcttcaggcttcacctttagtagctacgcaatgtcctgggttaggcaggcccctgggaagggattagagtgggtgtctgcgatctcgggccggggtgggacaacttattacgctgattcagtaaaaggacgcttcacgattagccgagacaacagtaagtccaccctgtgtctacagatgaactctctccgtgccgaagatacagcagtgtattactgcgccaaagctagagcaaattgggactattttgattactggggccagggcactctggtcaccgtgagctcc

SEQ ID NO: 23291 - RNA, 321 nt, synthetic construct
  misc_feature 1..321: note = derived and/or modified sequence opt3 from HuMab-049_LightChain_VJ-Region
  source 1..321: mol_type = other RNA
gacatccagatgacccaaagcccctcctctgtgtcagccagtgtcggcgatagagttacaattacttgcagggctagccaggggatatcctcttggctggcatggtaccagcacaagcctggaaaagccccaaagctccttatctatgcggcttcgattctgcagtcaggtgtgccgagccggttcagtggctccgggtctggaacggactttaccttgacaatcagctccttacgccccgaggatttcgccacttactattgtcaacaggcaaactcatttcctattaccttcggccagggtacacgactggaaatcaaa

SEQ ID NO: 23292 - RNA, 357 nt, synthetic construct
  misc_feature 1..357: note = derived and/or modified sequence opt3 from HuMab-050_HeavyChain_VDJ-Region
  source 1..357: mol_type = other RNA
gaggtgcagctgctcgaaagcggcgggggacttgtccaacccggtggctccctgagattgtcttgcgccgcttcagggttcacctttagtagctacgcaatgaactgggttaggcaggcccctggaaagggcttagagtgggtgtccgcgatctctggtcgcgggggaacaacttattacgctgactcggtaaaaggccggttcacgatttcacgagataatagcaagaacaccctgtatctacagatgagttccctccgtgccgaagacacagcagtgtactattgtgccaaagctagagcaaattgggattactttgactattggggccaggggactctggtcaccgtgtctagc

SEQ ID NO: 23293 - RNA, 321 nt, synthetic construct
  misc_feature 1..321: note = derived and/or modified sequence opt3 from HuMab-050_LightChain_VJ-Region
  source 1..321: mol_type = other RNA
gacatccagatgacccaaagcccctcctctgtgtcagccagtgtcggcgatagagttacaattacttgcagggctagccaggggatatcctcttggctggcatggtaccagcacaagcctggaaaagccccaaagctccttatctatgcggcttcgattctgcagtcaggtgtgccgagccggttcagtggctccgggtctggaacggactttaccttgacaatcagctccttacaacccgaggatttcgccacttactattgtcagcaggcaaactcatttcctattaccttcggccagggtacacgcctggaaatcaaa

SEQ ID NO: 23294 - RNA, 360 nt, synthetic construct
  misc_feature 1..360: note = derived and/or modified sequence opt3 from HuMab-054_HeavyChain_VDJ-Region
  source 1..360: mol_type = other RNA
caggtgcaactgcagcagtggggcgccgggctccttaagcccagcgagaccctgtccttgacatgcgctgtctacggaggttctttctcaggctattactggagttggatcagacagcctccagggaaaggattagaatggattggcgagatacaccatagcggttccactaactataatccgtctctgaagtcgagggttacgatctcagtggacaccagcaaaaaccaatttagtctaaagctctcctctgtaacagcagccgatactgcggtgtactattgtgctcggctgtggtacgggagcggatcctattacttcgactactggggccagggcacccttgtcacagtgtcaagt

SEQ ID NO: 23295 - RNA, 321 nt, synthetic construct
  misc_feature 1..321: note = derived and/or modified sequence opt3 from HuMab-054_LightChain_VJ-Region
  source 1..321: mol_type = other RNA
gacatccagatgacccaaagcccctcctctctgtcagccagtgtgggcgatagagtcacaattacttgcagggctagccaggggatatcctcttggctcgcatggtaccagcagaagcctgagaaagccccaaagtcgcttatctatgcggcttcaagcctgcaaagtggagttccgtcccggttctctggtagcggctccgggacggactttaccttgacaatttcaagtttacagcccgaagatttcgccacttactattgtcagcagtacaacagctttcctccaaccttcggaggcggtacaaaagtggagatcaag

SEQ ID NO: 23296 - RNA, 357 nt, synthetic construct
  misc_feature 1..357: note = derived and/or modified sequence opt3 from HuMab-055_HeavyChain_VDJ-Region
  source 1..357: mol_type = other RNA
gaggtgcagctgctcgaaagcggcgggggacttgtccaacccggtggctccctgagattgtcttgcgccgcttcagggttcacctttagtagctacgcaatgaactgggttaggcaggcccctggaaagggcttagagtgggtgtccgcgatctctggtcgcgggggaacaacttattacgctgactcggtaaaaggccggttcacgatttcacgagataatagcaagagtaccctgtgtctacagatgaactccctccgtgccgaagacacagcagtgtattactgcgccaaagctagagcaaattgggattattttgactactggggccaggggactctggtcaccgtgtctagc

SEQ ID NO: 23297 - RNA, 366 nt, synthetic construct
  misc_feature 1..366: note = derived and/or modified sequence opt3 from HuMab-059_HeavyChain_VDJ-Region
  source 1..366: mol_type = other RNA
caggtgcaactggtccagagcggcgccgaggttaagaagcccggggcttccgtgagagtaccttgcaaggcatctggatacaccttcacaaggtatggtatctcatgggtgcggcaggccccaggccaggggctcgaatggatgggatggattagtgcgtacaacggcaaaacttattacgctcaaaaacttcagggtcgcgtcacgatgaccacagacactagcacctccacagcctatatggagctgcgatctttgcgttcggatgacaccgcagtgtactattgtgccagatcaccgttactgtggtttgaggaactatacttcgattactgggggcagggaactctcgttacagtgagcagt

SEQ ID NO: 23298 - RNA, 324 nt, synthetic construct
  misc_feature 1..324: note = derived and/or modified sequence opt3 from HuMab-059_LightChain_VJ-Region
  source 1..324: mol_type = other RNA
gagatcgtgctgacccagagccccggcacactctccctttctcctggggaaagagccactctgtcatgcagggctagtcaaagcgtctcctctacgtacttggcatggtatcagcagaagccaggacaggccccgcggttactgatttacggtgcgtcgtcacgcgctaccggcatacccgaccgattcagcgggagtggatccggcacagattttactctaaccatctctcgtctcgagcctgaagacttcgccgtttattactgtcaacagtatggtacaagcctgtttaccttcgggccaggaactaaagtggatattaag

SEQ ID NO: 23299 - RNA, 366 nt, synthetic construct
  misc_feature 1..366: note = derived and/or modified sequence opt3 from HuMab-060_HeavyChain_VDJ-Region
  source 1..366: mol_type = other RNA
gaggtgcagctggtccaaagcggcgccgaagttaagaaacccggggagtccctcaagatctcttgcaaaggatcaggttacagattcaccagttattggattggctgggtgaggcagatgcctgggaagggacttgaatggatgggcagcatatacccaggtgactcctatacacggaactctccgtcgtttcaggggcaggtaactatctcagctgataaaagcattgcaacggcctacctgcaatggaatagtttgaaggcgtccgacaccgctatgtattactgtgcccgccacgcaggagatttctattactttgacggcttagatgtgtggggccaggggacaactgtcaccgtgtctagc

SEQ ID NO: 23300 - RNA, 327 nt, synthetic construct
  misc_feature 1..327: note = derived and/or modified sequence opt3 from HuMab-060_LightChain_VJ-Region
  source 1..327: mol_type = other RNA
gagatcgtgctgacccagagccccggcacactctccctttctcctggggaaagagccactctgtcatgcagggctagtcaaagcgtctcctcttcgtacttggcatggtatcagcagaagccaggacaggccccgcggttactgatttacggtgcgtcaagccgcgctacgggcatacccgaccgattcagtgggtccggatctggcaccgattttacactaactatcagccgtctcgagcctgaagacttcgccgtttattactgtcaacagtatggttcctcaccacccattacctttgggcagggaacaagactggagatcaaa

SEQ ID NO: 23301 - RNA, 366 nt, synthetic construct
  misc_feature 1..366: note = derived and/or modified sequence opt3 from HuMab-067_HeavyChain_VDJ-Region
  source 1..366: mol_type = other RNA
gaggtgcagctggtccaaagcggcgccgaagttaagaaacccggggagtccctcaagatctcttgcaaaggatcaggttacagtttcaccagctattggattggctgggtgagacagatgcctgggaagggacttgaatggatgggcataatctacccaggtgactccgatacaaggtattctccgtcgtttcaggggcaggtaactatttcagtggacaaaagcatcagtacggcttacctgcaatggtcctctttgaaggcaagcgataccgccatgtattactgtgcgcggcagaagggagactattactaccactatggcttagatgtctggggccaggggacaactgtgaccgtttcctca

SEQ ID NO: 23302 - RNA, 366 nt, synthetic construct
  misc_feature 1..366: note = derived and/or modified sequence opt3 from HuMab-072_HeavyChain_VDJ-Region
  source 1..366: mol_type = other RNA
gaggtgcagctggtccaaagcggcgccgaagttaagaaacccggggagtccctcaagatctcttgcaaaggatcaggttacagtttcaccagctattggattggctgggtgagacagatgcctgggaagggacttgaatggatgggcataatctacccaggtgactccgatacaaggtattctccgtcgtttcaggggcaggtaactatttcagctgacaaaagcatcagtacggcatacctgcaatggtcctctttgaaggccagcgataccgcgatgtattactgtgctcggcagaagggagactattactacttcaacggcttagatgtgtggggccaggggacaactgtcaccgtgtcctca

SEQ ID NO: 23303 - RNA, 327 nt, synthetic construct
  misc_feature 1..327: note = derived and/or modified sequence opt3 from HuMab-072_LightChain_VJ-Region
  source 1..327: mol_type = other RNA
gagatcgtgctgacccagagccccggcacactctccctttctcctggggaaagagccactctgtcatgcagggctagtcaaagcgtctcctcttcgtacttggcatggtatcagcagaagccaggacaggccccgcggttactgatttacggtgcgtcaagccgcgctacgggcatacccgaccgattcagtgggtccggatctggcaccgattttacactaactatcagccgtctcgagcctgaagacttcgccgtttattactgtcaacagtatggttcctcaccaagactgacctttgggggaggcacaaaagtggagattaag

SEQ ID NO: 23304 - RNA, 363 nt, synthetic construct
  misc_feature 1..363: note = derived and/or modified sequence opt3 from HuMab-084_HeavyChain_VDJ-Region
  source 1..363: mol_type = other RNA
caggtgcaactggtccagagcggcgccgaggttaagaaacccgggtcctctgtgaaggtatcatgcaaagctagtggaggtaccttcagaacatacgcaatcaactgggtgaggcaggcccctggccaggggctcgaatggatgggacggattaatactgtccttggcatagtgaaccacgcgcaaaagtttcagggtcgcgttacgatcaccgctgacaaaagcacaaatactgcctatatggagctgaactccttgcgatctgaagataccgcagtgtactattgtgcccgtgagaagggggtcgactactattacggaattgaagtgtggggccagggcacaaccgtaactgtttcgtca

SEQ ID NO: 23305 - RNA, 321 nt, synthetic construct
  misc_feature 1..321: note = derived and/or modified sequence opt3 from HuMab-084_LightChain_VJ-Region
  source 1..321: mol_type = other RNA
gacatccagatgacccaaagcccctcctctgtgtcagccagtgtcggcgatagagttacaattacttgcagggctagccaggggatatcctcttggctggcatggtaccagcacaagcctggaaaagccccaaagctccttatctatgtggcgtcgacgctgcagtcaggtgtaccgagccggttcagtggctccgggtctggaaccgactttacattgactattagctccttacaacccgaggatttcgctacctactattgtcagcaggccaactcatttcctctgacattcggcggtgggaccaaagtggaaatcaag

SEQ ID NO: 23306 - RNA, 360 nt, synthetic construct
  misc_feature 1..360: note = derived and/or modified sequence opt3 from HuMab-091_HeavyChain_VDJ-Region
  source 1..360: mol_type = other RNA
caggtgcaactgcagcagtggggcgccgggctccttaagcccagcgagaccctgtccttgacatgcgctgtctctggaggttcattcagtggctactattggacttggatcagacagcctccagggaaaggattagaatggattggcgagatataccacagcggtgacacgaactataatccgtccctgaagtctagggttaccatctcggtggatacaagcaaaaaccaattttcactaaagctctacagtgtaactgcagccgacaccgcggtgtattactgtgctcggctgtatttcgggtccggaatttactaccttgattattggggccagggcacactggtcaccgtgtctagc

SEQ ID NO: 23307 - RNA, 321 nt, synthetic construct
  misc_feature 1..321: note = derived and/or modified sequence opt3 from HuMab-091_LightChain_VJ-Region
  source 1..321: mol_type = other RNA
gacatccagatgacccaaagcccctcctctctgtcagccagtgtgggcgatagagtcacaattacttgcagggctagccaggggatatcctcttggctcgtttggtaccagcagaagcctgagaaagcaccaaagtcgcttatctatgccgcgtcaagcctgcaaagtggagtgccgtcccggttctctggtagcggctccgggacggactttaccttgacaatttcaagtttacagcccgaagatttcgctacttactattgtcagcagtacaacagctttcctccaaccttcggacaaggcacaaaagtagagatcaag

SEQ ID NO: 23308 - RNA, 366 nt, synthetic construct
  misc_feature 1..366: note = derived and/or modified sequence opt3 from HuMab-093_HeavyChain_VDJ-Region
  source 1..366: mol_type = other RNA
gaggtgcagctggtccaaagcggcgccgaagttaagaaacccggggagtccctcaagatctcttgcaaaggatcaggttacagtttcaccagctattggattggctgggtgagacagatgcctgggaagggacttgaatggatgggcaggatatacccaggtgactccgatacacggtattctccgtcgtttcaggggcaggtaactatctcagctgacaaaagcattacgaccgcatacctgcaatggagttccttgcgcgcctctgatacagcgatgtattactgtgctcgacagcgtggagactattactacttctttggcttagatatctggggccaggggactaccgtgacagtcagcctg

SEQ ID NO: 23309 - RNA, 372 nt, synthetic construct
  misc_feature 1..372: note = derived and/or modified sequence opt3 from HuMab-098_HeavyChain_VDJ-Region
  source 1..372: mol_type = other RNA
gaggtgcagctgctcgaaagcggcgggggacttgtccaacccggtggctccctgagattgtcttgcgccgcttcagggttcacctttagtaattacggaatgagctgggttaggcaggcacctggcaagggtttagagtgggtgtccgccatctctgggtcggcgtattcaacatactatgctgacagcgtaaaaggacggttcactattagtcgcgataattccaagaacacgctgtggctacagatgaactctctccgagccgaagacaccgcagtgtactattgtgccaaagctcactaccatggcagcggctcctattacacactgtttgattactgggggcagggaactcttgtcaccgtgtcaagt

SEQ ID NO: 23310 - RNA, 321 nt, synthetic construct
  misc_feature 1..321: note = derived and/or modified sequence opt3 from HuMab-098_LightChain_VJ-Region
  source 1..321: mol_type = other RNA
gacatccagatgacccaaagcccctcctctctgtcagccagtgtgggcgatagagtcacaattacttgcagggctagccaggggatatcctcttggctcgcatggtaccagcagaagcctgagaaagccccaaagtcgcttatctatgcggcttcaagcctgcaaagtggagttccgtcccggttctctggtagcggctccgggacggactttaccttgacaatttcaagtttacagcccgaagatttcgccacttactattgtcagcagtacaacagctatccttacacctttggacaaggcacaaaactggagatcaag

SEQ ID NO: 23311 - RNA, 372 nt, synthetic construct
  misc_feature 1..372: note = derived and/or modified sequence opt3 from HuMab-100_HeavyChain_VDJ-Region
  source 1..372: mol_type = other RNA
gaggtgcagctgctcgaaagcggcgggggacttgtccaacccggtggctccctgagattgtcttgcgccgcttcagggttcacctttaacaattacggaatgaactgggttaggcaggcacctggcaagggtttagagtgggtgagtgccatcagcgggacaggatattccacttactatgcggactctgtaaaaggccggttcacgatttcgcgcgataattcaaagaacaccctgtacctacagatgaatagcctccgagctgaagacacagccgtgtattactgtgcaaaagcccactattttggcagtgggtcctactacactctgttcgattattggggacagggtacccttgtcacagtgtctagc

SEQ ID NO: 23312 - RNA, 372 nt, synthetic construct
  misc_feature 1..372: note = derived and/or modified sequence opt3 from HuMab-106_HeavyChain_VDJ-Region
  source 1..372: mol_type = other RNA
gaggtgcagctggtccaaagcggcgccgaagttaagaaacccggggagtccctcaagatctcttgcaaaggatcaggttacagtttcaccagatattggattggctgggtgaggcagatgcctgggaagggacttgaatggatgggcataatctacccaggtgacagcgatacacggtattccccgtcttttcaggggcaggtaactatttcggctgacaaatcaatcagcacggcatacctgcaatggagttccttgaaggcctctgataccgcgatgtattactgtgctcgcttaacaggagaccgaggcttcgattattacagcggcatggacgtgtgggggcagggaactaccgtcacagtgtcctca

SEQ ID NO: 23313 - RNA, 321 nt, synthetic construct
  misc_feature 1..321: note = derived and/or modified sequence opt3 from HuMab-106_LightChain_VJ-Region
  source 1..321: mol_type = other RNA
gagatcgtgctgacccagagccccggcacactctccctttctcctggggaaagagccactctgtcatgcagggctagtcaaagcgtctcctcttcgtacttggcatggtatcagcagaagccaggacaggccccgcggttactgatttacggtgcgtcaagccgcgctacgggcatacccgaccgattcagtgggtccggatctggcaccgattttacactaactatcagccgtctcgagcctgaagacttcgccgtttattactgtcaacagtatggttcctcatttaccttcgggccaggaacaaaagtggatattaag

SEQ ID NO: 23314 - RNA, 351 nt, synthetic construct
  misc_feature 1..351: note = derived and/or modified sequence opt3 from HuMab_10F8_HeavyChain_V-Region
  source 1..351: mol_type = other RNA
caggtgcaactggtcgagagcggcgggggagttgtgcagcccggtagatccctcaggctttcttgcaccgcctcaggcttcacatttagtcactacgggatgtattgggtacggcaggctcctggaaagggcctggaatgggtggcagtcatctggtacgacggtagctatgagtacaatgaagattccgtgaaagggcgcttcactatttctcgagacaattcgaagaacacgttgtatttacagatgaactcactgcgtgccgaggataccgcggtttactattgtgctagagacagggtgggactatttgattactggggccaaggcacactcgtcactgtgagcagt

SEQ ID NO: 23315 - RNA, 408 nt, synthetic construct
  misc_feature 1..408: note = derived and/or modified sequence opt3 from HuMab_10F8_HeavyChain_V-Region_Precursor
  source 1..408: mol_type = other RNA
atggagttcggcctgagctgggtgtttctcgtcgcccttctgagaggggttcagtgccaagtgcagttggtagaatccggaggtggcgtggtccagcccgggaggtctttacggctgtcatgtaccgctagtggattcacatttagccactacggcatgtattgggtgcgccaggcacctggtaaggggctagagtgggttgccgtgatctggtacgacggatcctatgaatacaacgcggattctgtcaaaggccgattcactatttcgcgtgacaattcaaagaacacgctctatctgcaaatgaatagccttagagctgaggataccgccgtgtactattgcgcaagggaccgggtaggcctgtttgattactgggggcagggaacattggttactgtgagttcc

SEQ ID NO: 23316 - RNA, 321 nt, synthetic construct
  misc_feature 1..321: note = derived and/or modified sequence opt3 from HuMab_10F8_LightChain_V-Region
  source 1..321: mol_type = other RNA
gagatcgtgctgacccagagccccggcacactctccctttctcctggggaaagagccactctgtcatgcagggctagtcaaagcatttcctcttcgtacttggcatggtatcagcagaagccaggacaggccccgcggttactgatatacggtccctcaagccgcgcgacgggcatccctgaccgattcagtgggtccggatctggcaccgattttacactaactattagccgtctcgagccagaagacttcgctgtctattactgtcaacagtatgccggttccctgacctttgggcccggaacaaaagttgatatcaag

SEQ ID NO: 23317 - RNA, 381 nt, synthetic construct
  misc_feature 1..381: note = derived and/or modified sequence opt3 from HuMab_10F8_LightChain_V-Region_Precursor
  source 1..381: mol_type = other RNA
atggagacccccgcccagctcctgttccttctgttgttatggctgcctgacacaactggcgaaatcgtgctaacgcaaagcccagggaccctctccctgtctccgggagagagagctacactttcatgcagggcaagtcagagcatttcctcttcgtacctggcctggtatcagcagaagcccggtcaagcgcctcggttgctcatatacggcccatcaagccgcgctactgggatccccgatcgatttagtggatccggctctggtaccgacttcacactgaccattagccgtctggaacctgaggattttgccgtctattactgtcagcagtatgcagggtccctcactttcggaccaggcacaaaagttgacatcaag

SEQ ID NO: 23318 - RNA, 357 nt, synthetic construct
  misc_feature 1..357: note = derived and/or modified sequence opt3 from HuMab-111_HeavyChain_VDJ-Region
  source 1..357: mol_type = other RNA
caggtgcaactggtccagagcggcgccgaggttaagaaacccgggtcctctgtgaaggtatcatgcaaagctagtggaggtaccttcagctcctacggcatctcttgggtgagacaggcacctgggccaggactcgaatggatgggcaggattataccgatccttggtattgccaactatgcgcagaagtttcaagggcgggtcacaatcactgctgacaaatcgacgaataccgcctacatggagctgagctcattgcgcagtgaagatacagcagtgtattactgtgcccgagaccaggagtattcctctaactggtactattggggacagggcactttagttaccgtgagctcc

SEQ ID NO: 23319 - RNA, 321 nt, synthetic construct
  misc_feature 1..321: note = derived and/or modified sequence opt3 from HuMab-111_LightChain_VJ-Region
  source 1..321: mol_type = other RNA
gagatcgtgctgacccagagccccggcacactctccctttctcctggggaaagagccactctgtcatgcagggctagtcaaagcgtccggtcctcttacttggcatggtatcagcagaagccaggacaggccccgcgcttactgatttacggtgcgtcgtcacgagctacgggcatacccgaccgtttcagcgggagtggatccggcaccgattttacactaactatctctagactcgagcctgaagacttcgccgtttattactgtcaactgtatggtagctccccaacctttgggcccggaacaaaagtggatattaag

SEQ ID NO: 23320 - RNA, 363 nt, synthetic construct
  misc_feature 1..363: note = derived and/or modified sequence opt3 from HuMab-123_HeavyChain_VDJ-Region
  source 1..363: mol_type = other RNA
caggtgcaactggtccagagcggcgccgaggttaagaagcccggggcttccgtgaaggtatcttgcaaagcagccggatacaccttcacaaactatggtatctcatgggtgagacaggcgcctggccaggctctcgaatggatggggtggattactacgtacagtagcaataccatatatgcccaaaaacttcagggaagggtcacaatgactaccgacacatccacctctactgcatacatggagctgcggtcgttgcgctcagatgacacagccgtgtattactgtgctcgagatcgtgttgtggtcagaccagactattttgattactggggccagggtaccttagtgacggtaagcagt

SEQ ID NO: 23321 - RNA, 321 nt, synthetic construct
  misc_feature 1..321: note = derived and/or modified sequence opt3 from HuMab-123_LightChain_VJ-Region
  source 1..321: mol_type = other RNA
gagatcgtgctgacccagagccccgccacactctccctttctcctggcgaaagagctactctgtcatgcagggcaagtcaaagcgtctcctcttacttggcctggtatcagcagaagccagggcaggcgccgcggttactgatttacgacacgtcgaaccgcgctaccggaatacccgcccgattctcaggtagcggcagtgggacagattttactctaaccatctcctctctcgagcctgaagacttcgcagtttattactgtcaacagcgtagccactggccaagaacatttggacagggcaccaaagtggagattaag

SEQ ID NO: 23322 - RNA, 363 nt, synthetic construct
  misc_feature 1..363: note = derived and/or modified sequence opt3 from HuMab-124_HeavyChain_VDJ-Region
  source 1..363: mol_type = other RNA
caggtgcaactggtccagagcggcgccgaggttaagaaacccggggcttccgtgaaggtatcttgcaaagcagccggatacaccttcacaaactatggtatctcatgggtgagacaggcgcctggccaggggctcgaatggatgggatggattataacttacaatggcaacacgatctatgctcaaaggtttcaggaccgggtcaccatgacaactgataccagtacaagcaccgcctacatggagcttcgctccctgcgatctgacgatactgcagtgtattactgtgcccgtgacagaattatcgttaggccagattatttcgactactggggtcaggggacattggtgaccgtctcgtca

SEQ ID NO: 23323 - RNA, 372 nt, synthetic construct
  misc_feature 1..372: note = derived and/or modified sequence opt3 from HuMab-125_HeavyChain_VDJ-Region
  source 1..372: mol_type = other RNA
gaggtgcagctgctcgaaagcggcgggggacttgtccaacccggtggctccctgagattgtcttgcgccgcttcagggttcacctttacagactacgcaatgaactgggttaggcaggcccctggaaagggcttagagtgggtgagtactatcagcggttccgggtatgcgacgtactatgctgattctgtaaaaggacggttcaccatttcgcgcgacaattcaaagacaactctgtacctacagatgaacagcctccgagccgaagataccgcagtgtattactgtgccaaaggccacacactgggcagtgggtcctattacaccctttttgactactggggacagggtactctggtcacagtgtctagc

SEQ ID NO: 23324 - RNA, 321 nt, synthetic construct
  misc_feature 1..321: note = derived and/or modified sequence opt3 from HuMab-125_LightChain_VJ-Region
  source 1..321: mol_type = other RNA
gacatccagatgacccaaagcccctcctctctgtcagccagtgtgggcgatagagtcacaattacttgcagggctagccaggggataaactcctggctcgcatggtaccagcagaagcctgagaaagccccaaagtctcttatctatgcggcttcgtcactgcaaagcggagttccgagtcggttctccggttctggcagcgggacggactttaccttgacaatttcctcattacagcccgaagatttcgccacttactattgtcagcagtacaatagttatccttacacctttggacaaggcacaaaactggagatcaag

SEQ ID NO: 23325 - RNA, 369 nt, synthetic construct
  misc_feature 1..369: note = derived and/or modified sequence opt3 from HuMab-127_HeavyChain_VDJ-Region
  source 1..369: mol_type = other RNA
gaggtgcagctggtccaaagcggcgccgaagttaagaaacccggggagtccctcaccatctcttgcaagggatcaggttacagtttcagcatttattggataggctgggtgagacagatgcctgggaaaggacttgaatggatgggcatcatttttccaggtgactccgatatcaggtactctccgtcgttccaggggcaggtaacaatttcagctgacaagagcatcagtactgcatatctgcaatggtcctctttgaaagccagcgatacggcgatgtactattgtgctcggcagcccggagactggtcccctcgccactggtactttgatttatggggccgaggcaccctggtgacagtctcaagt

SEQ ID NO: 23326 - RNA, 321 nt, synthetic construct
  misc_feature 1..321: note = derived and/or modified sequence opt3 from HuMab-127_LightChain_VJ-Region
  source 1..321: mol_type = other RNA
gtgatctggatgacccagagcccctccctgctctctgcctcaacaggcgacagagtcactattagttgcaggatgagccaagggatatcctcttaccttgcttggtatcagcagaagcctggaaaagcaccagagctgttgatctacgccgcgtcgacgttacagtcaggtgttccgagccggttcagtggctccgggtctggaaccgattttacactgactattagctatctacaatccgaagacttcgctacctactattgtcagcagtactattcatttcccctcacattcggcggtgggaccaaggtggagatcaaa

SEQ ID NO: 23327 - RNA, 357 nt, synthetic construct
  misc_feature 1..357: note = derived and/or modified sequence opt3 from HuMab-129_HeavyChain_VDJ-Region
  source 1..357: mol_type = other RNA
caggtgcaactggtcgagagcggcgggggagttgtgcagcccggtagatccctcaggctttcttgcgccgcttcaggcttcacctttagtacattcgcaatccactgggtacggcaggcccctgggaagggactggaatgggtggcggtcattagctacgacggcggtcataaattttatgctgattccgtgaaggggcgcttcactatatctcgagacaactcgaaaaatacgttgtacttacagatgaactcactgcgtgccgaggataccgcaatgtattactgtgccagaggactaggcgtttggggcgcttttgactattgggggcaaggaacactcgtgactgtcagcagt

SEQ ID NO: 23328 - RNA, 318 nt, synthetic construct
  misc_feature 1..318: note = derived and/or modified sequence opt3 from HuMab-129_LightChain_VJ-Region
  source 1..318: mol_type = other RNA
gagatcgtgctgacccagagccccgccacactctccctttctcctggcgaaagagctactctgtcatgcagggcaagtcaaagcgtctcctcttacttggcctggtatcagcagaagccagggcaggcgccgcggttactgatttacgacgcttcgaaccgcgccacgggaatacccgcacgattctcaggtagcggcagtgggaccgattttacactaactatctcctctctcgagcctgaagacttcgccgtttattactgtcaacagcgtagcaattggtggacctttggacagggcacaaaagtggagattaag

SEQ ID NO: 23329 - RNA, 375 nt, synthetic construct
  misc_feature 1..375: note = derived and/or modified sequence opt3 from HuMab-132_HeavyChain_VDJ-Region
  source 1..375: mol_type = other RNA
caggtgcaactggtccagagcggcgccgaggttaagaaacccggggcttccgtgaaggtatcttgcaaagcatcaggatacaccttcacaagttatggtatcagctgggtgagacaggcccctggccaggggctcgaatggatgggatggatttccgcgtacaacggcaattctaactatgtccaaaagtttcagggtagggtgactatgacgaccgacacaactacctcgacagcttacatggagcttcggtcactgaccagcgatgacactgccgtttattactgtgcacgcgaatatagttacgattccgggacatacttctattacggaatggacgtgtggggccagggcaccacggtcactgtgtctagc

SEQ ID NO: 23330 - RNA, 324 nt, synthetic construct
  misc_feature 1..324: note = derived and/or modified sequence opt3 from HuMab-132_LightChain_VJ-Region
  source 1..324: mol_type = other RNA
gagatcgtgctgacccagagccccgccacactctccctttctcctggcgaaagagctactctgtcatgcagggcaagtcaaagcgtctcctcttacttggcctggtatcagcagaagccagggcaggcgccgcggttactgatttacgacgcttcgaaccgcgccacgggaatacccgcacgattctcaggtagcggcagtgggaccgattttacactaactatctcctctctcgagcctgaagacttcgccgtttattactgtcaacagcgtagcaattggccaatgtatacctttggacagggcacaaaactggagattaag

SEQ ID NO: 23331 - RNA, 360 nt, synthetic construct
  misc_feature 1..360: note = derived and/or modified sequence opt3 from HuMab-143_HeavyChain_VDJ-Region
  source 1..360: mol_type = other RNA
caggtgcaactgcagcagtggggcgccgggctccttaagcccagcgagaccctgtccttgacatgcgctgtctacggaggttctttctcaggctattactggaactggatcagacagcctccagggaaaggattagaatggattggcgagatacaccatagtggtagcgcaaattataacccgtccctgatgtctagggttactatctcggtggacacgtcaaagaatcaatttagcctacagctcagttccgtaaccgccgcggatacagctgtgtactattgtgcccgggggtactatggatctggctactactatttcgactactggggccaggggactctggtcaccgtgagctcc

SEQ ID NO: 23332 - RNA, 321 nt, synthetic construct
  misc_feature 1..321: note = derived and/or modified sequence opt3 from HuMab-143_LightChain_VJ-Region
  source 1..321: mol_type = other RNA
gacatccagatgacccaaagcccctcctctctgtcagccagtgtgggcgatagagtcacaattacttgcagggctagccaggggatatcctcttggctcgcatggtaccagcagaagcctgagaaagccccaaagtcgcttatctatgcggcttcacggctgcaaagcggagttccgagtcgcttctccggttctggcagcgggacggactttaccttgacaatttcctcattacagcccgaagatttcgccacttactattgtcagcagtacaacagttatcctatcacctttggacaaggcacacgactggagattaaa

SEQ ID NO: 23333 - RNA, 366 nt, synthetic construct
  misc_feature 1..366: note = derived and/or modified sequence opt3 from HuMab-150_HeavyChain_VDJ-Region
  source 1..366: mol_type = other RNA
gaggtgcagctggtccaaagcggcgccgaagttaagaaacccggggagtccctcaagatctcttgcaaaggatcaggttacagtttcaccagctattggattggctgggtgagacagatgcctgggaagggacttgaatggatgggctccatatacccaggtgactctcacacaaggtatcggccgtcgtttcaggggcaggtaactatctcagctgataaaagcattagtacggcatacctgcaatggtcctctttgaaggccagcgacaccgcgatgtattactgtgctcgccaggccggagattattactactataacggcatggacgtgtggggccaggggacaactgtcaccgtgtcctca

SEQ ID NO: 23334 - RNA, 321 nt, synthetic construct
  misc_feature 1..321: note = derived and/or modified sequence opt3 from HuMab-150_LightChain_VJ-Region
  source 1..321: mol_type = other RNA
gagatcgtgctgacccagagccccggcacactctccctttctcctggggaaagagccactctgtcatgcagggctagtcaaagcgtctcctcttcgtacttgacgtggtatcagcagaagccaggacaggcaccgcggttactgatttacggtgcctcaagccgcgcgaccggcatacccgaccgattcagtgggtccggatctggcacagattttactctaaccatcagccgtctcgagcctgaagacttcgctgtttattactgtcaacagtatggttcctcactgacatttgggggaggcaccaaagtggagattaag

SEQ ID NO: 23335 - RNA, 363 nt, synthetic construct
  misc_feature 1..363: note = derived and/or modified sequence opt3 from HuMab-152_HeavyChain_VDJ-Region
  source 1..363: mol_type = other RNA
caggtgcaagtcgttgagagcggcgggggagtggtacagcccggtagatccctgaggctctcttgcgccgcttcaggcttcacctttagtagctacgcaatgcactgggtgcggcaggcccctgggaagggacttgaatgggtcgcggtgatctcctatgacggctcttacaaatattacgctgattcggttaagggtcgcttcacaatttcacgagacaacagcaaaaatactctgtatttgcagatgaacagtttacgtgccgaggatacggcagtgtactattgtgccagagggtccataaccggatctacaggcgtctttgactactggggccaagggactctggtgaccgtaagctcc

SEQ ID NO: 23336 - RNA, 321 nt, synthetic construct
  misc_feature 1..321: note = derived and/or modified sequence opt3 from HuMab-152_LightChain_VJ-Region
  source 1..321: mol_type = other RNA
gacatccagatgacccaaagcccctcctctctgtcagccagtgtgggcgatagagtcacaattacttgcagggctagccaggggataaactcctggctcgcatggtaccagcagaagcctgagaaagccccaaagtctcttatctatgacgcgtcgtcactgcaaagcggagttccgagtcggttctccggttctggcagcgggacggattttaccttgacaatttcctcattacagcccgaaaatttcgctacttactattgtcagcagtacaacagttatcctatcacctttggacaaggcacacgcctggagattaaa

SEQ ID NO: 23337 - RNA, 363 nt, synthetic construct
  misc_feature 1..363: note = derived and/or modified sequence opt3 from HuMab-153_HeavyChain_VDJ-Region
  source 1..363: mol_type = other RNA
caggtgcaactggtcgagagcggcgggggagttgtgcagcccggtagatccctcaggctttcttgcgccgcttcaggcttcacctttagtgactacgtaatccactgggtgcggcaggcacctgggaaaggactggaatgggtcacagtgattagctatgatggctccaacaaatactatgccgactctgttaagggtcgcttcactatatcgcgagataattcaaagaacacgttgtacttacagatgaatagcctgagtgcggaggacaccgctatgtattactgtgcccgtgggggaatcacaggcactaccggcgtgtttgattattgggggcaaggaaccctagtcacagtgtcctct

SEQ ID NO: 23338 - RNA, 321 nt, synthetic construct
  misc_feature 1..321: note = derived and/or modified sequence opt3 from HuMab-153_LightChain_VJ-Region
  source 1..321: mol_type = other RNA
gacatccagatgacccaaagcccctcctctctgtcagccagtgtgggcgatagagtcacaattacttgcagggctagccaggggatatcctcttggctcgcatggtaccagcagaagcctgagaaagccccaaagtcgcttatctatgacgcgtcaagcctgcaaagtggagttccgtcccggttctctggtagcggctacgggacggatttttccttgaccatttcaagtttacagcccgaagacttcgctatctattactgtcagcagtataaaagctaccctattacatttggacaaggcactcgcctggagatcaag

SEQ ID NO: 23339 - RNA, 378 nt, synthetic construct
  misc_feature 1..378: note = derived and/or modified sequence opt3 from HuMab-159_HeavyChain_VDJ-Region
  source 1..378: mol_type = other RNA
gaggtgcagctggtccaaagcggcgccgaagttaagaaacccggggagtccctcaagatctcttgcaaaggatcaggttacaacttcaccagttattggattggctgggtgagacagatgcctgggaagggacttgaatggatgggcataatctacccaggtgacagcgatacaaggtattccccgtcttttcaggggcaggtaactatttcggctgacaaatcaatcagcacggcatacctgcaatggagttccttgaaggcctctgataccgcgatgtattactgtgctcggtggggaacatattacgacattttaactggctacttcaattggtttgatccctggggccaggggaccctggtgacagtcagctcc

SEQ ID NO: 23340 - RNA, 321 nt, synthetic construct
  misc_feature 1..321: note = derived and/or modified sequence opt3 from HuMab-159_LightChain_VJ-Region
  source 1..321: mol_type = other RNA
gacatccagatgacccaaagcccctcctctctgtcagccagtgtgggcgatagagtcacaattacttgcagggctagccaggggatatcctcttggctcgcatggtaccagcagaagcctgagaaagccccaaagtcgcttatctatgcggcttcaagcctgcaaagtggagttccgtcccggttctctggtagcggctccgggacggactttaccttgacaatttcaagtttacagcccgaagatttcgccacttactattgtcagcagtactatatctacccttggacctttggacaaggcacaaaagtggagattaag

SEQ ID NO: 23341 - RNA, 363 nt, synthetic construct
  misc_feature 1..363: note = derived and/or modified sequence opt3 from HuMab-160_HeavyChain_VDJ-Region
  source 1..363: mol_type = other RNA
caggtgcaactggtcgagagcggcgggggagttgtgcagcccggtagatccctcaggctttcttgcgccgcttcaggcttcacctttagtagccacgcaatgcattgggtacggcaggcccctgggaagggactggaatgggtggcggctatctcctacgacggctctaacaaatattacgccgattcggtcaagggtcgcttcacaatttcacgagacaatagcaaaaacactatgtatttgcagatgaatagtttacgtgcagaggatacggccatgtgttactgcgctagagggtccataaccggatctacaggcgtgtttgactattggggccaagggactctggttaccgtgagctcc

SEQ ID NO: 23342 - RNA, 321 nt, synthetic construct
  misc_feature 1..321: note = derived and/or modified sequence opt3 from HuMab-160_LightChain_VJ-Region
  source 1..321: mol_type = other RNA
gacatccagatgacccaaagcccctcctctctgtcagccagtgtgggcgatagagtcacaattacttgcagggctagccaggacatatcctcttggctcgcatggtaccagcagaagcctgagaaagccccaaagtcgcttatctatgcggcttcaagcctgcaaagtggggttccgtcccggttctctggaagcggttccggcacggattttaccttgacaatttcaagtttacagcccgaagacttcgccacttactattgtcagcagtacaacagctatcctatcacctttgggcaaggaacacgcctggagattaaa

SEQ ID NO: 23343 - RNA, 372 nt, synthetic construct
  misc_feature 1..372: note = derived and/or modified sequence opt3 from HuMab-162_HeavyChain_VDJ-Region
  source 1..372: mol_type = other RNA
gaggtgcagctgtgggaaagcggcgggggatccgtccaacccggtggctctctcagactttcatgcgccgctagtgggttcacctttagctcctacggaatgtcttgggttaggcaggcacctggcaagggtctggagtgggtgtcggggatctcaggaagcggctatagtacatactatgccgactccgtaaaaggccggttcactatttctcgcgataacagcaagaatacgttgtacttacagatgaactccctgcgagcggaagacaccgctgtgtattactgtgccaaagggtattaccacggatcaggtagttactatacatcttttgattactggggccaggggactctagtcaccgtgagctcc

SEQ ID NO: 23344 - RNA, 321 nt, synthetic construct
  misc_feature 1..321: note = derived and/or modified sequence opt3 from HuMab-162_LightChain_VJ-Region
  source 1..321: mol_type = other RNA
gacatccagatgacccaaagcccctcctctctgtcagccagtgtgggcgatagagtcacaattacttgcagggctagccaggggatatcctcttggctcgcatggtaccagcagaagcctgagaaagccccaaagtcgcttatctatgcggcttcaagcctgcaaagtggagttccgtcccggttctctggtagcggctccgggacggactttaccttgacaatttcaagtttacagcccgaagatttcgccacttactattgtcagcagtacaacagctatcctctgacctttggaggcggtacaaaagtggagatcaag

SEQ ID NO: 23345 - RNA, 366 nt, synthetic construct
  misc_feature 1..366: note = derived and/or modified sequence opt3 from HuMab-163_HeavyChain_VDJ-Region
  source 1..366: mol_type = other RNA
gaggtgcagctggtccaaagcggcgccgaagttaagaaacccggggagtccctcaagatctcttgccagggatcaggttacagattcattagttattggataggctgggtgaggcagatgcctgggaaaggacttgaatggatgggccggatctacccaggtgacagcgatacccgctattccccgtcttttcaggggcaagtaacaatttcggtggacaagtcaatcagcactgcttacctgcagtggagttccttgaaagcatctgatacggccatgtattactgtgcgcgacagcgtggagactattactacttcaacggcttagatgtctggggccaggggaccacagtgactgttagctcc

SEQ ID NO: 23346 - RNA, 321 nt, synthetic construct
  misc_feature 1..321: note = derived and/or modified sequence opt3 from HuMab-163_LightChain_VJ-Region
  source 1..321: mol_type = other RNA
gagatcgtgctgacccagagccccggcacactctccctttctcctggggaaagagccactctgtcatgcagggctagtcaaagcgtctcctcttcgtacttggcatggtatcagcagaagccaggacaggccccgcggttactgatttacggtgcgtcaagccgcgctacgggcatacccgaccgattcagtgggtccggatctggcaccgattttacactaactatcagccgtctcgagcctgaagacttcgccgtttattactgtcaacagtatggttcctcactgacctttgggggaggcacaaaagtggagattaag

SEQ ID NO: 23347 - RNA, 363 nt, synthetic construct
  misc_feature 1..363: note = derived and/or modified sequence opt3 from HuMab-166_HeavyChain_VDJ-Region
  source 1..363: mol_type = other RNA
caggtgcaactggtcgagagcggcgggggagttgtgcagcccggtagatccctcaggctttcttgcgccgcttcaggcttcacctttagtagctacgcaatgcactgggtacggcaggcccctgggaagggactggaatgggtggcggtcatctcctatgacggctctaacgagtactatgctgattcggtgaaaggtcgcttcacaatttcacgagacaatagcaagaacactttgtacttacagatgaatagtctgcgtgccgaagatacggcagtttattactgtgccagagggtccataatcggatctaccggcgtgtttgactattggggccaagggactctagtcacagtgagctcc

SEQ ID NO: 23348 - RNA, 321 nt, synthetic construct
  misc_feature 1..321: note = derived and/or modified sequence opt3 from HuMab-166_LightChain_VJ-Region
  source 1..321: mol_type = other RNA
gacatccagatgacccaaagcccctcctctctgtcagccagtgtgggcgatagagtcacaattacttgcagggctagccaggggatatccaactggctcgcatggtaccagcagaagcctgagaaagccccaaagtctcttatctatgacgcgtcgtcactgcaaagcggagttccgagtcggttctccggttctggcagcgggacggattttaccttgacaatttcctcattacagcccgaagacttcgctacttactattgtcagcagtacaatagttatcctatcacctttggacaaggcacacgcctggagattaaa

SEQ ID NO: 23349 - RNA, 363 nt, synthetic construct
  misc_feature 1..363: note = derived and/or modified sequence opt3 from HuMab-167_HeavyChain_VDJ-Region
  source 1..363: mol_type = other RNA
caggtgcaactggtcgagagcggcgggggagttgtgcagcccggtagatccctcaggctttcttgcgccgcttcaggcttcacctttagtagctacgcaatccactgggtacggcaggcccctgggaagggactggaatgggtggcggtcatttcctatgacggctctaacaaatactatgctgattcggtgaagggtcgcttcacaatatcacgagacaatagcaaaaacactttgtacttacagatgaatagtctgcgtgccgaggatacggcagtttattactgtgccagagggtccatcaccggatctacaggcgtgtttgactattggggccaagggactctagtcaccgtgagctcc

SEQ ID NO: 23350 - RNA, 363 nt, synthetic construct
  misc_feature 1..363: note = derived and/or modified sequence opt3 from HuMab-169_HeavyChain_VDJ-Region
  source 1..363: mol_type = other RNA
caggtgcaactggtccagagcggcgccgaggttaagaaacccggggcttccgtgaaggtatcttgcaaagcatcaggatacaccttcacaaactatggtatcagttgggtgagacaggcccctggccaggggctcgaatggatgggatggcttagcgcgtactccggcaatactatttatgctcaaaagctgcagggtagggtcacgatgaccacagacacttctaccacaaccgcctacatggagttgcggtcgttacgctcagatgacactgcagtgtattactgtgcccgagatcgtatagttgtgagaccagactattttgattactgggggcagggaacactggtcaccgtgagcagt

SEQ ID NO: 23351 - RNA, 321 nt, synthetic construct
  misc_feature 1..321: note = derived and/or modified sequence opt3 from HuMab-169_LightChain_VJ-Region
  source 1..321: mol_type = other RNA
gagatcgtgctgacccagagccccgccacactctccctttctcctggcgaaagagctactctgtcatgcagggcaagtcaaagcgtctcctcttacttggcctggtatcagcagaagccagggcaggcgccgcggttactgatttacgacgcttcgaaccgcgccacgggaatacccgcacgattctcaggtagcggcagtgggaccgattttacactaactatctcctctctcgagcctgaagacttcgccgtttattactgtcaacagcgtagcaattggccaagaacctttggacagggcacaaaagtggagattaag

SEQ ID NO: 23352 - RNA, 366 nt, synthetic construct
  misc_feature 1..366: note = derived and/or modified sequence opt3 from HuMab-7D8_HeavyChain_VH-Region
  source 1..366: mol_type = other RNA
gaggtgcagctggtcgaaagcggcgggggactcgttcaacccgacagatcccttaggctgtcttgcgccgcttcaggtttcacctttcacgattacgcaatgcattgggtgcggcaggcccctggcaaggggttggagtgggtaagtacaatcagctggaactccggaactattggctatgcggactctgtgaaaggtcgcttcacgatatcgcgagataatgctaagaactcattatacctgcagatgaatagcctacgtgccgaagacaccgcactctattactgtgccaaagatatccagtatgggaactactattacggaatggacgtctggggccaaggcacaactgtgaccgttagttcc

SEQ ID NO: 23353 - RNA, 366 nt, synthetic construct; identical to SEQ ID NO: 23352
  misc_feature 1..366: note = derived and/or modified sequence opt3 from HuMab-7D8_HeavyChain_V-Region
  source 1..366: mol_type = other RNA

SEQ ID NO: 23354 - RNA, 321 nt, synthetic construct
  misc_feature 1..321: note = derived and/or modified sequence opt3 from HuMab-7D8_LightChain_VL-Region
  source 1..321: mol_type = other RNA
gagatcgtgctgacccagagccccgccacactctccctttctcctggcgaaagagctactctgtcatgcagggcaagtcaaagcgtctcctcttacttggcctggtatcagcagaagccagggcaggcgccgcggttactgatttacgacgcttcgaaccgcgccacgggaatacccgcacgattctcaggtagcggcagtgggaccgattttacactaactatctcctctctcgagcctgaagacttcgccgtttattactgtcaacagcgtagcaattggccaattacctttggacagggcacaagactggagatcaaa

SEQ ID NO: 23355 - RNA, 321 nt, synthetic construct; identical to SEQ ID NO: 23354
  misc_feature 1..321: note = derived and/or modified sequence opt3 from HuMab-7D8_LightChain_V-Region
  source 1..321: mol_type = other RNA

SEQ ID NO: 23356 - RNA, 324 nt, synthetic construct
  misc_feature 1..324: note = derived and/or modified sequence opt3 from huMAb-anti-MSP10.1_LightChain_VJ-Region
  source 1..324: mol_type = other RNA
gagatcgtgctgacccagagccccgacattctctccctttctcctggcgaaagagccacactgtcatgcagggctagtcaagcattgactgccaagtacttagcgtggtatcagcagaaaccagggcaggtcccgcggctgctaatatacggaagctccacgcgcgctaccggtatccccgatcgattccgtggctctgggtcgggaacagactttactctcaccatttcaagactggagcctgccgatagcgcagtttattactgtcaacagtatgaagacagtccatggacattcggccagggtaccaaacttgagatcaag

SEQ ID NO: 23357 - RNA, 324 nt, synthetic construct
  misc_feature 1..324: note = derived and/or modified sequence opt3 from huMAb-anti-MSP10.2_LightChain_VJ-Region
  source 1..324: mol_type = other RNA
gagatcgtgctgacccagagccccgacacactctccctttctcctggcgaaactgccacgctgtcatgcagagctagtcaaaccgtcaggcggaacagcttggcatggtaccagcagaagccagggcaggccccgcgcttactgatttatggagcgtccgatcgagctacaggtatacccgaccgtttctctggctcggggtttggaactgatttcaccctaacagtttcaggcctcgagcctgaagactttgccgtgtactattgtcaacagtacggtaccagcccaagaactttcgggcagggaacaaaactggagatcaag

SEQ ID NO: 23358 - RNA, 324 nt, synthetic construct
  misc_feature 1..324: note = derived and/or modified sequence opt3 from HUMAB-Clone_18_VJ-Region
  source 1..324: mol_type = other RNA
gagatcgtgctgacccagagccccgccacactctccctttctcctggcgaaagagctactctgtcatgcagggcaagtcaaagcgtctcctcttacttggcctggtatcagcagaagccagggcaggcgccgcggttactgatttacgacgcttcgaaacgcgccacgggaatacccgcacgattctcaggtagcggcagtgggaccgattttacactaactatctcctctctcgagcctgaagacttcgccgtttattactgtcaacagcgtagcaagtggccaccctggacctttggacagggcacaaaagtggagtccaag

SEQ ID NO: 23359 - RNA, 324 nt, synthetic construct
  misc_feature 1..324: note = derived and/or modified sequence opt3 from HUMAB-Clone_22_VJ-Region
  source 1..324: mol_type = other RNA
gagatcgtgctgacccagagccccgccacactctccctttctcctggcgaaagagctactctgtcatgcagggcaagtcaaagcgtctcctcttacttggcctggtatcagcagaagccagggcaggcgccgcggttactgatttacgacgcttcgaaccgcgccacgggaatacccgcacgattctcaggtagcggcagtgggaccgattttacactaactatctcctctctcgagcctgaagacttcgccgtttattactgtcaacagcgtagcaaatggccaccctggacctttggacagggcacaaaggtggagattaaa

SEQ ID NO: 23360 - RNA, 432 nt, synthetic construct
  misc_feature 1..432: note = derived and/or modified sequence opt3 from HuMab-L612_Chain_VDJ-Region_Precursor
  source 1..432: mol_type = other RNA
atggagttcggcctgacctggctctttcttgtggccaacctgaagggggtccagtgcgaagttcaattgttagacagcggaggtggcctggtgcagcccgggggatgtctaagactctcctgcgctgcatctggcttcacattttcaagttgtgccatgagctgggtaaggcaggcgcctggtaaagggctggagtgggtgtccgctatctctggatcgggcggctcaacttactatgccgatagcgtcaaggggcggttcacgattagtcgcgacaaatccaagaataccctttacctgcagatgaactctttgcgagcagaagatacagccgtgtattactgcgctaaaggaggtaatgacatactcactggctattacgcatgggggcaaggaaccctggttacagtgagctccggctcagccagtgct

SEQ ID NO: 23361 - RNA, 321 nt, synthetic construct
  misc_feature 1..321: note = derived and/or modified sequence opt3 from HuMab_LC5002-002_LightChain_V-Region
  source 1..321: mol_type = other RNA
gacatccagatgacccaaagcccctcctctctgtcagccagtgtgggcgatagagtcacaattacttgcagggctagccaggggatatcccggtgggttgcatggtaccagcagaagcctgagaaagccccaaagtctctcatctatgcggcttcgtcacttcaaagcggagtgccgagtcgcttctccggttctggcagcgggacggactttaccctgacaatttcctcattgcagcccgaagatttcgccacttactattgtcagcagtacaacagttatccttggacctttggacaaggcacaaaagtagagatcaag

SEQ ID NO: 23362 - RNA, 357 nt, synthetic construct
  misc_feature 1..357: note = derived and/or modified sequence opt3 from HuMab_LC5002-002_gamma1-Chain_V-Region
  source 1..357: mol_type = other RNA
gaggtgcagctgctcgaaagcggcgggggacttgtccaacccggtggctccctgagattgtcttgcgccgcttcagggttcacctttaacatctacgcaatgaattgggttaggcaggcccctggaaagggcttagagtgggtgagtgtaattagcggtcgggggataacaacttattacgcggactccgtgaaaggacgcttcacgatctctcgagataactcgaagaataccctgtatctacagatgaactcactccgtgctgacgatacagccgtctactattgtgcaaaaggcagcagttcctggactgactttgattactggggccaggggaccctggtgacagtttctagc

SEQ ID NO: 23363 - RNA, 321 nt, synthetic construct
  misc_feature 1..321: note = derived and/or modified sequence opt3 from HuMab_LC5002-003_LightChain_V-Region
  source 1..321: mol_type = other RNA
gacatccagatgacccaaagcccctcctctctgtcagccagtgtgggcgatagagtcacaattacttgcagggctagccaggggatatcctcttggctcgcatggtaccagcagaagcctgagaaagccccaaagtcgcttatctatgcggcttcaagcctgcaaagtggagttccgtcccggttctctggtagcggctccgggacggactttaccttgacaatttcaagtttacagcccgaagatttcgccacttactattgtcagcagtacaacagctatccttggacctttggacaaggcacaaaagtggagatcaag

SEQ ID NO: 23364 - RNA, 357 nt, synthetic construct
  misc_feature 1..357: note = derived and/or modified sequence opt3 from HuMab_LC5002-003_gamma1-Chain_V-Region
  source 1..357: mol_type = other RNA
gaggtgcagctgctcgaaagcggcggggaccttatccaacccggaggttccctgagattgtcttgcgccgcttcaggcttcacctttaacatttacgcaatgaattgggtcaggcaggcccctgggaagggattagagtgggttagtgtgataagcggccggggtatcacaacttattacgcggattccgtaaaagggcgcttcacgatttctcgagacaactcgaagaataccctgtatctacagatggattcactccgtgctgaagacacagccgtgtactattgtgcaaaaggaagcagttactggactgattttgactattggggccagggcaccctggtcacagtgtcctct

SEQ ID NO: 23365 - RNA, 321 nt, synthetic construct
  misc_feature 1..321: note = derived and/or modified sequence opt3 from HuMab_LC5002-005_LightChain_V-Region
  source 1..321: mol_type = other RNA
gacatccagatgacccaaagcccctcctctctgtcagccagtgtgggcgatagagtcacaattacttgcagggctagccaggggatatcctcttggctcgcatggtaccagcagaagcctgagaaagccccaaagtcgcttatctatgcggcttcaagcctgcaaagtggagttccgtcccggttctctggtagcggctccgggacggactttaccttgacaatttcaagtttacagcccgaagatttcgccacttactattgtcagcagtacaacagccaccctccaacctttggacaaggcacaaaactggagatcaag

SEQ ID NO: 23366 - RNA, 354 nt, synthetic construct
  misc_feature 1..354: note = derived and/or modified sequence opt3 from HuMab_LC5002-005_gamma1-Chain_V-Region
  source 1..354: mol_type = other RNA
gaggtgcaggtcctggacagcggcgggggactcgttcaacccggtggctcccttagactgtcttgcaccgcctcagggttcacatttaggttgtacactatgagttgggtgcggcagacgcctggacgcggcttagaatgggtaagcggtatctccgggtctggactgtcgacctatttcgctgattcagtgaagggccgatttacaattagccgtgacaacagtaaaaatactgtctacctacagatgaactccctcagagcagaggataccgccgtgtattactgtgcgaaggaaggcgactggatatatttcgattcttgggggcagggaacactggttatcgtgagctcc

SEQ ID NO: 23367 - RNA, 321 nt, synthetic construct
  misc_feature 1..321: note = derived and/or modified sequence opt3 from HuMab_LC5002-007_LightChain_V-Region
  source 1..321: mol_type = other RNA
gagatcgtgctgacccagagccccggcacactctccctttctcctggggaaagagccactctgtcatgcagggctagtcaaagcgtctcctcttcgtacttggcatggtatcagcagaagccaggacaggccccgcggttactgatttacggtgcgtcaagccgcgctataggcatccccgaccgattcagtgggtccggatctggcacggattttaccctaacaattagccgtctcgagcctgaagacttcgccgtttattactgtcaacactatggttcctcactgacttttgggggaggcaccaaagtggagatcaag

SEQ ID NO: 23368 - RNA, 369 nt, synthetic construct
  misc_feature 1..369: note = derived and/or modified sequence opt3 from HuMab_LC5002-007__gamma1-Chain_V-Region
  source 1..369: mol_type = other RNA
caggtgcaactggtccagagcggcgccgaggttaagaaacccgggtcctctgtgaaggtatcatgcaaagtgagtggaggtaccttcagctcctacgctttttcttgggtcagacaggcacctggccaggggctcgaatggatgggaaggatcattccaatacttggccggacaaactatgcccaaaagttccagggtcgcgtgactatcacggcggacaaatcgacctcaacagcttacatggaggttagcagtctgcgatccgaagatactgccgtgtattactgtgcacgtgagggggaaaccttggactatttttactatggaatggatgtctggggccagggcacaaccgtgactgtatctagc

SEQ ID NO: 23369 - RNA, 357 nt, synthetic construct
  misc_feature 1..357: note = derived and/or modified sequence opt3 from HuMab_LC5002-018_gamma1-Chain_V-Region
  source 1..357: mol_type = other RNA
gaggtgcagctgctcgaaagcggcgggggacttgtccaacccggtggctccctgagattgtcttgcgccgcttcagggttcacctttaacatctacgcaatgaattgggttaggcaggcccctggaaagggcttagagtgggtgagtgtaattagcggttccggggtgacaacttattacgcggactctgtcaaaggacggttcacgatatcgcgcgataactcaaagaataccctgtatctacagatgaacagcctccgagctgaagacacagccgtgtactattgtgcaaaaggcagttcctggtacgttgattttgactattggggccaggggactctggtgaccgtctctagc

SEQ ID NO: 23370 - RNA, 1347 nt, synthetic construct
  misc_feature 1..1347: note = derived and/or modified sequence opt3 from Ibalizumab_HeavyChain1
  source 1..1347: mol_type = other RNA
caggtgcagctgcagcagagcggccccgaggtcgttaagcctggggcctccgtgaaaatgtcttgcaaggcttcaggatacaccttcacaagttatgtaatccactgggtgagacagaaaccaggtcaaggcctcgactggattgggtacataaacccgtataatgatggaactgactacgatgaaaagtttaaaggcaaggcaacgcttaccagcgacacatccacttctaccgcctatatggagctgtcgtcattgaggagcgaagatacagcggtctactattgtgctcgggagaaggacaactacgccaccggtgcatggttcgcctactgggggcagggaactttagtgacagttagttccgcttctaccaaaggccccagcgtgtttcctctggcaccatgctcccgctcaacgagtgaaagcactgccgctctaggctgtctcgtcaaggattatttccccgagcctgtgaccgtatcttggaatagcggggccctgacatcaggagttcatacttttccagcggtgcttcagagcagtggtctgtactctttgtccagcgtcgtgaccgtgccctcgtcttccctcggcacaaaaacctatacgtgcaacgtcgaccacaagccttcaaatactaaagttgataagcgagtggagagtaagtacgggccaccgtgtcccagctgccctgcaccagagttcctgggaggcccctccgtatttctgttccctccaaaacccaaggacacactcatgatctctcgtaccccggaggtgacttgtgtcgtggttgatgtgagccaggaagaccctgaggtccaatttaactggtatgtggatggtgtagaggttcataatgccaaaacaaagcccagagaagaacagttcaactcaacctacagggtggtcagtgtgttaacggtcctgcaccaggactggcttaatgggaaagaatataagtgcaaagtgtccaacaagggattgccaagctctattgagaagaccatctcaaaagctaagggccagcctcgggaaccccaagtttacacactgccacccagtcaggaggagatgactaaaaatcaggtgagcctaacctgtctcgtaaagggcttttacccttccgacattgccgtcgaatgggagtctaacgggcaaccagaaaataactataaaacaactccgcccgtgctggattcggacggatccttctttctttactcccgcctgaccgttgataagtcaagatggcaggagggtaatgtgttcagttgctctgtcatgcatgaagcattgcacaaccactatacacaaaagagcctctccctgtcattaggcaaa

SEQ ID NO: 23371 - RNA, 657 nt, synthetic construct
  misc_feature 1..657: note = derived and/or modified sequence opt3 from Ibalizumab_LightChain1
  source 1..657: mol_type = other RNA
gacatcgtgatgacccagagccccgattccctggccgtctctctcggcgagagagttacaatgaactgcaagtcaagtcaaagccttctgtactccactaatcagaaaaactatttggcttggtaccagcagaagcctgggcaatctccaaaattactgatttattgggcatcgacgagggaatcaggagtgccggaccggttcagcggtagtggctccgggaccgattttacactaactatatctagcgtacaggccgaggacgtggcggtctactattgtcagcagtactattcctaccgcaccttcggaggcggtacaaagctcgaaatcaaacgaaccgtggctgccccctcagtttttattttccctccaagtgatgagcaacttaagagcgggactgcatctgtggtctgcctgctgaataacttttacccccgtgaagccaaggtgcagtggaaagtagacaatgctttgcagtccggaaactcacaggagagcgttacagagcaagatagtaaggactctacctattccctcagctcgacgctgactctgtctaaagcagattacgaaaagcacaaagtgtatgcctgtgaggtcacccatcagggcctctcctcacctgtgacaaagagtttcaatagaggcgaatgc

SEQ ID NO: 23372 - RNA, 1329 nt, synthetic construct
  misc_feature 1..1329: note = derived and/or modified sequence opt3 from Ibritumomab_tiuxetan_HeavyChain
  source 1..1329: mol_type = other RNA
caggcctacctgcaacagagcggcgctgagctcgtgagacccggggcatccgtcaagatgtcttgcaaagcctcaggatataccttcacaagttacaacatgcactgggttaagcagactcctaggcagggtcttgaatggatcggcgcgatttatccagggaatggagacacgagctacaaccaaaaatttaagggcaaagctaccctgacagtggataagtcctcttcgactgcctatatgcagttgtcaagcctgaccagtgaggactccgcagtatacttctgtgcccgggtggtctattactctaatagctactggtattttgatgtgtggggtacagggaccactgttacagtgtccgctccgtcagtctaccccctggcacctgtgtgcggagacaccacgggcagtagcgtaactctaggctgtctcgttaaggggtatttcccagaacccgtgaccctgacatggaactctggatccctttcaagcggtgtccatacttttcctgccgtgctgcagagtgatttgtacaccctctcttccagcgtgacagtcacctcgtctacgtggccatcccagtcaataacttgcaatgttgctcaccccgccagtagcacaaaagtggacaagaaaatcgagcctcgcggcccaaccattaagccgtgtcccccttgcaaatgtccagcgcccaacctgttagggggaccttccgtattcatctttccacccaagattaaggatgtgctcatgatctctttaagcccgatagtcacttgcgtggttgtggacgtctcagaagatgaccctgatgtgcaaatcagttggttcgtaaataacgttgaggtgcatacagcacagacccagacgcaccgagaggactataattccaccctgcgtgtcgtgagcgcccttcccattcagcatcaagattggatgtctggcaaagaatttaagtgtaaagtcaacaataaggacttgccagctcctatcgagagaacaatttcaaaacccaagggtagtgtgagggccccacaggtttacgtgctgccccctccagaagaggagatgactaaaaagcaggtaaccctaacatgcatggtcactgacttcatgccggaagatatctatgtggagtggaccaacaatgggaagacagaactcaactacaaaaataccgagcccgttctggacagcgatggatcctactttatgtattctaaacttcgggtggaaaagaagaactgggtcgagcgcaactcgtacagctgttccgtggtacacgagggcctgcacaatcatcacactacgaaatcattcagtaga

SEQ ID NO: 23373 - RNA, 627 nt, synthetic construct
  misc_feature 1..627: note = derived and/or modified sequence opt3 from Ibritumomab_tiuxetan_LightChain
  source 1..627: mol_type = other RNA
cagatcgtgctgagccaatcccccgccattctctctgcttcacctggcgagaaggtcaccatgacatgcagagcaagtagctccgtttcttacatgcactggtatcagcagaaaccagggtcgtcaccgaagccctggatatacgcccctagcaaccttgcgagtggagtgccagctaggttctccggttctggcagcgggacttcctattcactgacgatcagtcgggtagaagccgaggacgcagccacctactattgtcagcaatggagctttaatccccctacattcggagctggcactaaattggaattaaagcgcgcagatgccgctccaaccgtgtttatttttcccccttctgacgagcagctgaaatccggtacagcctcagtcgtgtgcctactcaacaatttctacccacgagaagcgaaggttcagtggaaggtggataacgcactgcagagcgggaatagtcaagagtctgtcaccgagcaggactccaaagatagcacttattcgctttcttccacactgaccttgtcaaaggccgactacgaaaaacataaggtgtacgcttgtgaggtaacgcaccagggactcagtagcccggttactaaatccttcaac

SEQ ID NO: 23374 - RNA, 1368 nt, synthetic construct
  misc_feature 1..1368: note = derived and/or modified sequence opt3 from Icrucumab_HeavyChain1
  source 1..1368: mol_type = other RNA
caggcccaagtggtcgagagcggcgggggagttgtgcagtccggtagatctctgaggctctcatgcgctgcaagtggcttcgcctttagctcctacgggatgcactgggtacggcaggcgcccggaaagggccttgaatgggtggctgtcatctggtatgacggttctaacaaatactatgccgattcggtgcgcgggcgattcaccatttcacgtgacaatagcgagaacacactgtacttgcagatgaatagtttaagagcagaagatactgccgtttattactgtgctagggaccattatggatccggcgtgcaccattacttttactatggcctggatgtctgggggcaaggaacgaccgtgacagtatctagcgcatccactaagggtccttcagttttcccactagccccgagtagcaaatctacctccggcgggacagctgccctcggatgcctggtgaaggactactttcccgagcctgtcaccgtgtcatggaacagcggcgcgcttacaagtggtgtgcacactttcccagcagtcctgcagtcttccgggttgtatagcctctcgtctgttgtgaccgtaccctcctcaagtctgggaacgcagacttacatatgtaatgtgaaccataaacctagcaataccaaggtcgataagcgggtggaaccaaaatcctgcgacaagacacacacttgtcccccttgcccagccccggagctgctcggcggcccctctgtgtttttattccctccaaaacccaaggataccctgatgatcagccgcacacctgaggttacctgtgtcgtggtagacgtttcacacgaagatccagaggtgaaatttaactggtatgtcgacggggtggaagtccataatgctaagacgaagcccagagaggagcagtacaacagtacttatagggtggtttccgtgcttacagtattgcaccaagattggctgaatggaaaagaatacaagtgcaaagtcagcaacaaggccctaccggcacctattgagaaaaccatctctaaggctaaaggtcagccccgggaaccacaggtgtacactctccctccctcacgcgaggaaatgacaaagaatcaggttagtctgacctgtcttgtgaagggcttctatccaagcgacattgccgtcgagtgggagtccaacgggcaacccgaaaataactacaaaacgacccctccagtgctggactctgatggatcgtttttcttgtatagcaagctcacagtagacaaatcccgatggcagcagggcaacgtgttttcatgcagtgttatgcatgaggcgctgcacaatcactacactcaaaagtctttaagcctgtccccgggtaaa

SEQ ID NO: 23375 - RNA, 645 nt, synthetic construct
  misc_feature 1..645: note = derived and/or modified sequence opt3 from Icrucumab_LightChain1
  source 1..645: mol_type = other RNA
gagatcgtgctgacccagagccccggcacactctccctttctcctggggaaagagccactctgtcatgcagggctagtcaaagcgtctcctcttcgtacttggcatggtatcagcagaaaccaggacaggccccgcggttactgatttacggtgcgtcaagccgcgctacgggcatacccgaccgattcagtgggtccggatctggcaccgattttacactaactatcagccgtctcgagcctgaagacttcgccgtttattactgtcaacagtatggttcctcaccactgacctttgggggaggcacaaaagtggagattaagagaaccgtagcagcccccagtgtgttcatctttcctccaagcgatgaacagcttaaatctggcactgcttccgtcgtgtgcctgttgaacaatttctaccccagggaggcaaaggttcagtggaaagtggacaacgccctccaatcagggaatagccaggagagtgtcacagaacaggattctaaggactccacctatagcctgtcgtctacgctgactctctccaaggctgattacgagaaacacaaggtgtacgcctgtgaagtaacccatcagggattatcaagtcctgttacaaagagctttaaccggggtgagtgc

SEQ ID NO: 23376 - RNA, 675 nt, synthetic construct
  misc_feature 1..675: note = derived and/or modified sequence opt3 from Idarucizumab_HeavyChain1
  source 1..675: mol_type = other RNA
caggtgcaactgcaggagagcggccccgggctcgtcaagccttccgaaaccctttctctgacatgcactgtttcaggattcagtttgacgagctacatcgtggactggattagacagccaccgggtaaaggcttagagtggataggggtaatctgggccggaggctccaccggttataactctgctctgaggtcgcgggtgtcaattacaaaggatactagcaaaaatcagtttagtctaaagctctcctctgtcaccgcagccgacacagcggtgtactattgtgctagcgccgcatactattcctactataactacgatgggttcgcctactggggacaaggcaccctggttactgtgtcaagtgctagcacaaaaggcccctctgtctttcctcttgcaccatcctcaaagagcaccagtgggggaacggccgctctgggttgcttggtgaaggactatttccccgaacctgtaactgtttcttggaactccggcgccctcaccagcggggtgcacacatttccagcggtcctgcagtcgtctggactgtactccctctcaagtgtggtgactgtccccagctcctctttaggcacccagacatatatctgtaatgttaatcataaacctagcaacaccaaggtggataaaaaggtagagccaaaatcatgc

SEQ ID NO: 23377 - RNA, 657 nt, synthetic construct
  misc_feature 1..657: note = derived and/or modified sequence opt3 from Idarucizumab_LightChain1
  source 1..657: mol_type = other RNA
gacgtggtcatgacccagagccccctgtccctccctgttacacttggccaaccagcctctatctcatgcaagagtagccagtccctgttgtacactgatgggaaaacgtatttatactggttcctgcagagaccgggacagtctcccaggcggctaatttatctcgtgtcgaagctggactcaggtgtacctgatcgctttagcggcagtgggtccggaaccgacttcacacttaaaatatctcgagtggaggctgaagatgtcggcgtgtactattgtctgcaaagcactcactttccacataccttcggtgggggaacaaaggttgagatcaaacgtaccgtggcagccccctccgtctttattttccctccatcagacgaacagttgaagagtggcactgcgagcgtggtatgcctcctgaacaatttttaccccagagaggctaaggttcagtggaaagtggataacgccctgcagtctggcaattcccaagaatcagtcacagagcaggacagcaaggatagtacctattctctctccagcacgttaactctgtcgaaagcagactacgagaagcacaaagtgtacgcctgtgaagtgacccatcaggggctttcttcccctgtcacaaagtcattcaacaggggagagtgc

SEQ ID NO: 23378 - RNA, 1332 nt, synthetic construct
  misc_feature 1..1332: note = derived and/or modified sequence opt3 from Igatuzuab_HeavyChain1
  source 1..1332: mol_type = other RNA
caggtgcaactggtccagagcggcgccgaggttaagaaacccgggtcctctgtgaaggtatcatgcaaagctagtggattcacctttacagactacaagatccactgggtgagacaggcacctggtcagggcctcgaatgggggtatttcaacccaaatagcggatactccacttatgcccaaaaatttcagggcagggtcacgattaccgcggataagtctacatcgactgcttacgagctttcaagcctgcggagtgaagacaccgccgtgtattactgtgcacgcttgtccccgggtgggtattacgttgatgcctggggacagggcacaaccgtgactgtctctagcgcttccacaaagggcccctcagtgttccctttagcaccaagtagcaaatctacctccgggggaacggccgctctgggttgcctagtaaaggactactttcccgagcctgttactgtgtcatggaacagcggcgccctcaccagtggggtccatacattcccagcggtgctgcagtcttccggactttatagcctgtcgtctgtggtcactgttccctcctcaagtttgggcacccaaacatacatatgtaatgtgaaccacaaacctagcaataccaaggtagataaaaaggtggaaccaaagtcctgcgacaaaacgcatacttgtccgccctgccctgcaccagagctcctgggtgggccctctgtctttctgttccctccaaagcccaaagatacactcatcagccgaaccccggaggtgacttgtgttgtggtcgacgtgtcacacgaagatcctgaggtaaagtttaactggtatgttgacggagtggaagtccataatgccaaaacaaagccccgtgaggagcagtacaacagtacctatagagtggtctccgtgttaacggttctgcaccaggattggcttaatggcaaagaatacaagtgcaaggtgagcaacaaggctttgccagcccctattgagaaaaccatctctaaagcaaagggccagcccagggaaccacaagtatatacactgcccccttcacgggacgagctaactaaaaatcaggtcagtctcacctgtctggtgaaggggttctacccaagcgatattgctgttgaatgggagtccaacggacagccggagaataactacaagacaactccccctgtgcttgactctgacggttcgtttttcctgtatagcaaattgaccgtcgataagtcccgctggcaacagggcaatgtgttttcatgcagtgtacacgaagccctccataaccactacacacagaaatctctgagcttatccccaggg

SEQ ID NO: 23379 - RNA, 636 nt, synthetic construct
  misc_feature 1..636: note = derived and/or modified sequence opt3 from Igatuzuab_LightChain1
  source 1..636: mol_type = other RNA
gacatccagacccaaagcccctcctctctgtcagccagtgtgggcgatagagtcacaattacttgcagggctagccaggggataaacaattacctcaactggtatcagcagaagcctggaaaagcaccaaagcggcttatctacaatacgaacaatctgcaaaccggtgttccgtcccgcttctctggctcggggtcaggaacagagtttactttgaccattagcagtttacagcccgaagacttcgccacatattactgtctgcagcacaactcctttcctaccttcggccagggtactaaactagagatcaagcgaacagtggcggctccatctgtatttatttttccccctagcgatgaacaactcaaatccgggaccgcctcagtggtctgcctgcttaataacttctatccacgtgaggcaaaggtgcagtggaaggttgacaatgccctgcagagtggaaacagccaggaatctgtgacggagcaagattccaaagactcaacttacagcttgagttctaccctcacactgtccaaggctgattatgagaaacataaggtctacgcatgtgaagtgactcaccagggcctgagctcgcccgtaaccaaatctttcaatagaggcgagtgc

SEQ ID NO: 23380 - RNA, 357 nt, synthetic construct
  misc_feature 1..357: note = derived and/or modified sequence opt3 from IGF-IR_HUMAB-1A_HeavyChain
  source 1..357: mol_type = other RNA
gaggtgcagctggtccaaagcggcgggggactcgttcaccccggtggctcccttagactgtcttgcgccgggtcaggattcacctttaggaactacgctatgtattgggtgcggcaggcacctggcaagggtttggaatgggtaagtgccatcgggagcggaggcggcacatactatgcggactccgtgaaagggcgcttcactatttctcgagataatgctaagaactcgttatacctgcagatgaactcactacgtgccgaggacatggcagtctattactgtgccagagctccaaattggggaagcgatgcatttgacatatggggtcagggcacgatggtgaccgttagttcc

SEQ ID NO: 23381 - RNA, 357 nt, synthetic construct
  misc_feature 1..357: note = derived and/or modified sequence opt3 from IGF-IR_HUMAB-23_HeavyChain
  source 1..357: mol_type = other RNA
gaggtgcagctggtccaaagcggcgggggactcgttcaccccggtggctcccttagactgtcttgcgccgggtcaggattcacctttagtaactacgctatgtattgggtgaggcaggcacctggcaagggtttggaatgggtaagcgccatcgggtccggaggcggcacatactatgcggactctgtgaaagggcggttcactatttcgcgcgataatgctaagaactcattatacctgcagatgaatagcctacgagccgaggacatggcagtctatcattgtgcccgtgctccaaactggggaagtgaagcatttgatatatggggtcagggcacgatggtgaccgtttcctct

SEQ ID NO: 23382 - RNA, 321 nt, synthetic construct; identical to SEQ ID NO: 23278
  misc_feature 1..321: note = derived and/or modified sequence opt3 from IGF-IR_HUMAB-23_LightChain
  source 1..321: mol_type = other RNA

SEQ ID NO: 23383 - RNA, 357 nt, synthetic construct
  misc_feature 1..357: note = derived and/or modified sequence opt3 from IGF-IR_HUMAB-8_HeavyChain
  source 1..357: mol_type = other RNA
gaggtgcagctggtccaaagcggcgggggactcgttcaccccggtggctcccttagactgtcttgcgccgggtcaggattcacctttaggagttacgctatgtattgggtgcggcaggcacctggcaagggtttggaatgggtaagcgccatcgggtccggaggcggcacatactatgcggactctgtgaaggggcgcttcactatttcgcgagataacgctaaaaattcattatacctgcagatgaacagcctacgtgccgaggacatggcagtctattactgtgccagagctccaaattggggaagtgatgcatttgacatatggggtcagggcacgatggtgaccgtttcctct

SEQ ID NO: 23384 - RNA, 321 nt, synthetic construct
  misc_feature 1..321: note = derived and/or modified sequence opt3 from IGF-IR_HUMAB-8_LightChain
  source 1..321: mol_type = other RNA
gacatccagatgacccaaagcccctcctctctgtcagccagtgtgggcgatagagtcacaattacttgcagggctagccaggggatatcctcttggctcgcatggtaccagcagaagcctgagaaagccccaaagtcgcttatctatgcggcttcaagcctgcaaagtggagttccgtcccggttctctggtagcggctccgggacggactttaccttgacaatttcaagtttacagcccgaagatttcgccacttactattgtcagcagtacaacagctatcctccaacctttggacccggcacaaaagtggacatcaag

SEQ ID NO: 23385 - RNA, 708 nt, synthetic construct
  misc_feature 1..708: note = derived and/or modified sequence opt3 from ImAb1_LightChain
  source 1..708: mol_type = other RNA
atggacatgagagcccccgctcagttctttggcatcctgctcctttggttccctgggattaggtgcgatataaagatgacccaaagcccatcctctatgtacgcatcactgggagagcgggtgacaatcacttgtaaagccagtcaggacattaagagctatttgtcctggtaccagcagaaaccgtggaagtctcccaaaatcttaatttattacgcgacgtcgctggctgatggtgtcccttcacgcatcagcggcagtgggtccggacaagactattctctaaccataagctccctcgaatcagatgacacagccacttactattgcctgcagcacggcgagagtccatacacctttggtgggggaacaaagttggaaatcaagcgagcagatgccgctcccaccgttagcattttccctccatcttccgagcagctgacttcaggcggcgcaagcgtggtatgttttcttaacaatttctaccccaaagacatcaacgtgaagtggaaaattgatgggagtgaacgtcagaatggagtcctcaactcttggacagaccaagattccaaggacagcacctattcgatgtcttccacgctgactctgaccaaagatgagtacgagagacataattcatatacatgcgaagccactcacaagaccagtacaagccctatcgtgaagtcctttaacaggaatgagtgt

SEQ ID NO: 23386 - RNA, 681 nt, synthetic construct
  misc_feature 1..681: note = derived and/or modified sequence opt3 from ImAb1_gamma1-Chain
  source 1..681: mol_type = other RNA
atgaatttcggctttagcctgatcttcctcgtgcttgtcctgaagggggttcagtgcgaggtgaaattggtagaatccggaggtggcttagtgaagcccgggggatctctgaaactatcatgtgccgctagtggctttaccttcagcaattacgcaatgtcctgggtcagacaaacacctgagaagaggctcgaatgggtggcctctatttcgtcagacggtgatacttattttccagacaacgttaaagggcggttcacgataagccgcgagaatgcgggaaacatcctgtttcttcagatgagttccctgcgatctgaagataccgctatgtactattgcgcccgtggcttcatgattacattttggggccaggggactttggtgaccgtcagcgcagccaagacaaccccgccctccgtgtaccctctcgctccaggatgtggtgacactacaggctcaagtgtaaccctggggtgcctggttaagggatatttccccgagagcgtgacggtcacttggaactctggctccctctcaagcagtgtgcacacctttcctgcattactgcagtctggtctttacacaatgtccagctcggtgactgtcccatcttccacctggccctcacaaacagttacctgtagtgtggcccatcctgctagctccacgactgtagat

SEQ ID NO: 23387 - RNA, 1344 nt, synthetic construct
  misc_feature 1..1344: note = derived and/or modified sequence opt3 from Imalumab_HeavyChain1
  source 1..1344: mol_type = other RNA
gaggtgcagctgctcgaaagcggcgggggacttgtccaacccggtggctccctgagattgtcttgcgccgcttcagggttcacctttagtatctacagcatgaactgggttaggcaggcacctggaaagggcttagagtgggtgtcctctattggttcgtcagggggaacaacttattacgccgacagcgtaaaaggccggttcacgataagtcgcgataattccaagaacaccctgtatctacagatgaatagcctccgagcggaagacacagctgtgtactattgtgccggctctcagtggctgtacgggatggatgtctggggacaaggtactaccgtgacagtttcctcagcaagtaccaaaggcccaagcgtgtttccgcttgccccctcttccaagtcaactagcgggggaacagctgcactgggctgcttggtcaaagactatttccctgagccagtgaccgtaagttggaactctggtgccctcacgtccggggttcacacttttcccgctgtgctgcagagctcgggactgtactctctctcctcagtcgtgaccgtgcctagtagctccttaggcacacagacttacatctgtaatgtcaaccataagccatctaataccaaggttgataaacgtgtggaacccaagagctgcgacaaaacacacacctgtcctccatgcccggcccccgagctgcttggcgggccttcagtattcttgtttccacccaagcctaaagatacgctgatgattagtagaactccagaggtgacatgtgtcgtggttgacgtgtcccatgaagatcccgaggtcaagttcaactggtatgtggacggagtagaagttcacaatgcgaagaccaaaccgagggaggagcagtacaacagcacttatcgggtggtctctgtgctaacagtcctccatcaagattggctgaatggtaaggaatacaaatgcaaggtgtcaaacaaagcacttcctgcccccatcgagaagaccattagtaaagctaagggccagccacgcgaacctcaggtttatacgctgcccccaagcagagaggaaatgaccaagaatcaggtgtccttgacatgtctcgtaaaagggttttacccctctgacatcgccgtcgagtgggagtcgaacggacaacctgaaaataactataagactaccccaccggtgctggatagcgacggctccttctttttatactcaaaactgacagttgacaagagtaggtggcagcagggtaacgtgttctcttgcagcgtcatgcacgaggcactccacaatcattacactcaaaaatccctttcactgagccccgggaag

SEQ ID NO: 23388 - RNA, 642 nt, synthetic construct
  misc_feature 1..642: note = derived and/or modified sequence opt3 from Imalumab_LightChain1
  source 1..642: mol_type = other RNA
gacatccagatgacccaaagcccctcctctctgtcagccagtgtgggcgatagagtcacaattacttgcaggagctcccagcggataatgacgtacctcaactggtatcagcagaagcctgggaaagctccaaaacttctgatcttcgttgcatctcactcgcaatcaggagtgccgagccgctttcgaggtagtggctccgagaccgacttcacattgactatttctgggttacagcccgaagatagcgccacctactattgtcagcagtccttttggacacctctgaccttcggaggcggtactaaggtagagatcaagcgtacagtggcggctccatcagtctttatttttccccctagtgacgaacaactaaaaagcgggaccgcctctgtggtttgcctcctgaataacttctacccaagagaggcaaaggtgcagtggaaggtcgataatgcccttcagtccggaaactcacaggaaagcgtgacggagcaagacagtaaagattctacttattccctgagctcgaccttgacactctctaaggctgactacgagaaacataaggtatatgcatgtgaagttactcaccagggcctgtcctcacccgtgaccaaaagtttcaataggggcgagtgc

SEQ ID NO: 23389 - RNA, 1347 nt, synthetic construct
  misc_feature 1..1347: note = derived and/or modified sequence opt3 from Imgatuzumab_HeavyChain1
  source 1..1347: mol_type = other RNA
caggtgcaactggtccagagcggcgccgaggttaagaaacccgggtcctctgtgaaggtatcatgcaaagctagtggattcacctttacagactacaagatccactgggtgagacaggcacctggtcagggcctcgaatggatggggtatttcaacccaaatagcggatactccacttatgcccaaaaatttcagggcagggtcacgattaccgcggataagtctacatcgactgcttacatggagctttcaagcctgcggagtgaagacaccgccgtgtattactgtgcacgcttgtccccgggtgggtattacgttatggatgcctggggacagggcacaaccgtgactgtctctagcgcttccacaaagggcccctcagtgttccctttagcaccaagtagcaaatctacctccgggggaacggccgctctgggttgcctagtaaaggactactttcccgagcctgttactgtgtcatggaacagcggcgccctcaccagtggggtccatacattcccagcggtgctgcagtcttccggactttatagcctgtcgtctgtggtcactgttccctcctcaagtttgggcacccaaacatacatatgtaatgtgaaccacaaacctagcaataccaaggtagataaaaaggtggaaccaaagtcctgcgacaaaacgcatacttgtccgccctgccctgcaccagagctcctgggtgggccctctgtctttctgttccctccaaagcccaaagatacactcatgatcagccgaaccccggaggtgacttgtgttgtggtcgacgtgtcacacgaagatcctgaggtaaagtttaactggtatgttgacggagtggaagtccataatgccaaaacaaagccccgtgaggagcagtacaacagtacctatagagtggtctccgtgttaacggttctgcaccaggattggcttaatggcaaagaatacaagtgcaaggtgagcaacaaggctttgccagcccctattgagaaaaccatctctaaagcaaagggccagcccagggaaccacaagtatatacactgcccccttcacgggacgagctaactaaaaatcaggtcagtctcacctgtctggtgaaggggttctacccaagcgatattgctgttgaatgggagtccaacggacagccggagaataactacaagacaactccccctgtgcttgactctgacggttcgtttttcctgtatagcaaattgaccgtcgataagtcccgctggcaacagggcaatgtgttttcatgcagtgtaatgcacgaagccctccataaccactacacacagaaatctctgagcttatccccaggg

SEQ ID NO: 23390 - RNA, 639 nt, synthetic construct
  misc_feature 1..639: note = derived and/or modified sequence opt3 from Imgatuzumab_LightChain1
  source 1..639: mol_type = other RNA
gacatccagatgacccaaagcccctcctctctgtcagccagtgtgggcgatagagtcacaattacttgcagggctagccaggggataaacaattacctcaactggtatcagcagaagcctggaaaagcaccaaagcggcttatctacaatacgaacaatctgcaaaccggtgttccgtcccgcttctctggctcggggtcaggaacagagtttactttgaccattagcagtttacagcccgaagacttcgccacatattactgtctgcagcacaactcctttcctaccttcggccagggtactaaactagagatcaagcgaacagtggcggctccatctgtatttatttttccccctagcgatgaacaactcaaatccgggaccgcctcagtggtctgcctgcttaataacttctatccacgtgaggcaaaggtgcagtggaaggttgacaatgccctgcagagtggaaacagccaggaatctgtgacggagcaagattccaaagactcaacttacagcttgagttctaccctcacactgtccaaggctgattatgagaaacataaggtctacgcatgtgaagtgactcaccagggcctgagctcgcccgtaaccaaatctttcaatagaggcgagtgc

SEQ ID NO: 23391 - RNA, 1353 nt, synthetic construct
  misc_feature 1..1353: note = derived and/or modified sequence opt3 from Inclacumab_HeavyChain1
  source 1..1353: mol_type = other RNA
gaggtgcagctggtcgaaagcggcgggggactcgttagacccggtggctcccttaggctgtcttgcgccgcttcagggttcacctttagtaactacgacatgcactgggtgcggcaagcaacaggaaagggcttggagtgggtaagcgccatcactgcggctggtgatatttattaccctgggtccgtgaaaggacgcttcacgatatctcgagaaaatgccaagaactcgttatatctgcagatgaactcactacgtgcaggcgacaccgccgtctactattgtgctagaggcaggtacagcgggagtggatcctattacaatgattggtttgacccatggggtcagggcacactcgtgactgtttctagcgcatccaccaaagggccgtcagtgttccccctggccccttgcagtcggagcacatctgagtccaccgctgcccttggatgtctggtcaaggattactttccagaacccgtgactgtatcatggaatagcggcgcgttgacaagtggtgttcataccttccctgcagtgctccagtcttccgggctgtatagcctgtcgtctgtcgtgacggtgccatcctcaagtctcggaactaaaacctacacatgcaacgtcgaccacaagcccagcaatactaaggttgataaacgcgtggagtccaagtatggccctccatgtccgccctgccctgccccagagtttgaaggcgggccctctgtattcttatttcctccaaaacccaaggacaccctgatgatcagcagaacaccggaggtgacctgtgtcgtggttgatgtgtcacaagaagaccctgaggtccagttcaactggtacgtggatggagtagaggttcataatgctaaaacgaagcccagggaggaacagtttaacagtacttatcgggtggtctccgtgcttacagtcttgcaccaggactggctgaatggtaaggaatacaaatgcaaggtgagcaacaaaggcctaccatcttcaattgagaagaccatcagtaaagccaaggggcaacctcgcgaaccccaggtttatactctcccacccagccaggaggagatgaccaaaaatcaggtgtccctgacatgtcttgtaaagggattctacccttctgatattgcagtcgaatgggagtcgaacggccaaccagaaaataactacaagacgaccccgcccgtgctggacagcgacggttcctttttcttgtattcacgactcacagttgataaaagtagatggcaggaggggaacgtgttctcttgcagcgtcatgcatgaagctctgcacaatcactacactcagaagtccttatcactgagcctcggcaaa

SEQ ID NO: 23392 - RNA, 642 nt, synthetic construct
  misc_feature 1..642: note = derived and/or modified sequence opt3 from Inclacumab_LightChain1
  source 1..642: mol_type = other RNA
gagatcgtgctgacccagagccccgccacactctccctttctcctggcgaaagagctactctgtcatgcagggcaagtcaaagcgtctcctcttacttggcctggtatcagcagaagccagggcaggcgccgcggttactgatttacgacgcttcgaaccgcgccacgggaatacccgcacgattctcaggtagcggcagtgggaccgattttacactaactatctcctctctcgagcctgaagacttcgccgtttattactgtcaacagcgtagcaattggccactgacctttggaggcggtacaaaagtggagattaagagaaccgtagctgcaccctccgtgttcatctttcctccatcagatgaacagcttaaaagtgggactgccagcgtcgtgtgcctgttgaacaatttctatcccagggaggctaaggttcagtggaaagtggacaacgccctccaatctggaaattcccaggagtcagtcacagaacaggatagcaaggacagtacctactctctgtccagcacgctgactctctcgaaggcggattatgagaaacacaaggtgtacgcatgtgaagtaacccatcagggcttatcttcccctgttacaaaatcatttaaccggggcgagtgc

SEQ ID NO: 23393 - RNA, 1347 nt, synthetic construct
  misc_feature 1..1347: note = derived and/or modified sequence opt3 from Indatuximab_ravtansine_HeavyChain1
  source 1..1347: mol_type = other RNA
caggtgcaactgcagcagagcggctccgagctcatgatgcccggggcctctgtcaagatctcatgcaaagctaccggatacacattcagtaactattggattgaatgggttaagcagagacctggtcacggccttgagtggataggggaaatcctgccaggaactggcaggacgatttacaatgagaaatttaagggtaaagcaaccttcacagccgacatcagctccaacactgtgcaaatgcagttgtcttcgttaacctcagaagatagcgcggtatattactgtgctcggcgcgactattacgggaatttttattacgccatggattactggggacagggcacaagtgtgaccgtctcctctgcaagcactaagggcccgtccgtgttccccctggccccttgctcacgaagtacaagcgagtctaccgctgcactagggtgtctcgttaaggactattttccagagcccgtgacggtctcctggaactcaggagccctgactagcggtgtgcataccttccctgctgtacttcagagttctggcctgtactccttgagctcggttgtgacagtcccatcttcctcactcgggactaaaacctatacatgcaatgtggatcacaagcccagtaacaccaaagtggacaagcgtgtcgaaagcaaatacggacctccatgtccgtcctgccccgcccctgagtttctgggcggtccatctgttttcctgtttccccctaagccaaaggatacgctcatgattagcagaactcccgaagtgacatgtgtagtggtcgacgtgtcacaagaggatccggaggttcagttcaattggtatgtggacggggtcgaagtgcataacgcgaaaaccaagcctagggaggaacagtttaatagtacttaccgggtagtttccgtgttaacagtcctgcaccaggattggcttaacggaaaagagtataagtgcaaagtgagcaataagggcttgccctcttcaatcgagaaaaccataagtaaggcaaagggccaaccacgcgaacctcaggtctacacgctgcccccaagccaggaggaaatgaccaaaaaccaagtgtccctaacatgtctcgttaaggggttctacccctctgacatcgccgtggagtgggaatcgaatggacagcctgagaacaattataaaactaccccaccggtactggatagcgacggttcctttttcctttactcaagactgacagtcgacaagagtaggtggcaggaaggcaacgtgttctcttgcagcgttatgcatgaggctttgcacaaccactatactcagaaatccctctcactgagcttagggaag

SEQ ID NO: 23394 - RNA, 642 nt, synthetic construct
  misc_feature 1..642: note = derived and/or modified sequence opt3 from Indatuximab_ravtansine_LightChain1
  source 1..642: mol_type = other RNA
gacatccagatgacccaaagcacatcctctctgtcagccagtctcggcgatagagtgactattagctgctccgcttctcaggggataaacaattaccttaactggtatcagcagaagcccgacggaacggtcgagctgttgatctactatacctcgacattacaatcaggtgttcctagcaggttcagtggctccgggtctggaactgattacagcctgaccatttccaatctagaaccagaggacatcggcacatattactgtcagcagtattcaaaactcccgcggacctttggtgggggaactaagctggaaattaaacgcacagtggcagcccccagtgtattcatctttcctccaagcgatgagcagcttaagtctggcaccgcgtccgtggtctgcctgttgaacaatttctacccccgagaagctaaagtgcaatggaaggttgacaacgccctccagtcaggcaatagccaggagagtgtgacggagcaggattctaaggactccacttacagcctgtcgtctaccctgacactctccaaagcagattatgaaaagcacaaagtctacgcctgtgaggtgactcatcaagggttatcaagtcctgtaaccaagagctttaaccgtggagaatgc

SEQ ID NO: 23395 - RNA, 1347 nt, synthetic construct
  misc_feature 1..1347: note = derived and/or modified sequence opt3 from Indusatumab_vedotin_HeavyChain1
  source 1..1347: mol_type = other RNA
caggtgcaactgcagcagtggggcgccgggctccttaagcccagcgagaccctgtccttgacatgcgctgtcttcggaggttctttttcaggctactattggagttggatcagacagcctccagggaaaggattagaatggattggcgagataaaccacaggggtaatactaacgacaatccgagcctgaagtcccgggttacgatctctgtggatacctcgaaaaaccaattcgcactaaagctctcaagcgtaacagccgcggacactgctgtgtactattgtgcccgcgaacgagggtacacctatggaaattttgatcattggggccagggcacactggtcaccgtgagttccgcatctactaaagggcccagcgttttccctcttgccccatcctcaaagagtacaagcggaggtaccgctgcactgggctgcttggtgaaggactactttcccgagcctgtcacggtgtcttggaactccggggccctcacttcaggagtacacaccttcccagctgttctgcagagcagtggcctgtattctctctccagcgtggtcacagtgccctcgtcttccttaggtactcagacctacatttgtaatgtgaaccataaaccttcaaatacaaaggtcgataaaaaggttgaaccaaaaagttgcgacaagacccacacgtgtccgccctgccctgccccagagctgcttgggggacccagcgtgtttttgttccctccaaagcccaaagatactctgatgatctcccgtacaccggaggtaacctgtgtggtcgtggacgtttctcatgaagatcctgaggtgaagtttaactggtacgtcgacggcgtggaagtacacaatgcgaaaactaagcccagagaggagcaatataacagcacatacagggttgtgtcagtcctaaccgtgctccaccaggattggctgaatggcaaagaatataagtgcaaagtcagtaacaaggcacttccagcccctattgagaagacgatctccaaagctaaggggcagccccgggaaccacaggtgtacaccctgccccctagccgcgacgagttgactaaaaatcaagtttctctcacatgtctggtgaagggattctatccatcagatatagccgtagaatgggagagtaacggtcagccggagaacaattacaaaaccacaccccctgtcttagacagcgacggctcctttttcctgtattctaagctcactgtggataagtcgagatggcagcaagggaacgtttttagctgctccgtgatgcatgaagcacttcacaatcattacacccagaaatcactgagtttgtctccaggaaag

SEQ ID NO: 23396 - RNA, 642 nt, synthetic construct
  misc_feature 1..642: note = derived and/or modified sequence opt3 from Indusatumab_vedotin_LightChain1
  source 1..642: mol_type = other RNA
gagatcgtgatgacccagagccccgccacactgtccgtctctcctggcgaaagagctactctctcatgcagggcaagtcaaagcgtttcccggaaccttgcctggtaccagcagaagccagggcaggcgccgcgcctgttgatttatggagcttctacgcgagccaccggtatacccgcacgtttctcgggctcagggagcggaacagagtttactttaaccatcggcagtctgcaatccgaagacttcgccgtgtactattgtcagcagtacaaaacatggcctagaacctttggtcaggggactaatgtagagattaagaggacagtggctgcaccatctgtcttcatctttccccctagcgatgaacaactaaaatccggaaccgcctcagtggtttgcctcctgaacaatttctatccacgggaggctaaggtgcagtggaaagtcgacaacgcccttcagagtggcaatagccaggagtctgtgacggaacaagattccaaggactcaacttacagcctgagttctaccttgacactctccaaggcggattatgagaaacacaaggtatacgcatgtgaagttactcatcagggcctgagctcgcccgtgaccaaatcttttaaccgcggggagtgc

SEQ ID NO: 23397 - RNA, 1353 nt, synthetic construct
  misc_feature 1..1353: note = derived and/or modified sequence opt3 from Inebilizumab_HeavyChain1
  source 1..1353: mol_type = other RNA
gaggtgcagctggtcgaaagcggcgggggactcgttcaacccggtggctcccttagactgtcttgcgccgcttcagggttcacctttagtagctcctggatgaactgggtgaggcaggcacctggaaagggcttggagtgggtaggtcggatctacccaggggacggagatacaaattataacgtgaaattcaagggccgctttactatttctcgagacgattcgaaaaattcattatacctgcagatgaacagcctaaagacggaagacaccgccgtctattactgtgcgcgtagtggcttcataacaactgtgagagattttgactattgggggcagggaaccctcgttacagtgtcctctgctagcaccaaaggtccgtccgtcttccccctggccccttcaagtaagagcacttctggcgggacagcagcccttggatgcctggtgaaggattactttccagagcccgtaaccgtttcctggaactcaggcgctttgacgagcggtgtgcacactttccctgcagtcctccaaagttctgggctgtattccctgagctcggtggtgaccgtcccatcttcctcactcggaacacagacttacatctgtaatgttaatcataaacccagtaacaccaaggtggacaaaagggtagaacctaagagctgcgataaaacacacacctgtccaccgtgccccgcccctgagttactgggcggcccatccgtgtttctttttccccctaagccaaaggacacgttgatgatttctcggactcccgaggtcacatgtgtggttgtggatgtcagccatgaagacccggaggtgaaatttaattggtacgtagatggggttgaagtgcacaacgctaagaccaaacctcgcgaggagcagtataattcaacttacagagtcgtgagtgtcctgacagtgctacatcaggactggctcaacggaaaggaatataaatgcaaggtttccaataaagccctgcccgcgccaatcgagaagaccattagcaaggcaaaaggtcaacctagggaaccccaggtgtacacgcttccaccctctcgggaggaaatgaccaagaaccaggtatcactgacatgtttggtcaaaggcttctatcctagtgacatcgccgtggagtgggagagcaatgggcagccagaaaacaactacaagactaccccgcccgttctcgattccgacggatctttcttcctgtattcgaaattaacagtggataagagccgctggcaacagggcaatgtcttctcctgctcagtgatgcacgaggctctgcacaaccattacactcagaagagtctctctcttagccctggtaaa

SEQ ID NO: 23398 - RNA, 654 nt, synthetic construct
  misc_feature 1..654: note = derived and/or modified sequence opt3 from Inebilizumab_LightChain1
  source 1..654: mol_type = other RNA
gagatcgtgctgacccagagccccgacttccaatccgtcacacctaaggaaaaagttactattacgtgcagagcctctgagtcagtggatacctttggcataagtttcatgaactggtttcagcagaagccagaccagagcccgaaactccttatccacgaggcttccaatcaagggtctggagtaccctcgaggttctcaggtagcggcagtgggacagattttactctgaccattaactccttggaagcagaagacgccgcgacatactattgtcagcagtctaaggaggtgcctttcacctttggaggcggtactaaagtcgagatcaagcggacagtggctgccccaagcgttttcatttttcccccttccgatgaacagttaaagtcagggaccgcaagtgtggtctgcctgctaaataacttctacccacgcgaggccaaagtgcaatggaaggtagacaatgctctccagagcggaaactctcaggaatccgttacggagcaggattcaaaagacagcacttatagtctgtcttccacccttacactgagcaaggcagattacgagaaacataaggtgtatgcctgtgaagtcactcaccaaggcttgtcgtctcccgtgaccaagtcctttaatcgaggcgagtgc

SEQ ID NO: 23399 - RNA, 90 nt, synthetic construct
  misc_feature 1..90: note = derived and/or modified sequence opt3 from Insulin_peglispro_Fragment1
  source 1..90: mol_type = other RNA
ttcgtgaaccagcacctgtgcggcagccatctcgtcgaggccctttacctggtttgtggggaaagaggatttttctataccaagcccaca

SEQ ID NO: 23400 - RNA, 63 nt, synthetic construct
  misc_feature 1..63: note = derived and/or modified sequence opt3 from Insulin_peglispro_Fragment2
  source 1..63: mol_type = other RNA
ggcatcgtggagcagtgctgtaccagcatttgctccctgtaccaactcgaaaactattgtaat

SEQ ID NO: 23401 - RNA, 495 nt, synthetic construct
  misc_feature 1..495: note = derived and/or modified sequence opt3 from Interferon_beta-1b_chain1
  source 1..495: mol_type = other RNA
agctacaacctgctcggcttccttcagagatcctctaattttcaatcacagaagctgttgtggcagttaaacgggaggctggagtattgcctaaaagaccggatgaatttcgatatccccgaagagattaagcagctccaacagtttcagaaagaagacgccgctctgaccatatacgagatgcttcagaacatcttcgcaatttttcgccaagatagtagctccacaggatggaatgaaactatcgtggagaacctgttggccaatgtctatcaccagattaaccatctcaagacggttctggaggaaaaactggagaaggaagacttcacccgaggtaagctcatgtcttcgttacacctgaaacgttactatggcagaatccttcattacttgaaggcgaaagagtattcacactgtgcttggacaatagtgagggtagagatcctgcggaatttttacttcattaaccgcctaactgggtacctcagaaat

SEQ ID NO: 23402 - RNA, 1347 nt, synthetic construct
  misc_feature 1..1347: note = derived and/or modified sequence opt3 from Intetumumab_HeavyChain1
  source 1..1347: mol_type = other RNA
caggtgcaactggtcgagagcggcgggggagttgtgcagcccggtagatccaggcggctctcttgcgccgcttcaggcttcacctttagtcgctacacaatgcactgggtacgacaggcacctgggaagggacttgaatgggtggccgtcatcagcttcgacggctccaacaaatattacgtggattctgttaagggtcgttttactatttcgagagacaattcagagaacacgctgtatttacaggtgaatatattgagggcggaagataccgctgtctactattgtgcccgggaggcacgcgggagctacgccttcgacatctggggacaaggcacaatggtgactgtaagttccgcttctaccaaaggcccaagcgtttttccgctggcaccctcctcaaagagtacaagcgggggaaccgccgctctaggttgcctcgtgaaagattatttccctgaaccagtcactgtgtcttggaactccggcgccctgacatcaggggtgcatacctttcccgcggtccttcagagcagtggactgtactctttgtccagcgttgtgacggtaccttcgtcttccctcggcactcagacctacatttgtaatgtgaaccacaagccatcaaatacaaaggtcgacaaaaaggtggagcccaaaagttgcgataagactcatacctgtcctccatgcccggcacccgagctgctgggtgggcctagcgttttcctctttccacccaaacctaaggacacattaatgatctccagaaccccagaagtgacgtgtgtcgtggtagatgtttctcacgaggaccccgaagtgaagttcaactggtatgtcgatggagtggaggtccataatgccaaaactaagccgagggaggaacagtacaacagcacatatcgggtggtttcagtgctgaccgtacttcaccaagactggttgaatggcaaagagtacaagtgcaaagtcagtaacaaggctctgcctgcccccattgagaaaactatctccaaggcaaagggccagccacgcgaacctcaggtgtatacactacccccaagccgagatgaactcaccaaaaatcaggtttctctgacgtgtcttgtgaaggggttttacccctcagacatagctgtcgagtgggagagtaacggacaacctgaaaataactataaaaccacaccaccggtgctggacagcgatggttccttctttttgtactctaagctcactgtagacaaatcgagatggcagcagggcaacgtgttcagctgctccgttatgcacgaggccctgcataatcactacacccaaaagtcattaagtctgtctcccgggaag

SEQ ID NO: 23403 - RNA, 645 nt, synthetic construct
  misc_feature 1..645: note = derived and/or modified sequence opt3 from Intetumumab_LightChain1
  source 1..645: mol_type = other RNA
gagatcgtgctgacccagagccccgccacactctccctttctcctggcgaaagagctactctgtcatgcagggcaagtcaaagcgtctcctcttacttggcctggtatcagcagaagccagggcaggcgccgcggttactgatttacgacgcttcgaaccgcgccacgggaatacccgcacgattctcaggtagcggcagtgggaccgattttacactaactatctcctctctcgagcctgaagacttcgccgtttattactgtcaacagcgtagcaattggccaccctttaccttcggacctggcacaaaagtggatattaagagaaccgtagctgcaccatccgtgtttatctttcccccttcagacgagcagctgaaaagtggtactgccagcgtcgtgtgccttctgaacaatttctatccaagggaagctaaggttcagtggaaagtggataacgccttgcaatctggaaattcccaggagtcagtcacagagcaggacagcaaggatagtacctactctctctccagcacgctgactctgtcgaaggcggactatgaaaaacacaaggtgtacgcatgtgaggtaacccatcaggggctctcttccccggttacaaaatcattcaaccggggcgaatgc

SEQ ID NO: 23404 - RNA, 1347 nt, synthetic construct; identical to SEQ ID NO: 23262
  misc_feature 1..1347: note = derived and/or modified sequence opt3 from Iodine_(124I)_Girentuximab_HeavyChain1
  source 1..1347: mol_type = other RNA

SEQ ID NO: 23405 - RNA, 642 nt, synthetic construct; identical to SEQ ID NO: 23263
  misc_feature 1..642: note = derived and/or modified sequence opt3 from Iodine_(124I)_Girentuximab_LightChain1
  source 1..642: mol_type = other RNA

SEQ ID NO: 23406 - RNA, 1335 nt, synthetic construct
  misc_feature 1..1335: note = derived and/or modified sequence opt3 from Iodine_(131I)_derlotuxiab_biotin_HeavyChain1
  source 1..1335: mol_type = other RNA
caggtgcaactgaaggagagcggccccgggctcgtcgccccttcccagtctctttcaattacctgcacagttagtggattcagcctgactgactacggtgtgagatggatcaggcagccaccgggcaaagggttggaatggttaggagtaatatggggcggtgggtccacgtattacaactctgctctgaagtcgcggctatcaatcagcaaagataatagtaagtcccaggtgtttctcaaaaactctctgcaaaccgacgatacagcatattactgtgccaaggagaagcgccgaggatattactatgcggactactggggccagggcactagcgtcaccgtgtcctcagctagtacaaaagggcccagcgttttccctcttgccccatcttccaagtcaaccagcggaggtactgcagccctgggctgcttggtgaaagattactttcccgaacctgtcacagtgagttggaactctggggctctcacctccggagtacacacgttcccagcagttctgcagagctcgggcctgtattctctctcctcagtggtcactgtgcccagtagctccttaggtacccagacatacatttgtaatgtgaatcataagccttctaacactaaagtcgacaagaaggccgagccaaaaagctgcgataagacccacacatgtccgccctgccctgctccagaactgcttgggggaccctcagtgtttttgttccctccaaaacccaaggacaccctgatcagtcgtacgccggaggttacttgtgtagtggtcgatgtgtcccatgaggaccctgaagttaaatttaattggtatgtggatggcgtcgaggtgcacaacgccaagacaaaacccagagaagaacaatacaatagcacctatagggtagtttctgtgctaactgtcctccatcaggactggctgaacggcaaggagtacaagtgcaaagtgtcaaataaggcgcttccagcacctattgagaaaacaatcagtaaggccaaagggcagccccgggagccacaggtctataccctgccccctagccgcgatgaattgacgaagaaccaagtgtccctcacctgtctggttaagggattctacccatctgacatagctgtggagtgggaatcgaatggtcagccggagaacaattacaaaacaactccccctgtattagacagcgatggctcctttttcctgtattcaaagctcaccgtcgacaaaagtagatggcagcaagggaacgtgttttcttgcagcgttcacgaggcccttcacaaccattacacacagaagtccctgtcattgagcccaggaaaa

SEQ ID NO: 23407 - RNA, 639 nt, synthetic construct
  misc_feature 1..639: note = derived and/or modified sequence opt3 from Iodine_(131I)_derlotuxiab_biotin_LightChain1
  source 1..639: mol_type = other RNA
gagaacgtgctgacccagagccccgccatctccgcttctcctggcgaaaaggtcacaacttgcagagcatcaagtagcgtttcctcttcgtacctccactggtatcaacagaaatcaggggccagcccaaaactttggatttacagtacgtccaatctggcgtctggagtgccggctaggttcagcggttccggctcagggaccagttatagcttgacaatatcttccgtagaggccgaagacgcagccacttactattgtcagcagtactcaggatatcccttaacctttggcggtgggacaaagctggagatcaagcggaccgtggctgcacctagcgtcttcatttttccacccagtgatgaacaactaaaatctggaactgcctccgtggtttgcctcctgaacaatttctaccctcgcgaggctaaggtgcagtggaaggtcgacaacgcccttcagagcggcaattcgcaggagtctgtgacagaacaagattccaaagactcaacctacagtctgagctccacgttgactctctctaaggcggattatgagaaacataaggtatacgcatgtgaagttacccaccagggcctgagctcaccagtgacaaaaagttttaaccgaggggagtgc

SEQ ID NO: 23408 - RNA, 1350 nt, synthetic construct
  misc_feature 1..1350: note = derived and/or modified sequence opt3 from Iodine_(131I)_Derlotuximab_biotin_HeavyChain1
  source 1..1350: mol_type = other RNA
caggtgcaactgaaggagagcggccccgggctcgtcgccccttcccagtctctttcaattacctgcacagttagtggattcagcctgactgactacggtgtgagatggatcaggcagccaccgggcaaagggttggaatggttaggagtaatatggggcggtgggtccacgtattacaactctgctctgaagtcgcggctatcaatcagcaaagataatagtaagtcccaggtgtttctcaaaatgaactctctgcaaaccgacgatacagcaatgtattactgtgccaaggagaagcgccgaggatattactatgcgatggactactggggccagggcactagcgtcaccgtgtcctcagctagtacaaaagggcccagcgttttccctcttgccccatcttccaagtcaaccagcggaggtactgcagccctgggctgcttggtgaaagattactttcccgaacctgtcacagtgagttggaactctggggctctcacctccggagtacacacgttcccagcagttctgcagagctcgggcctgtattctctctcctcagtggtcactgtgcccagtagctccttaggtacccagacatacatttgtaatgtgaatcataagccttctaacactaaagtcgacaagaaggccgagccaaaaagctgcgataagacccacacatgtccgccctgccctgctccagaactgcttgggggaccctcagtgtttttgttccctccaaaacccaaggacaccctgatgatcagtcgtacgccggaggttacttgtgtagtggtcgatgtgtcccatgaggaccctgaagttaaatttaattggtatgtggatggcgtcgaggtgcacaacgccaagacaaaacccagagaagaacaatacaatagcacctatagggtagtttctgtgctaactgtcctccatcaggactggctgaacggcaaggagtacaagtgcaaagtgtcaaataaggcgcttccagcacctattgagaaaacaatcagtaaggccaaagggcagccccgggagccacaggtctataccctgccccctagccgcgatgaattgacgaagaaccaagtgtccctcacctgtctggttaagggattctacccatctgacatagctgtggagtgggaatcgaatggtcagccggagaacaattacaaaacaactccccctgtattagacagcgatggctcctttttcctgtattcaaagctcaccgtcgacaaaagtagatggcagcaagggaacgtgttttcttgcagcgttatgcacgaggcccttcacaaccattacacacagaagtccctgtcattgagcccaggaaaa

SEQ ID NO: 23409 - RNA, 645 nt, synthetic construct
  misc_feature 1..645: note = derived and/or modified sequence opt3 from Iodine_(131I)_Derlotuximab_biotin_LightChain1
  source 1..645: mol_type = other RNA
gagaacgtgctgacccagagccccgccatcatgtccgcttctcctggcgaaaaggtcacaatgacttgcagagcatcaagtagcgtttcctcttcgtacctccactggtatcaacagaaatcaggggccagcccaaaactttggatttacagtacgtccaatctggcgtctggagtgccggctaggttcagcggttccggctcagggaccagttatagcttgacaatatcttccgtagaggccgaagacgcagccacttactattgtcagcagtactcaggatatcccttaacctttggcggtgggacaaagctggagatcaagcggaccgtggctgcacctagcgtcttcatttttccacccagtgatgaacaactaaaatctggaactgcctccgtggtttgcctcctgaacaatttctaccctcgcgaggctaaggtgcagtggaaggtcgacaacgcccttcagagcggcaattcgcaggagtctgtgacagaacaagattccaaagactcaacctacagtctgagctccacgttgactctctctaaggcggattatgagaaacataaggtatacgcatgtgaagttacccaccagggcctgagctcaccagtgacaaaaagttttaaccgaggggagtgc

SEQ ID NO: 23410 - RNA, 1344 nt, synthetic construct
  misc_feature 1..1344: note = derived and/or modified sequence opt3 from Ipilimumab_HeavyChain
  source 1..1344: mol_type = other RNA
caggtgcaactggtcgagagcggcgggggagttgtgcagcccggtagatccctcaggctttcttgcgccgcttcaggcttcacctttagtagctacacaatgcactgggtacggcaggcacctgggaagggactggaatgggtgactttcatctcctatgacggcaacaataaatactatgccgattctgtcaagggtcgctttacgatttcgcgagacaacagcaaaaataccttgtacttacagatgaactcactgcgtgcggaggatacagctatatattactgtgccagaactgggtggctaggaccattcgactattggggccaaggcaccctcgtgacagttagttccgcatctaccaaggggccgagcgtgtttcccctggccccttcctcaaaaagtactagcggaggtacagctgcacttggctgcctggtcaaggattacttcccagaacccgtgaccgtatcttggaactccggggccttgacgtcaggagttcatacttttcctgctgtgctccagagcagtggcctgtactctctgtccagcgtcgtgaccgtgccatcgtcttccctcggtacacagacttatatctgtaatgtcaatcacaagccctcaaacaccaaagttgacaagagggtggagcctaaaagttgcgataagacacatacctgtccaccgtgccccgcccctgaattacttgggggaccaagcgtattcctgtttccccctaaaccaaaggacacgttgatgatttcccggactcccgaggtgacatgtgtcgtggttgatgtgtctcacgaggacccggaagtcaagttcaattggtacgtggatggcgtagaggttcataacgcgaaaaccaagcctcgcgaagaacagtataatagcacttacagagtggtctcagtgctgacagtcctacaccaagactggctcaacggcaaagagtataagtgcaaagtgagtaataaggcactgcccgccccaatcgagaaaaccatttccaaggctaaggggcagcctagggagccccaggtttacacgcttccacccagccgggatgaactgaccaaaaaccaggtgtctttgacatgtctcgtaaagggattttatccttcagacatcgccgtcgagtgggaaagtaatggtcaaccagagaacaactacaaaactaccccgcccgtgctggacagcgatggctccttctttttatactctaagctgacagttgacaaatcgcgctggcagcaggggaatgtgttcagctgctccgtcatgcacgaggcactccataaccactatactcaaaagtcacttagtctgtctcctggaaag

SEQ ID NO: 23411 - RNA, 645 nt, synthetic construct
  misc_feature 1..645: note = derived and/or modified sequence opt3 from Ipilimumab_LightChain
  source 1..645: mol_type = other RNA
gagatcgtgctgacccagagccccggcacactctccctttctcctggggaaagagccactctgtcatgcagggctagtcaaagcgtcggatcctcttacttggcatggtatcagcagaagccaggtcaggccccgcggttactgatttacggcgcgttctcgcgcgctacggggatacccgaccgattttcaggaagcggcagtggtaccgatttcacactaactatctcccgtctcgagcctgaagactttgccgtttattactgtcaacagtatgggtctagcccatggaccttcggacagggcacaaaagtggagattaagagaaccgtagcagccccctccgtgtttatcttccctccatcagatgaacagctgaaaagtggcactgctagcgtcgtgtgccttctgaacaatttttaccccagggaggcaaaggttcaatggaaagtggacaacgccttgcagtctggaaattcccaggagtcagtcacagaacaggatagcaaggacagtacctattctctctccagcacgctgactctgtcgaaggctgattacgagaaacacaaggtgtacgcctgtgaagtaacccatcaagggctctcttcccctgttacaaaatcattcaaccggggtgagtgc

SEQ ID NO: 23412 - RNA, 186 nt, synthetic construct
  misc_feature 1..186: note = derived and/or modified sequence opt3 from Iratumumab_HeavyChain1
  source 1..186: mol_type = other RNA
caggtgcaactgcagcagtggggcgccgggctccttaagcccagcgagaccctgtccttgacatgcgctgtctacggaggttctttctcagcatattactggagttggatcagacagcctccaggcaaagggttagaatggattggagactattggggccaaggtagcctggttactgtgtcctct

SEQ ID NO: 23413 - RNA, 321 nt, synthetic construct
  misc_feature 1..321: note = derived and/or modified sequence opt3 from Iratumumab_LightChain1
  source 1..321: mol_type = other RNA
gacatccagatgacccaaagccccacatccctgtctgcctcagtgggcgatagagtcactattacgtgcagggctagtcaggggataagctcctggctcacctggtaccagcagaagcctgagaaagcaccaaagtctcttatctatgccgcgtcgtcactgcaaagcggagttccgagtcggttctccggttctggcagcgggacagactttactttgaccatttcctcattacagcccgaagatttcgctacatactattgtcagcagtacgacagttatcctatcacctttggacaaggcactcgcctggagattaaa

SEQ ID NO: 23414 - RNA, 1350 nt, synthetic construct
  misc_feature 1..1350: note = derived and/or modified sequence opt3 from Isatuximab_HeavyChain1
  source 1..1350: mol_type = other RNA
caggtgcaactggtccagagcggcgccgaggttgctaagcccgggacctccgtgaaactctcttgcaaggcatcaggatacacattcactgactattggatgcagtgggtaaaacagagacctggtcaaggccttgaatggatcgggacgatttacccaggagatggcgacaccggttatgcccagaagtttcaggggaaagcgacactgactgctgataagagtagcaagaccgtgtacatgcacttgtcctctttagcctcggaggactcagcagtctattactgtgccaggggagattattacggcagcaacagtctggactactggggccaggggacatccgtgaccgtttctagcgcttccactaaaggaccgtcagtgttccccctagcacctagtagcaagtctacatccggtggcaccgccgctctcgggtgcctggtcaaagattattttccagaacccgtgacggtatcatggaatagcggagcccttaccagtggcgttcatactttccctgcggtgctgcaatcttccggtttgtacagcctctcgtctgtcgtgacagtgccatcctcaagtctggggactcagacctatatatgtaacgtcaatcacaagcccagcaacacaaaagttgacaagaaggtggagcctaaatcctgcgataagacccatacgtgtccaccgtgccccgcacctgaactgctcggaggcccatctgtatttttatttccccctaaaccaaaggacactctgatgatcagccggacacccgaggtgacctgtgtcgtggttgatgtgtcacacgaggacccggaagtcaaattcaattggtacgtggatggcgtagaggttcataacgccaagactaaacctcgcgaagaacagtataatagtacataccgagtggtctccgtgcttaccgtcttgcaccaggactggctgaacgggaaggagtataagtgcaaagtgagcaataaggctctacccgccccaattgagaaaacgatctctaaggcaaaaggacaacctcgtgagccccaggtttacaccctcccaccctcaagagacgaactgacaaagaaccaggtgagtcttacttgtctggtaaagggtttctaccctagcgatattgctgtcgagtgggaatccaatggccaaccagagaacaattataaaaccacaccgcccgtgttggactctgatgggtcgtttttcctctacagcaagctgactgttgacaaatccaggtggcagcagggaaacgtgttttcatgcagtgtcatgcacgaggccttacataatcactatacccagaagtctctgagcctctcccctggcaaa

SEQ ID NO: 23415 - RNA, 642 nt, synthetic construct
  misc_feature 1..642: note = derived and/or modified sequence opt3 from Isatuximab_LightChain1
  source 1..642: mol_type = other RNA
gacatcgtgatgacccagagccacctgtccatgtctacatcactcggcgatcccgtcagtattacttgcaaggccagccaagacgtttccacggtggtagcttggtaccagcagaaacctgggcagtctccaagaaggcttatatattcggcatcataccggtatatcggagtgccggatcgcttcaccggtagcggcgccgggacagactttactttcaccattagttccgtccaagcggaggatctggctgtgtactattgtcagcagcattactctcccccttatacatttggaggcggtaccaagttggaaatcaaacgaactgttgccgcaccaagcgtgttcatttttcccccttccgacgagcagttaaagtcagggacagccagtgtcgtgtgcctgctaaacaatttctacccacgtgaagctaaagtacaatggaaggttgataacgcactccagagcggaaattctcaggagtccgtgaccgaacaggactcaaaggatagcacgtacagtctgtcttccactcttaccctgagcaaagccgactatgagaagcacaaagtctacgcttgtgaggtgacacatcaaggcttgtcgtctcccgtgactaagtcctttaacagaggcgaatgc

SEQ ID NO: 23416 - RNA, 1347 nt, synthetic construct
  misc_feature 1..1347: note = derived and/or modified sequence opt3 from Itolizumab_HeavyChain1
  source 1..1347: mol_type = other RNA
gaggtgcagctggtcgaaagcggcgggggactcgttaagcccggtggctcccttaaactgtcttgcgccgcttcagggttcaagtttagtagatacgcaatgagctgggtgaggcaagcccctggaaaacggttggagtgggtagcgaccatctcctctggcggttcgtatatttactatccagactcagtgaaggggcgcttcacaataagccgagataacgtcaaaaatactttatacctgcagatgagttccctacgttctgaagacacggctatgtattactgtgccagaagggattatgacctcgattactttgacagctggggacagggcaccctggtgacagtttcctcagcaagtactaagggcccgagcgtgttcccccttgccccttcttccaagtcaaccagcgggggaacagctgcactgggttgcttggtcaaagattactttccagagcccgtgaccgtaagttggaactctggcgccctcacttccggggttcacacattccctgctgtgctgcagagctcgggactgtattctctctcctcagtcgtgaccgtgccaagtagctccttaggcacgcaaacttacatctgtaatgtcaaccataagccctctaataccaaagttgacaagaaagtggaacctaagagctgcgataagacacacacttgtccaccgtgccccgcccctgagctgcttggtgggccatcagtatttttgtttccccctaaaccaaaggacaccctgatgattagtcggacacccgaggtgacctgtgtcgtggttgatgtgtcccatgaagacccggaggtcaaattcaactggtatgtggatggagtagaagttcacaatgcgaagacgaaacctcgcgaggagcagtacaacagcacttatagagtggtctctgtgctaacagtcctccatcaggactggctgaatggcaaggaatacaaatgcaaggtgtcaaacaaggcacttcccgccccaatcgagaaaaccattagtaaggctaaaggccagcctagggaaccccaagtttatactctgccacccagccgggacgagttgacaaagaatcaggtgtccctcacctgtctggtaaaagggttctacccttctgatatcgccgtcgaatgggagtcgaacggacagccagagaataactacaagacgaccccgcccgtgttagacagcgatggttcctttttcctgtattcaaagctcacagttgacaaaagtcgctggcagcaaggcaatgtgttttcttgcagcgtcatgcacgaagcacttcacaaccattacactcagaagtccctgtcattgagccctgggaaa

SEQ ID NO: 23417 - RNA, 642 nt, synthetic construct
  misc_feature 1..642: note = derived and/or modified sequence opt3 from Itolizumab_LightChain1
  source 1..642: mol_type = other RNA
gacatccagatgacccaaagcccctcctctctgtcagccagtgtgggcgatagagtcacaattacttgcaaggctagcagggacatacggtcctacctcacgtggtatcagcagaaacctgggaaggcaccaaaaacccttatctactatgccacatctctggcggatggagttccgtcgcgcttctcaggtagcggcagtgggcaggactactccttgactatttctagcttagagtccgatgacaccgctacatattactgtctgcaacacggagaatcaccctttaccctaggcagtggtactaagctcgagatcaaacgaacagtggccgcacctagcgtattcatttttccaccctctgatgaacagctgaagtccgggaccgcctcagtggtctgccttctgaacaatttctatcctcgtgaggctaaggtgcagtggaaagttgacaacgcattgcagagcggaaatagtcaagaatctgtgacggagcaggattccaaggacagcacttactcgctctcttccaccctgacactgtcaaaagccgattacgagaagcataaagtctatgcttgtgaagtgactcaccagggcctcagtagcccagtaaccaagtcctttaacagaggcgagtgc

SEQ ID NO: 23418 - RNA, 1335 nt, synthetic construct
  misc_feature 1..1335: note = derived and/or modified sequence opt3 from Ixekizumab_HeavyChain1
  source 1..1335: mol_type = other RNA
caggtgcaactggtccagagcggcgccgaggttaagaaacccgggtcctctgtgaaggtatcatgcaaagctagtggatacagcttcaccgactatcacatccattgggtgagacaggcacctggtcagggcctcgaatggatgggggtcattaacccaatgtacggaacaactgattataatcaaaggtttaagggccgggtgacgataaccgccgacgagtccacatctactgcgtacatggaactttcgtcactgcgcagcgaggataccgctgtttattactgtgcccgatatgactacttcacaggtaccggggtgtactggggacagggcactttggtcacagtgagttccgcatctaccaaaggcccgagcgtatttcccttagccccttgctcccgttcaacgagtgaaagcactgctgcactggggtgtctagttaaggattatttcccagagcccgtgaccgtctcttggaactccggagccctcacatcaggtgtgcacacttttcctgctgtgctgcagagcagtggcctttactctctgtccagcgtcgttaccgtgccatcgtcttccttggggacaaagacctatacgtgcaatgtagaccataaaccctcaaacactaaggtggataaaagagtcgagagtaagtacggacctccatgtccgccctgccctgccccagagttcctcggcggtcccagcgtgtttctgttccctccaaaacccaaggacacactgatgatctccaggaccccggaggttacttgtgtggtcgtggatgtatctcaggaagaccctgaggttcaatttaattggtatgtggatggggtcgaggtgcacaacgcgaagacaaaaccccgggaagaacagttcaatagcacctaccgcgtcgtgtcagttctcacggtgttacatcaggactggctgaacggaaaggaatataaatgcaaggtaagtaataaaggccttccatccagcattgagaagaccatctctaaagcaaagggccagcctagagaaccccaagtctacacattgccaccctcacaggaggagatgactaagaaccaggtgagtctgacctgtctagttaaagggttttaccctagcgatattgccgtggaatgggagtccaatggacaaccagaaaacaattataagacaactccgcccgtcctcgactctgacggttcgttctttctgtacagcaggcttaccgtggataaatcccggtggcaggagggcaacgtattctcatgcagtgtgatgcacgaagctctgcacaatcattatacacagaagtctttgagcctctccctgggg

SEQ ID NO: 23419 - RNA, 657 nt, synthetic construct
  misc_feature 1..657: note = derived and/or modified sequence opt3 from Ixekizumab_LightChain1
  source 1..657: mol_type = other RNA
gacatcgtgatgacccagacacccctgagcctctccgtcactcctggccaaccagcctctatttcatgccggagtagcaggtcccttgttcactctcgggggaacacgtacctgcattggtatttgcagaagccgggacagtcgccccagttactgatatacaaagtgtcaaatcgcttcatcggtgtacctgatcgatttagcggcagtgggtccggaaccgacttcacactaaagatttctcgtgtggaggctgaagatgtcggcgtgtattactgtagccaatccactcacctcccatttaccttcggtcaggggacaaaactggagatcaagagaaccgttgcagccccctcagtgtttattttccctccaagtgacgaacagcttaaaagcggaactgcgtctgtcgtgtgcctgttgaacaatttttatcccagggaggctaaggtacagtggaaggttgataacgccctccaatccggcaattcacaggaaagcgtgacagagcaggacagtaaagattctacctactccctgagctcgacgctgactctctctaaggcagactatgagaaacataaggtctacgcctgtgaagtgacccaccagggcttatcctcacctgtgacaaaaagtttcaacagaggggagtgc

SEQ ID NO: 23420 - RNA, 1347 nt, synthetic construct
  misc_feature 1..1347: note = derived and/or modified sequence opt3 from Labetuzumab_govitecan_HeavyChain1
  source 1..1347: mol_type = other RNA
gaggtgcagctggtcgaaagcggcgggggagttgtgcaacccggtagatccctcaggctttcttgctcagccagtggcttcgactttaccacatactggatgagctgggtacggcaggctcctgggaagggactggagtggatcggcgaaattcacccagattcctctactataaactatgcaccgtcgttgaaagaccgcttcacgatctcacgagataatgccaagaacaccttatttctgcagatggacagcctacgtcccgaggatacaggtgtgtacttctgtgcgagtctctattttgggttcccttggtttgcttactggggacagggcactccagtcaccgtgtcctctgccagcacaaaaggcccctccgttttccctctggcaccatcaagtaagagcacctctgggggaactgccgctcttggttgcctggtgaaagactattttcccgaacctgtcacagtgtcctggaactcaggcgcattgaccagcggggtacatacgttcccagccgttctccaaagttctggactgtactccctgagctcggtggtcactgtgccgtcttcctcactcggcacccagacatatatttgtaatgtgaatcacaagcccagtaacactaaggtcgataaaagagttgagcctaagagctgcgacaaaacccatacatgtccaccctgccctgctccagagttactgggtgggccctccgtgtttcttttcccgcctaagcccaaagataccttgatgatctctaggacgccagaagtaacttgtgtggtcgtggacgttagccacgaggatcctgaagtgaagtttaattggtacgtcgacggagtggaggtacataacgccaagacaaaaccccgggaggaacagtacaattcaacctatcgcgttgtgagtgtcctgactgtgctacaccaggattggctcaacggcaaggagtacaaatgcaaggtctccaataaagcgctgccagcacccattgaaaagacaatcagcaaagccaagggccaacctagagagccacaggtgtatacccttccgccctctagggaagagatgacgaagaaccaggtttcactgacctgtttggtgaaagggttctaccctagtgacatagctgtagagtgggaaagcaatggacagccagagaacaattataagacaactccccctgtcctcgactccgatggttctttctttctgtactcgaaattaaccgtggacaagagccggtggcaacagggcaacgttttctcctgctcagtgatgcacgaagccctgcataaccactatacacagaaaagtctctctcttagcccagggaag

SEQ ID NO: 23421 - RNA, 639 nt, synthetic construct
  misc_feature 1..639: note = derived and/or modified sequence opt3 from Labetuzumab_govitecan_LightChain1
  source 1..639: mol_type = other RNA
gacatccagctgacccaaagcccctcctctctctcagccagtgtgggcgatagagtcacaattacttgcaaggctagccaggacgttgggacgtccgtggcatggtaccagcagaaacctggaaaggccccaaaacttctgatatattggacctctacaaggcacactggtgtaccgtcgcggttctcaggcagcgggagtggaaccgattttacattcaccatctcctctttgcaacccgaggacattgcgacttactattgtcagcagtacagcttatatcgctcctttggccagggtacaaaggtggaaatcaaacgaaccgtcgctgccccttcagtgttcatttttccacccagtgatgagcaactaaagagcgggacggcatctgttgtgtgcctgctcaacaatttctaccctcgtgaagccaaggtccagtggaaagtggacaacgctctgcagtccggaaattcacaggagagcgtaactgaacaagatagtaaggactctacctattcccttagctcgacactgactttgtctaaagcagattacgagaagcataaagtttacgcctgtgaggtgacccaccagggcctctcctcaccagtcacaaagagttttaacagaggcgaatgc

SEQ ID NO: 23422 - RNA, 1341 nt, synthetic construct
  misc_feature 1..1341: note = derived and/or modified sequence opt3 from Lambrolizumab_HeavyChain1
  source 1..1341: mol_type = other RNA
caggtgcaactggtccagagcggcgttgaggtgaagaaacccggggcctccgtaaaggtgtcttgcaaggcttcaggatacaccttcacaaactattacatgtattgggtcagacaggcacctggtcagggcctcgaatggatgggagggatcaatccaagtaacggcggtactaattttaacgagaaattcaaaaatagggtgacgcttaccacagacagctccactaccacagcctacatggaactgaagtctttgcaatttgatgacaccgcggtttattactgtgctcggcgcgattatcgattcgacatggggtttgattactggggacagggcactacagtgaccgtctcgtcagccagcacgaagggcccgagtgtgttccccttagcaccttgctcccgttctactagcgagtccaccgccgctctggggtgtctagtaaaagactactttccagaacccgttacagtgtcatggaacagtggagcactcactagcggtgtccacaccttccctgccgtgctgcagtcttccggcctttattcactgagcagtgtggtcacagttccatcttccagcttggggaccaagacgtacacttgcaatgtggatcataaaccctcgaacacaaaggtagacaaaagagtggagtctaagtatggacctccatgtccgccctgccctgctccagagtttctcggcggtccctccgtcttcctgtttcctccaaagcccaaagataccctgatgatttcaaggactccggaagtgacatgtgttgtggtcgacgtgagtcaggaggatcctgaagtacaattcaattggtacgttgacggggtggaggtccacaacgccaagaccaaaccccgggaggaacagtttaatagcacgtatcgcgtggtctccgtgctcaccgttttacatcaggattggctgaacggaaaggagtacaaatgcaaggtgtctaataaaggccttccaagctcaatagaaaagacaatcagtaaggcgaaaggccagcctagagagccccaagtatatactttgccaccctcccaggaagagatgaccaagaaccaggtcagcctgacatgtctagtgaaagggttctacccttctgacattgcagttgagtgggaatcaaatggacaaccagagaacaactacaagactaccccgcccgtgctcgacagtgatggtagcttctttctgtattccaggcttacagtcgacaaatctcggtggcaggaaggcaatgtgttctcgtgcagcgtaatgcacgaggccctgcataaccactacacccagaagtccttgtcactcagtctggggaag

SEQ ID NO: 23423 - RNA, 654 nt, synthetic construct
  misc_feature 1..654: note = derived and/or modified sequence opt3 from Lambrolizumab_LightChain1
  source 1..654: mol_type = other RNA
gagatcgtgctgacccagagccccgccacactctccctttctcctggcgaaagagctactctgtcatgcagggcaagtaagggggtcagcacgtccggatactcttatttgcactggtaccaacagaaaccaggtcaggccccgcggttactgatttatctagcgtcgtacctcgagtcaggcgttcccgctcgcttcagcgggagtggatccggcaccgactttacactgactatatctagccttgaacctgaggatttcgccgtgtattactgtcagcattcccgagacctgccattgacctttggtgggggaacaaaggtagaaatcaaacgtaccgtggcagccccctcagtcttcatttttcctccaagtgatgagcaactcaagagcggcactgcttctgtggtttgcctgctgaacaatttctatcccagagaggcaaaagtgcagtggaaggtcgacaacgccctccagtccggcaattcacaggaaagcgtgacagagcaagatagtaaggactctacctactccttaagctcgacgctgactctttctaaagctgattacgaaaagcacaaagtatatgcctgtgaggttacccatcaggggttgtcctcacctgtgacaaagagttttaacaggggagagtgc

SEQ ID NO: 23424 - RNA, 669 nt, synthetic construct
  misc_feature 1..669: note = derived and/or modified sequence opt3 from Lampalizumab_HeavyChain1
  source 1..669: mol_type = other RNA
gaggtgcagctggtccaaagcggccccgaactcaagaaacctggggcctccgttaaggtgtcttgcaaggcttcaggatacaccttcacaaactatggtatgaattgggtaagacaggcaccaggccaggggcttgagtggatgggatggatcaacacttacacgggcgaaaccacatatgccgacgattttaaaggtaggttcgtgtttagtctggacactagcgtctccaccgcgtacttgcagatttcttcgttaaaagctgaggatacagccgtgtattactgtgaacgggaagggggagttaataactggggccaaggcaccctggtgactgtctcaagcgcaagtacaaaggggccgtccgtgttccccctagccccttctagcaagtccacctcaggaggtacggctgcactcggctgcctggtaaaagactattttccagagcccgttactgtgagttggaatagcggggcccttacctctggagtccacacattccctgctgtgctgcagtcctcaggcttgtacagcctcagttctgtggtcactgttccatccagctcgctgggtacccagacatacatatgtaacgtgaatcataagccctctaacaccaaagtagataagaaagtggagcctaagtcctgcgacaagacgcacact

SEQ ID NO: 23425 - RNA, 642 nt, synthetic construct
  misc_feature 1..642: note = derived and/or modified sequence opt3 from Lampalizumab_LightChain1
  source 1..642: mol_type = other RNA
gacatccaggtgacccaaagcccctcctctctgtcagccagtgtcggcgatagagttacaattacttgcataacgagcaccgacatcgatgacgatatgaactggtaccagcagaagcctgggaaagtgccaaagctccttatttccggaggtaatacactgaggccgggcgtaccctctcggttctcggggtcaggaagcggcactgactttaccttgacaatcagttccttacagcctgaggatgtggctacctattactgtctgcaatctgacagcctaccatatactttcggtcaggggacaaaagtcgaaattaagcgcaccgtggcagccccctccgtttttatcttccctccatcagatgagcagctcaaaagtggaacggcgagcgtggtctgcctgcttaacaatttttacccccgagaagctaaggtgcagtggaaggtagacaacgccctgcaatctggcaattcccaggagtcagttactgaacaggatagcaaagacagtacctattctttgtccagcacactcactctgtcgaaggcagattacgagaaacacaaggtgtatgcctgtgaggtcacccatcagggcctgtcttcccctgtgacaaaatcattcaaccgtggggaatgc

SEQ ID NO: 23426 - RNA, 1353 nt, synthetic construct
  misc_feature 1..1353: note = derived and/or modified sequence opt3 from Lanadelumab_HeavyChain1
  source 1..1353: mol_type = other RNA
gaggtgcagctgctcgaaagcggcgggggacttgtccaacccggtggctccctgagattgtcttgcgccgcttcagggttcacctttagtcactacatcatgatgtgggttaggcaggcacctggaaagggcttagagtgggtgagcggtatttattcctctgggggaataacagtatacgccgactcggtgaaaggccggttcactatctcacgcgataacagcaagaatacgctgtatctacagatgaacagtctccgagcggaagacaccgctgtctactattgtgcctaccgtagaattggcgtgccaaggcgggatgagtttgacatctgggggcagggaacaatggttactgtgtcctctgcaagcaccaaaggtccgtccgtcttccccctggccccttcaagtaagagcacatctggcgggaccgctgcacttggatgcctggtgaaagattattttccagaacccgtaactgtttcctggaactcaggcgccttgacaagcggtgtgcataccttccctgctgtcctccaaagttctgggctgtactccctgagctcggtggtgacggtcccatcttcctcactcggaactcagacctacatttgtaatgttaatcacaagcccagtaacacaaaggtggacaaacgcgtagagcctaagagctgcgataaaactcatacctgtccaccgtgccccgcccctgagttactgggcggcccatccgtgtttctttttccccctaagccaaaagacacattgatgatctctagaacccccgaagtcacgtgtgtggttgtggatgtcagccacgaggacccggaagtgaagtttaattggtatgtagatggggttgaggtgcataacgcgaagactaaacctagggaggaacagtacaattcaacatatcgggtcgtgagtgtcctgaccgtgctacaccaggactggctcaacggaaaggagtacaaatgcaaggtttccaataaagcactgcccgccccaatagaaaagactatcagcaaagctaagggtcaacctcgcgagccccaggtgtatacacttccaccctctcgagaagagatgaccaagaaccaggtatcactgacgtgtttggtcaaaggcttctaccctagtgatattgccgtggagtgggaaagcaatgggcagccagagaacaattataagaccacaccgcccgttctcgactccgacggatctttcttcctgtactcgaaattaactgtggataagagcagatggcaacagggcaacgtcttttcctgctcagtgatgcacgaagcactgcataaccactacacccagaaaagtctctctcttagccctggt

SEQ ID NO: 23427 - RNA, 639 nt, synthetic construct
  misc_feature 1..639: note = derived and/or modified sequence opt3 from Lanadelumab_LightChain1
  source 1..639: mol_type = other RNA
gacatccagatgacccaaagcccctccacactgtctgcctcagtgggcgatagagtcactattacgtgcagggctagtcagagcatatcctcttggctcgcatggtaccagcagaagcctgggaaagccccaaaacttctgatctataaggcgtcgaccttggagtcaggagttccgagccggttcagtggttccggctctgggacagaatttactttaaccattagctccctgcaacccgacgatttcgctacatactattgtcagcagtacaacacctattggacttttggacagggcacaaaggtggagatcaaacgcaccgtagccgcaccttcagtgttcatttttccacccagtgacgaacaactaaagagcggtacggcctctgtcgtgtgcctcctgaataacttctaccctcgagaggctaaggttcagtggaaagtggataatgcacttcagtccgggaactcacaggaaagcgtcactgagcaagacagtaaggattctacctattccctgagctcgacattgactctctctaaagccgactacgagaagcacaaagtgtacgcttgtgaagtaacccatcagggactgtcctcaccagttacaaagagttttaatcgtggcgagtgc

SEQ ID NO: 23428 - RNA, 1317 nt, synthetic construct
  misc_feature 1..1317: note = derived and/or modified sequence opt3 from Landogrozumab_HeavyChain1
  source 1..1317: mol_type = other RNA
gaggtgcagctggtcgaaagcggcgggggactcgttcaacccggtggctcccttagactgtcttgcgccgcttcagggttgaccttcagtaggtaccctatgagctgggtgcggcaggcaccaggaaagggcttagtatgggtgtccgccatcacatcttcgggtgggtcaacttattacagcgacacggtcaaaggacgctttaccattagtcgagataacgcgaagaatacactgtatctacagatgaactccctccgtgctgaggacactgccgtgtactattgtgcaagactgccggattactggggccagggcacccttgttacagtgtctagcgcctccaccaaagggccctcagtcttccctctggctccatgcagtaggagcacttctgaatccacagcagccttgggatgtctcgtgaaggactattttcccgagcctgtaaccgtttcatggaatagcggtgctctgacgagtggcgtgcacactttcccagccgtcctgcaatcttccgggctctacagcttatcgtctgtggtgaccgtcccctcctcaagtctgggaacaaaaacttatacctgcaacgttgatcataagcctagcaatacaaaggtggacaaacgggtagaatccaagtacggcccaccgtgtcccccttgcccagcgcccgagtttcttggtgggccttctgtgttcttgtttccacccaaaccgaaggataccctgatgataagccgcacgcctgaggtcacttgtgtggttgtggacgtctcacaggaagatcccgaggtgcagttcaactggtacgtagacggagttgaagtgcacaatgcaaaaacaaagccaagagaggagcagtttaacagtacctatagggtcgtgtccgtcctaactgtgctccatcaagattggctgaatggcaaggaatacaaatgcaaggttagcaacaaaggccttccttcttcaatcgagaagacaattagtaaagccaaggggcagccccgggaaccacaggtgtataccctgccccctagccaggaggaaatgacgaaaaatcaagtatccttgacctgtctcgtcaagggattctacccatctgacatcgctgtggagtgggagtcgaacggtcagccggaaaataactataagacaactccccctgttctggatagcgacggctcctttttcttatactcacgcctgaccgtggacaaaagtcgatggcaggaggggaatgtcttttcttgcagcgtgatgcacgaagccctccataaccactacacacaaaagtccctttcactgagcttggga

SEQ ID NO: 23429 - RNA, 645 nt, synthetic construct
  misc_feature 1..645: note = derived and/or modified sequence opt3 from Landogrozumab_LightChain1
  source 1..645: mol_type = other RNA
gagatcgtgctgacccagagccccggcacactctccctttctcctggggaaagagccactctgtcatgcagggctagtagctccgtctcttcgtcatacttgcactggtatcaacagaaaccaggacaggcaccgcggttactgatttacagcacgagtaacctagttgccggtatacccgaccgcttctccggctctgggagcggaaccgattttacactcactatctcccgactggagcctgaagacttcgcggtgtattactgtcagcatcactcaggctatcattttaccttcggtgggggaacaaaagtagagattaagcgtaccgtggctgccccaagtgtctttatctttccccctagcgatgaacaacttaaatctggcactgcatccgtggtttgcctgttgaataacttctacccaagagaggccaaggtgcagtggaaagtcgacaatgctctccagtcaggcaacagccaggagagtgtgacagaacaagattctaaggactccacctatagcctgtcgtctacgctgactctctccaaggcagattacgagaaacacaaggtatacgcctgtgaagttacccatcaggggttatcaagtcccgtgacaaagagcttcaataggggagagtgc

SEQ ID NO: 23430 - RNA, 1344 nt, synthetic construct
  misc_feature 1..1344: note = derived and/or modified sequence opt3 from Laprituximab_emtansine_HeavyChain1
  source 1..1344: mol_type = other RNA
caggtgcaactggtccagagcggcgccgaggttgctaagcccggggcatccgtgaaactctcttgcaaggcctcaggatacaccttcacaagttattggatgcagtgggtaaaacagagacctggtcaaggccttgaatgtatcgggactatttacccaggagacggcgatacgacctatacacagaagtttcagggtaaagcgactctgaccgctgacaagagctcctctacagcctacatgcagttgtcgtcattaaggagcgaggatagtgcagtgtattactgcgcccggtatgacgctccggggtacgcaatggattactggggacaaggcaccctggtcactgtgtcctctgccagcacaaagggcccctccgttttccctctagctccatcaagtaaaagcacctctgggggaacggccgcgctcggttgtctggtgaaggactattttcccgaacctgtcactgtgtcctggaactcaggcgcacttaccagcggggtacacacattcccagccgttctgcagagttctggattgtactccctcagctcggtggtcactgtgccctcttcctcactgggcacccagacatatatatgcaatgtgaaccataaacctagtaataccaaggtcgataaaaaggttgagccaaagagctgtgacaaaacgcacacttgcccgccctgtcctgctccagaactgctcggtgggccctccgtgtttttattccctccaaagcccaaagatacactgatgatctctcgcaccccggaggtaacttgcgtggtcgtggacgttagccatgaggatcctgaagtgaagtttaactggtacgtcgacggagtggaggtacacaatgccaaaacaaagccccgagaggaacagtataactcaacctaccgtgttgtgagtgtccttacggtgttgcatcaagattggctgaatggcaaagagtataagtgtaaggtctccaacaaagcactaccagctcctattgaaaagaccatcagcaaagccaagggccagcccagagagccacaggtgtacacactgcccccttctagggacgaactcactaaaaatcaagtttcacttacctgcctggtgaaggggttctacccaagtgacattgcggtagagtgggaaagcaacggacagccggagaataactataagacaactccccctgtcttggattccgacggttctttctttctctactcgaaactgaccgtggataagagccggtggcagcagggcaatgtttttagttgttcagtgatgcacgaggccttacacaaccattatacacaaaaatccctgtctctcagcccaggg

SEQ ID NO: 23431 - RNA, 642 nt, synthetic construct
  misc_feature 1..642: note = derived and/or modified sequence opt3 from Laprituximab_emtansine_LightChain1
  source 1..642: mol_type = other RNA
gacatccagatgacccaaagcccctcctctctgtcagccagtgtgggcgatagagtcacaattacttgcagggctagccaggacataaacaattacctcgcatggtatcagcacaagcctgggaaaggaccaaaacttctgatccattacacgtccaccttgcacccgggtattccctctcggttctcgggctcagggagcggacgcgattatagtttttccatctctagcttagagcctgaagacattgccacatactattgtctgcagtacgataacctactctatactttcggccaaggtaccaagctggagatcaagcgaacagttgcggctccatccgtgtttatatttcccccttcagacgaacagcttaaaagtgggaccgccagcgtagtgtgcctgttgaataacttctacccacgtgaggcaaaggtccagtggaaggtggataatgccctccagtctggaaactcccaagaatcagttactgagcaggacagcaaagatagtacatactctctgtccagcaccctgacgctctcgaaggctgactatgagaaacataaggtgtacgcatgtgaagtcactcaccagggcttatcttcccccgtgaccaaatcattcaatagaggcgagtgc

SEQ ID NO: 23432 - RNA, 1314 nt, synthetic construct
  misc_feature 1..1314: note = derived and/or modified sequence opt3 from Lealesoab_HeavyChain1
  source 1..1314: mol_type = other RNA
caggtgcaactgcaggagagcggccccgaactcaagaaacctggggagaccgtcaagatctcctgcaaagcctctggatacacattcagaaactatggtaattgggttaagcaggctccaggcaaagggcttaagtggggatggattaacacttacacgggcgaaccgacctatgcagacgattttaagggtaggttcgccttttcactggagacaagtgcgagcactgcttacttgcagataaataacgtgaaaaatgaagacaccgccacatatttctgtgcacggaaggggtgggattttaacggatcctctttagactactggggccaaggcaccactgtaacagtgtcgtcagccaaaaccacgccccctagcgtctatccactggctcccgggagtgcagcccagactaattccgtgaccctaggatgcctcgttaagggttacttccctgagccagtgacagtcacttggaactctggcagcctgtcctcaggggtgcacacctttcccgctgtacttcagagtgatctgtacacattgtctagctccgttaccgtgccttcaagcccacgcccgagtgagacggtcacttgtaatgtggcccatcccgcgtcttccacaaaagtggacaagaagatcgtccctcgagattgcggatgtaaaccatgcatttgtaccgttcccgaagtgagctcggtattcatctttcctccaaagcccaaagacgtgctcactattacactgaccccgaaggtcacgtgcgtggttgtggatatctctaaagacgatcctgaggtccagttctcctggtttgtggacgatgtagaagttcacaccgcacaaacacagccccgtgaggagcagttcaactcaacttttagaagtgtgagcgaactgccaatacatcaggactggctcaatggcaaggagttcaaatgtagggtcaactccgccgctttccctgcccccatcgaaaagaccatttctaagacaaaaggtcggccaaaggcaccccaagtgtatactatccctccaccgaaagagcaggctaaggacaaagtcagcttaacctgcattacagactttttccccgaagatatcaccgtggagtggcagtggaatgggcaacctgccgagaactacaagaatactcagccaataaacacgaacggatcatattttgtttacagtaagctgaatgtgcagaaatccaactgggaagcgggcaatacattcacctgtagcgtacttcacgagggcttgcataaccaccacactgaaaagtctctgtcacatagtcccgggaaa

SEQ ID NO: 23433 - RNA, 654 nt, synthetic construct
  misc_feature 1..654: note = derived and/or modified sequence opt3 from Lealesoab_LightChain1
  source 1..654: mol_type = other RNA
gacatccagctgacccaaacacccctcagccttcctgtgtccctgggcgatcaggcctctatttcatgcagaagtagccagtccatagtccactctaacgggaatacttacttggagtggtatttacagaagccaggacaatcgccgaacctgctaatctacaaagtttcaaataggttcagcggtgtgcccgaccggtttagtggctccgggtctggaacggatttcaccctcaagattagccgcgtagaagctgaggacctgggcgtgtattactgttttcagggttcccatgtccctccaacattcgggggaggcactaaacttgaaatcaagcgagcagatgccgcgcccaccgtgtcaatttttcctccaagtagcgagcagctgacatctggcggggcttccgttgtgtgcttcttgaacaatttttatcccaaagacatcaacgtcaagtggaagatagatggatcagaacgtcagaatggtgtgctcaacagctggaccgaccaagatagtaaagactctacttactccagctcgacactgaccctgacgaaggatgagtatgagagacacaattcttacacttgtgaagccacccataaaacatccacttcacctatcgtaaagagtttcaacaggaatgagtgc

SEQ ID NO: 23434 - RNA, 1335 nt, synthetic construct
  misc_feature 1..1335: note = derived and/or modified sequence opt3 from Lebrikizumab_HeavyChain1
  source 1..1335: mol_type = other RNA
caggtgaccctgagagagagcggccccgccctcgtcaagcctacacaaactcttacgctgacctgcacagtttccgggttctctttgtcagcttacagtgtgaactggatcaggcagccaccgggaaaagcattagaatggctggccatgatttggggtgacggcaagatagtatataatagcgcgctaaaatcccggctcactatctctaaggatacctcgaaaaaccaggtggtcctgacaatgaccaatatggaccccgtggatactgctacatactattgtgccggggacggatactatccttacgcaatggataactggggccagggttcacttgttaccgtgagcagtgcctccacgaaggggccatctgtctttcccctggctccttgcagccgctccacttcagagagtaccgcagccttgggatgtctcgtgaaggactatttcccagaacccgtaacagttagctggaatagtggcgctctgacttccggcgtgcacacctttcctgccgtcctgcaatcaagcgggctctacagtttatcttccgtggtgacagtcccaagctcgtctctgggaaccaaaacgtacacttgcaacgttgatcataagccgtccaatacaaaagtggacaagcgagtagagtcaaaatatggtcccccttgtccaccctgccctgcgccagagttccttggcgggcccagtgtgtttttgttcccgcctaagcccaaggataccctgatgattagccgtactccagaggtcacatgtgtggttgtggacgtctcccaggaggatcctgaagtgcagtttaactggtacgtagacggagttgaggtgcacaatgcaaaaaccaagcccagagaagaacagttcaactctacgtatagggtcgtgagcgtcctaaccgtgctccatcaagattggctgaatggcaaagagtacaagtgcaaagtttcaaacaagggtcttccaagttccatcgagaaaacaattagcaaggccaaggggcagccccgggaacctcaggtgtatactctgccaccgtctcaggaagagatgaccaaaaatcaagtatcattgacatgtctcgtcaagggattttaccccagtgacatcgctgtggaatgggagagcaacggccagcctgagaataactataaaactaccccacccgttctggactccgatggctctttctttttatactcgcgcctgacagtggacaagagcagatggcaggaagggaacgtcttctcctgctcagtgatgcacgaggccctccataatcactacacccaaaaatctctttctctgagcttgggaaag

SEQ ID NO: 23435 - RNA, 654 nt, synthetic construct
  misc_feature 1..654: note = derived and/or modified sequence opt3 from Lebrikizumab_LightChain1
  source 1..654: mol_type = other RNA
gacatcgtgatgacccagagccccgattccctgtctgtctcactcggcgagagagccacaattaactgcagggctagtaagagcgttgactcctacggaaattctttcatgcactggtatcaacagaaacctgggcagccaccgaaacttctgatatacttggcatcgaacttagaatcaggtgtgcccgatcggtttagcggcagtgggtccggaactgacttcacgctgaccatctctagcctacaggccgaggatgtagcggtgtattactgtcaacagaataacgaagaccctcgcacatttggcggtgggactaaggtcgagattaagcgaaccgtggctgccccatccgttttcatctttcccccttcagatgaacagctcaaaagtggaacagcaagcgtggtctgcctgcttaataacttctatccacgtgaggccaaggtgcagtggaaggtagacaatgctctgcaatctggcaactcccaggagtcagttaccgaacaggatagcaaagacagtacttactctttgtccagcacactcaccctgtcgaaggcagattatgagaaacataaggtgtacgcctgtgaagtcacgcaccagggcctgtcttcccccgtgactaaatcatttaatagaggggagtgc

SEQ ID NO: 23436 - RNA, 1227 nt, synthetic construct
  misc_feature 1..1227: note = derived and/or modified sequence opt3 from Lenercept_chain1
  source 1..1227: mol_type = other RNA
ctggtgccccacctcggcgacagagagaagagggatagcgtctgccctcaggggaaatacatccatccacaaaacaattccatttgttgcaccaagtgtcacaaaggaacatatctttacaacgactgcccgggtcccggccaggatactgactgtcgggaatgcgagtctgggtcattcacggccagtgaaaatcatctgcgccactgtttgagctgctccaagtgtcgaaaagagatgggacaggttgaaatatcttcgtgcaccgtggatcgtgacacagtatgtggctgcagaaagaaccagtataggcattactggtcagagaatttatttcaatgcttcaactgtagcctgtgcctaaatggtactgtgcacctcagttgtcaggagaagcagaacaccgtctgcacatgtcacgctgggtttttcctgcgggaaaatgagtgcgtgtcctgttctaactgcaaaaagagccttgaatgtaccaaactgtgcttgcctcagatcgagaatgttaagggaactgaggattccggcacaaccgacaaaacgcatacttgtccaccctgccctgcaccagaactcctgggcgggccctcagtgtttctgttccctccaaagccgaaggataccctcatgattagtcgcacacccgaggtcacttgcgtggtagttgacgtgagccacgaagatcctgaggtcaaatttaactggtatgtggacggagtggaagtccataatgccaagaccaaaccaagagaggagcaatacaactctacatatagggttgtgtccgtattaaccgtgctgcaccaggattggcttaatggtaaggaatacaaatgtaaggtctcaaacaaagcgttgcccgctcctatcgagaagacgattagcaaggccaaaggccagccacgggaaccccaggtgtacactctgccgcctagtcgcgaggaaatgacaaagaaccaagtttctctaacctgcctcgtgaaagggttctatccctccgacatcgcagtcgagtgggagagcaatggacagccagaaaacaattacaagactacacctcccgtgctggactcggatggctcctttttcctttattctaaactgaccgtagacaagtcacgatggcagcaaggtaacgtttttagttgtagcgtgatgcacgaggccttgcataatcactacacgcagaagtccctctctctgagcccagggaaa

SEQ ID NO: 23437 - RNA, 1347 nt, synthetic construct
  misc_feature 1..1347: note = derived and/or modified sequence opt3 from Lenzilumab_HeavyChain1
  source 1..1347: mol_type = other RNA
caggtgcaactggtccagagcggcgccgaggttaagaaacccggggcttccgtgaaggtatcttgcaaagcatcaggatacagtttcaccaactattacatccactgggtgagacaggcccctggtcagaggctcgaatggatgggctggattaatgcggggaacggaaatacaaagtatagccaaaaatttcagggccgggtcactataacgcgcgacacctccgcttctacagcctacatggagctttcgtcactgcgaagcgaagatactgcagtgtattactgtgttcgtagacagaggttcccatattactttgactactggggtcaggggaccttggtgacagtcagttccgcctctaccaagggaccgagcgtgttccccttagctccttcctcaaagagtactagcggcggcacagcagccctggggtgcctagtaaaagattattttccagagcccgttaccgtgtcttggaactccggagctctcacgtcaggtgtccatactttccctgccgtgctgcaaagcagtggcctttactctctgtccagcgtggtcaccgttccatcgtcttccttggggacacagacttatatctgtaatgtgaaccacaagccctcaaataccaaagtagacaagcgggtggaacctaaaagttgcgataagacacatacctgtccaccgtgccccgcgcctgagctcctgggaggcccaagcgtctttctgtttccccctaagccaaaagacacgctcatgatttcccgcactcccgaggtgacatgtgttgtggtcgatgtgtctcacgaagacccggaggtaaagttcaactggtacgttgatggtgtggaagtccataatgcaaaaaccaagcctagagaggagcagtataacagcacttacagggtggtctcagtgttaacagttctgcaccaggactggcttaatgggaaagaatataagtgcaaagtgagtaacaaggccttgcccgctccaatcgagaagaccatttccaaagccaagggacaacctcgggaaccccaggtatacacgctgccacccagccgcgaggaaatgaccaaaaatcaggtctctctaacatgtctcgtgaagggcttctacccttcagatatcgcagttgagtgggagagtaacggccaaccagaaaataactataaaactaccccgcccgtgctggacagcgatgggtcctttttcctttactctaagctgacagtcgacaagtcgcgatggcagcagggaaacgtgtttagctgctccgtaatgcacgaggctttgcataatcactatactcagaaatcactcagtctgtctcctggtaag

SEQ ID NO: 23438 - RNA, 642 nt, synthetic construct
  misc_feature 1..642: note = derived and/or modified sequence opt3 from Lenzilumab_LightChain1
  source 1..642: mol_type = other RNA
gagatcgtgctgacccagagccccgccacactctccgtctctcctggcgaacgggctactctttcatgcagggcaagtcaaagcgttgggacgaacgtggcctggtaccagcagaagccaggacaggcgccgcgggtactgatttattccacctcttcgcgcgctacaggtataactgaccgattctcaggcagcgggagtggaaccgattttacattgaccatctcccgtttagagcccgaagacttcgccgtgtactattgtcaacagtttaataaatctcctctgactttcggcggtgggacaaaggtcgagattaaaagaaccgtggcagccccaagcgtttttatctttcccccttccgatgaacagctaaagtcaggaacggctagtgtggtctgcctcctgaacaatttctacccaagggaggcaaaagtgcagtggaaggtagacaacgcccttcaaagcggcaattctcaggagtccgttactgaacaggattcaaaggacagcacctatagtctgtcttccacattgactctcagcaaagctgattacgagaagcacaaagtgtatgcctgtgaagtcacccatcagggcctgtcgtctcccgtgacaaagtccttcaacagaggggagtgc

SEQ ID NO: 23439 - RNA, 1326 nt, synthetic construct
  misc_feature 1..1326: note = derived and/or modified sequence opt3 from Lerdelimumab_HeavyChain1
  source 1..1326: mol_type = other RNA
gaggtgcagctggtcgaaagcggcgggggagttgtgcaacccggtagatccctcaggctttcttgcgccgcttcaggcttcacctttagtagctacgggatgcactgggtacggcaggcacctggaaagggcctggagtgggtggccgtcatctggtatgacggttccaacaaatactatgcggattctgtgaaggggcgcttcacaatttcgcgagacaatagcaaaaacactttgtacttacagatggattcactgcgtgctgaagacacggccgtttattactgtggaagaaccctagagagttccctctggggccagggcacactggtgactgtctctagcgcatccaccaaggggccatcagtgtttccgcttgccccctgcagtaggagcacatctgaatccaccgctgcactgggatgtttggtaaaagattatttccctgagccagttactgtgtcatggaatagcggtgccctcacaagtggcgtccatacctttcccgctgtgctgcaatcttccgggctgtacagcctctcgtctgtggtcacggttccttcctcaagtttaggaactaagacctacacatgcaacgtggaccacaagccaagcaatactaaagtagataagcgggtggagtccaaatatggtcccccttgtccatcttgcccggcccccgagttcctgggcgggcctagcgtctttcttttcccacccaagcctaaagacaccttgatgatatcacgcacaccagaggtgacctgtgttgtggtcgatgtgagtcaggaagaccccgaggtacagtttaactggtacgttgatggagtggaggtccataatgcgaagacgaagccgagagaagaacagttcaactccacttatagggtggtcagcgtgctgacagttctacaccaagactggctcaatggcaaagaatacaagtgcaaagtgtctaacaagggcctgccttcaagtatcgagaaaaccattagcaaggcaaaagggcagccccgggaaccacaggtatatactcttcctccctcccaggaggagatgacaaagaatcaagtctctctgacctgtttggtgaagggattttacccatcggatatcgccgttgaatgggagagcaacggtcagcccgaaaataactataaaacgacccctccagtgctcgactccgacggctcattctttctgtacagtcgcttaacagtcgataagtctcgatggcaggaggggaatgtgttcagctgctccgtaatgcatgaagctctgcacaaccactacactcaaaaatcactcagcctttctctgggaaag

SEQ ID NO: 23440 - RNA, 645 nt, synthetic construct
  misc_feature 1..645: note = derived and/or modified sequence opt3 from Lerdelimumab_LightChain1
  source 1..645: mol_type = other RNA
agctccgagctgacccaggaccccgccgtgtctgtcgctctcggccaaacagttagaatcacttgccagggggattcacttaggagttactatgcaagctggtaccagcagaagcctggacaagccccagtgctggtaatttatggtaaaaacaatcggccgtccggcatacccgaccgcttctctgggtcgtcaagcggaaacacggcgagtttgaccatcacaggcgctcaggccgaagatgaggcagactactattgtaattcccgagattctagctccactcaccgtggtgtgtttgggggaggcaccaagttaacagtcctgggccagcctaaagccgctccatcagtgaccctatttccccctagtagcgaagaactccaggcaaacaaggccactctggtttgccttatttctgacttctacccaggggctgtgacagtcgcctggaaagcggattcctcacccgtgaaggcaggagtagaaaccacgactcctagcaagcaaagtaataacaaatatgccgcttcttcctacctgagcttgaccccagagcagtggaagtcgcatagatcttactcctgtcaggttacacacgagggttcaactgtggagaaaaccgtcgccccgacagagtgcagt

SEQ ID NO: 23441 - RNA, 1353 nt, synthetic construct
  misc_feature 1..1353: note = derived and/or modified sequence opt3 from Lexatumumab_HeavyChain1
  source 1..1353: mol_type = other RNA
gaggtgcagctggtccaaagcggcgggggagttgaaagacccggtggctccctcaggctttcttgcgccgcttcagggttcacctttgacgattacggaatgagttgggtgcggcaggcacctggcaagggtctggagtgggtaagcgggatcaactggaatggaggctccacaggctatgccgactctgtgaaagggcgcgtcactatttcgcgagataacgcgaaaaattcattgtacttacagatgaacagcctgcgtgctgaagacacggccgtgtattactgtgcaaagatactaggagccggtagaggctggtatttcgatctctgggggaagggaaccacagttactgtgagttccgcttctaccaaaggcccaagcgtctttccgctggcaccctcctcaaagagtacaagcggtgggaccgccgctcttggatgcctggtgaaggactacttccctgagccagtaactgtttcttggaactccggcgccttgacatcaggcgtgcacacctttcccgcggtcctccagagcagtgggctgtattctctgtccagcgtggtgacggtcccttcgtcttccctcggaactcaaacctacatctgtaatgttaatcataaaccatcaaacacaaaggtggataaaagggtagaacccaagagttgcgacaaaactcacacctgtcctccatgcccggcacccgagttactgggtggccctagcgtgttcctttttccacccaagcctaaggatacattgatgatttcccggaccccagaggtcacgtgtgtggttgtggacgtctctcatgaagatcccgaggtgaaattcaattggtacgtagacggggttgaagtgcacaacgccaagactaaaccgcgcgaggagcagtataatagcacatacagagtcgtgtcagtcctgaccgtgctacatcaggattggctcaacggaaaggaatataaatgcaaggttagtaataaagctctgcctgcccccatcgagaagactatttccaaggcaaaaggccagccaagggaacctcaagtgtacacacttcccccaagccgggaggaaatgaccaagaaccaggtatctctgacgtgtttggtcaaaggtttttatccctcagacatcgctgtggagtgggagagtaatgggcagcctgaaaacaactacaagaccacaccaccggttctcgacagcgatggctccttctttctgtattctaaattaactgtggacaagtcgcgctggcagcaaggaaatgtcttcagctgctccgtgatgcacgaggccctgcacaaccattacacccagaagtcactcagtctttctcccggcaaa

SEQ ID NO: 23442 - RNA, 1353 nt, synthetic construct; identical to SEQ ID NO: 23441
  misc_feature 1..1353: note = derived and/or modified sequence opt3 from Lexatumumab_HeavyChain
  source 1..1353: mol_type = other RNA

SEQ ID NO: 23443 - RNA, 642 nt, synthetic construct
  misc_feature 1..642: note = derived and/or modified sequence opt3 from Lexatumumab_LightChain1
  source 1..642: mol_type = other RNA
agctccgagctgacccaggaccccgccgtgtctgtcgctctcggccaaacagttagaatcacttgccagggggattcacttaggagttactatgcaagctggtaccagcagaagcctggacaagccccagtgctggtaatttatggtaaaaacaatcggccgtccggcatacccgaccgcttctctgggtcgtcaagcggaaacacggcgagtttgaccatcacaggcgctcaggccgaagatgaggcagactactattgtaattcccgagattctagcggtaaccacgtggtctttgggggaggcactaagttaaccgtgctgggccagcctaaagccgctccatccgttacactatttcccccttcaagtgaggaactccaggcaaataaggccaccctggtgtgccttattagcgacttctacccaggggctgtcactgtggcctggaaagcggattcttcccccgtaaaggcaggagttgaaacaaccacgccttcaaagcaaagcaacaataaatatgccgctagttcttacctgtccttgactccagagcagtggaaaagccatcgttcgtactcttgtcaggtgacccacgagggttccacagtcgaaaagactgtggccccgaccgagtgctca

SEQ ID NO: 23444 - RNA, 642 nt, synthetic construct; identical to SEQ ID NO: 23443
  misc_feature 1..642: note = derived and/or modified sequence opt3 from Lexatumumab_LightChain
  source 1..642: mol_type = other RNA

SEQ ID NO: 23445 - RNA, 1377 nt, synthetic construct
  misc_feature 1..1377: note = derived and/or modified sequence opt3 from Libivirumab_HeavyChain1
  source 1..1377: mol_type = other RNA
caggtgcaactggtcgagagcggcgggggagttgtgagacccggtaggtccctccggctttcttgcgccgcttcaggcttcgcatttagtgactacagcatcaactgggtacgccaggcccctgggaagggactggaatgggtggcgattatatcctatgatggccgaatcacctactatcgtgactctgtcaaaggtagattcacaatttcgagggatgactcaaagaatactttgtacttacagatgaacagcctgcggacggaggataccgctgtgtattactgtgcccgccagtattacgacttttggagtgggtcctctgttggaagaaattacgatggcatggacgtgtggggcctagggacaactgtcaccgtgagctccgcatcaacaaaaggaccaagtgtattcccgctcgcccccagctctaagtccacctcaggtggcactgctgcactggggtgccttgttaaagattattttcctgaaccagtgacagtcagctggaacagtggagccctgacctctggcgtgcacacgttccccgctgtgttgcaatccagcggtctctactcgctgtcttccgtcgttactgtgccttcaagtagcctggggacccagacatatatctgtaatgtaaaccataagccatccaatactaaggtggacaaaagggtcgagcccaagtcttgcgataaaacccacacatgtcctccatgcccggcccccgaactcttaggaggccctagcgtgtttctgttcccacccaagcctaaagacacccttatgatttcacggacgccagaggttacttgtgtggtcgtggatgtaagtcatgaggaccccgaagttaagtttaactggtacgtggacggcgtcgaggtgcacaatgcgaagacaaaaccgcgcgaggaacagtataactccacctaccgagtcgtgagcgttttgactgtgctgcatcaggattggctaaatgggaaggagtataaatgcaaggtatctaacaaagcactccctgcccccatcgaaaagacaatatcaaaagctaagggacaaccaagagagcctcaggtctacaccctgcccccaagtagggaagagatgacgaagaatcaggtgagccttacctgtctggttaaaggtttctacccctccgacatcgccgtggaatgggagtctaacggccagcctgagaataactataagacaactccaccggtcttggattcggacgggagctttttcctctactccaaactgaccgtggataagtcacggtggcaacagggaaacgtatttagttgctctgtgatgcacgaagcattacacaatcattatacacagaaaagcctgtccctctcacccggcaag

SEQ ID NO: 23446 - RNA, 657 nt, synthetic construct
  misc_feature 1..657: note = derived and/or modified sequence opt3 from Libivirumab_LightChain1
  source 1..657: mol_type = other RNA
gacatcgtgatgacccagagccccctgtccctctctgtcacacctggcgagccagcctcaattagttgcagaagctcccaatctcttctgcacaggtcggggaacaattacttggattggtatttacagaagccgggacattcaccccagctgctaatatacgttggtagcaaccgggctagtggcgtgcctgaccgcttctccgggtctggaagcggcactgaatatacgctcaaaatctcccgagtagaggcagaagatgtgggtgtctactattgtatgcaggccctgcaaaccccacgtacatttgggcagggaactaagctggagattaaaagaaccgtggcggctccctcagttttcatctttcctccaagtgacgaacagcttaagagcggcacagcctctgtggtctgcttgctcaataacttctaccccagggaggcaaaagtgcagtggaaggtagataatgccctgcaatccggcaactcacaggagagcgttaccgaacaggacagtaaggattctacttattccctgagctcgacactcaccttatctaaagctgactacgagaagcacaaagtgtacgcatgtgaagtcacgcatcaggggctgtcctcacctgtgactaagagttttaatcggggagagtgc

SEQ ID NO: 23447 - RNA, 1350 nt, synthetic construct
  misc_feature 1..1350: note = derived and/or modified sequence opt3 from Lifastuzumab_HeavyChain
  source 1..1350: mol_type = other RNA
gaggtgcagctggtcgaaagcggcgggggactcgttcaacccggtggctcccttagactgtcttgcgccgcttcagggttcagttttagcgacttcgcaatgtcctgggtgaggcaggcccctggaaagggcttggagtgggtagcgaccatcggtcgggtggcttttcacacatactatccagattctatgaaagggcgcttcactatttcgcgagacaactcaaagaatacgttatacctgcagatgaacagcctacgtgccgaagataccgcagtctattactgtgccagacataggggatttgacgtgggccacttcgatttttggggccaggggacactcgttactgtgagttccgcttctaccaaaggaccgagcgtcttccccctggcaccttcctcaaagagtacaagcggtggcaccgccgctcttgggtgcctggtgaaagactattttccagagcccgtaactgtttcttggaactccggagccttgacatcaggcgtgcataccttccctgcggtcctccaaagcagtggtctgtactctctgtccagcgtggtgacggtcccatcgtcttccctcgggactcagacctatatatgtaatgttaatcacaagccctcaaacacaaaggtggataaaaaggtagaacctaaaagttgcgacaagactcatacctgtccaccgtgccccgcacctgagttactgggaggcccaagcgtgtttctttttccccctaaaccaaaggatacattgatgatctcccggacccccgaggtcacgtgtgtggttgtggacgtctctcacgaagatccggaggtgaagttcaattggtacgtagacggcgttgaagtgcacaacgccaaaactaagcctcgcgaggagcagtacaatagcacatatagagtcgtgtcagtcctgaccgtgctacatcaggattggctcaacgggaaagaatacaagtgcaaagttagtaataaggctctgcccgccccaattgagaaaactatctccaaggcaaagggacaacctagggaaccccaggtgtatacacttccacccagccgggaggaaatgaccaaaaaccaggtatctctgacgtgtttggtcaagggtttctacccttcagacattgctgtggagtgggagagtaatggccagccagaaaacaattataaaaccacaccgcccgttctcgacagcgatgggtccttctttctgtactctaagttaactgtggacaaatcgcgctggcaacagggaaacgtcttcagctgctccgtgatgcacgaggccctgcataaccactatacccagaagtcactcagtctttctcctggcaag

SEQ ID NO: 23448 - RNA, 657 nt, synthetic construct
  misc_feature 1..657: note = derived and/or modified sequence opt3 from Lifastuzumab_LightChain
  source 1..657: mol_type = other RNA
gacatccagatgacccaaagcccctcctctctgtcagccagtgtgggcgatagggtcacaattacttgcaggagctccgagacgctcgttcactcttcggggaacacctaccttgaatggtatcagcagaagcctggaaaagctccaaagctgttgatataccgggtgtcaaatcgcttcagcggtgtaccgagtcgattttccggctctgggagcggaacagacttcactttaaccatctcctcactgcagcccgaggattttgcaacatattactgtttccaaggcagttttaaccctctaaccttcggtcaggggactaaagtggaaattaagcgtacagtcgccgcgccaagcgtgtttatctttcccccttctgacgagcagctcaaatccggaaccgcttcagttgtgtgcctgcttaataacttctatccaagagaagccaaggtccagtggaaggtggataatgcactgcaaagcggcaacagtcaggagtctgtaacggagcaggactccaaagatagcacttactcgttgtcttccaccctcacactgtcaaaggccgactatgaaaaacataaggtttacgcttgtgaggtgactcaccagggcctgagtagccccgtcaccaaatccttcaatagaggggaatgc

SEQ ID NO: 23449 - RNA, 1347 nt, synthetic construct
  misc_feature 1..1347: note = derived and/or modified sequence opt3 from Lifastuzumab_vedotin_HeavyChain1
  source 1..1347: mol_type = other RNA
gtgcagctggtcgagagcggcgggggactcgttcaacccggtggctcccttagactgtcttgcgccgcttcagggttcagttttagcgacttcgcaatgtcctgggtgaggcaggcccctggaaagggcttggaatgggtagcgaccatcggtcgggtggcttttcacacatactatccagattctatgaaagggcgcttcactatttcgcgagacaactcaaagaatacgttatacctgcagatgaacagcctacgtgccgaggataccgcagtctattactgtgccagacataggggatttgacgtgggccacttcgatttttggggccaggggacactcgttactgtgagttccgcttctaccaaaggaccgagcgtcttccccctggcaccttcctcaaagagtacaagcggtggcaccgccgctcttgggtgcctggtgaaagactattttccagaacccgtaactgtttcttggaactccggagccttgacatcaggcgtgcataccttccctgcggtcctccaaagcagtggtctgtactctctgtccagcgtggtgacggtcccatcgtcttccctcgggactcagacctatatatgtaatgttaatcacaagccctcaaacacaaaggtggataaaaaggtagagcctaaaagttgcgacaagactcatacctgtccaccgtgccccgcacctgaattactgggaggcccaagcgtgtttctttttccccctaaaccaaaggatacattgatgatctcccggacccccgaggtcacgtgtgtggttgtggacgtctctcacgaggatccggaagtgaagttcaattggtacgtagacggcgttgaggtgcacaacgccaaaactaagcctcgcgaagaacagtacaatagcacatatagagtcgtgtcagtcctgaccgtgctacatcaggattggctcaacgggaaagagtacaagtgcaaagttagtaataaggctctgcccgccccaattgagaaaactatctccaaggcaaagggacaacctagggagccccaggtgtatacacttccacccagccgggaagagatgaccaaaaaccaggtatctctgacgtgtttggtcaagggtttctacccttcagacattgctgtggaatgggagagtaatggccagccagagaacaattataaaaccacaccgcccgttctcgacagcgatgggtccttctttctgtactctaagttaactgtggacaaatcgcgctggcaacagggaaacgtcttcagctgctccgtgatgcacgaagccctgcataaccactatacccagaagtcactcagtctttctcctggcaag

SEQ ID NO: 23450 - RNA, 657 nt, synthetic construct; identical to SEQ ID NO: 23448
  misc_feature 1..657: note = derived and/or modified sequence opt3 from Lifastuzumab_vedotin_LightChain1
  source 1..657: mol_type = other RNA

SEQ ID NO: 23451 - RNA, 1359 nt, synthetic construct
  misc_feature 1..1359: note = derived and/or modified sequence opt3 from Ligelizumab_HeavyChain1
  source 1..1359: mol_type = other RNA
caggtgcaactggtccagagcggcgccgaggttatgaagcccgggtcctctgtgaaagtatcatgcaaggctagtggatacaccttcagctggtattggctcgaatgggtgagacaggcacctggtcacggccttgagtggatgggggaaatcgacccaggaacatttactacgaactacaatgagaaattcaaggccagggtcacctttacagcggatacttccacctctacagcttatatggaactgtcgtcattgcggagcgaggacaccgccgtgtactattgtgcacgcttcagtcatttttccggctctaactacgattatttcgactactggggtcaggggactttagttacagtgagctccgcctcaaccaaaggaccgagtgtctttcccctggctcctagctctaagtccacgtcaggcggcactgcagccctagggtgcctcgtgaaggattacttcccagagcccgtaaccgttagctggaatagtggagctctgacatctggtgtgcacacttttcctgccgtccttcaatccagcggcctgtattcgttgtcttccgtggtgaccgtcccatcaagtagcctcgggacacagacctacatttgtaacgttaatcataaaccctccaacacgaaggtggacaaaaaggtagaacctaaatcttgcgataagactcacacatgtccaccgtgccccgcgcctgagctgctgggaggcccaagcgtgttcctctttccccctaagccaaaagacaccttaatgatatcacgaactcccgaagtcacatgtgtggttgtggatgtcagtcatgaggacccggaggtgaagttcaattggtatgtagatggtgttgaagtgcacaacgcaaaaaccaagcctcgtgaggaacagtacaattccacgtatagagtcgtgagcgtcctgaccgtgcttcaccaggactggttgaacgggaaagagtacaagtgcaaagtttctaataaggccctgcccgctccaatcgaaaagacaatttcaaaagccaagggacaacctagggagccccaggtgtatactctaccacccagtcgggatgagctcaccaaaaaccaggtaagcctgacatgtcttgtcaagggcttttacccttccgacatcgcagtggaatgggagtctaatggccagccagaaaacaattacaaaactaccccgcccgttctggactcggatgggagcttcttcttgtattccaagctcacagtggacaagtcacgctggcaacagggaaacgtctttagttgctctgtgatgcatgaggctctgcacaaccattacacccagaaatccttaagcctgtcacctggtaag

SEQ ID NO: 23452 - RNA, 642 nt, synthetic construct
  misc_feature 1..642: note = derived and/or modified sequence opt3 from Ligelizumab_LightChain1
  source 1..642: mol_type = other RNA
gagatcgtgatgacccagagccccgccacactgtccgtctctcctggcgaaagagctactctctcatgcagggcaagtcaaagcattgggacgaacatacactggtaccagcagaaaccaggacaggccccgcggcttctgatctattacgcgtccgagtctatttcgggtatccccgctcgcttctcaggcagcgggagtggaaccgaatttacattgactatttcctctttacaaagcgaggacttcgccgtttattactgtcagcagtcctggtcatggcctaccacatttggcggtgggaccaaagtggaaatcaagcgaactgtagcagccccaagtgtgttcatatttccccctagcgatgagcagctgaaatctggaacagcttccgtcgtgtgcctactcaataacttctatccacgtgaggcaaaggttcaatggaaagtggacaatgccctgcagtcaggcaacagccaggaaagtgtcaccgagcaggattctaaggactccacgtacagcctttcgtctactctgaccttgtccaaggctgattatgaaaaacataaggtgtacgcctgtgaggtaacacaccaaggcctctcaagtcccgttactaagagctttaatagaggggagtgc

SEQ ID NO: 23453 - RNA, 1329 nt, synthetic construct; identical to SEQ ID NO: 23001
  misc_feature 1..1329: note = derived and/or modified sequence opt3 from Lilotomab_HeavyChain1
  source 1..1329: mol_type = other RNA

SEQ ID NO: 23454 - RNA, 642 nt, synthetic construct; identical to SEQ ID NO: 23002
  misc_feature 1..642: note = derived and/or modified sequence opt3 from Lilotomab_LightChain1
  source 1..642: mol_type = other RNA

SEQ ID NO: 23455 - RNA, 1338 nt, synthetic construct
  misc_feature 1..1338: note = derived and/or modified sequence opt3 from Lintuzumab_HeavyChain1
  source 1..1338: mol_type = other RNA
caggtgcaactggtccagagcggcgccgaggttaagaaacccgggtcctctgtgaaggtatcatgcaaagctagtggatacaccttcacagactataacatgcactgggtgagacaggcacctggtcagggcctcgaatggatcgggtacatttatccatacaatggaggcactggttataaccaaaagtttaaaagcaaggccacgataaccgcggatgagtccacaaatactgcttacatggaactttcttcgctgaggtcagaggacaccgccgtctattactgtgcacgggggcgcccggccatggattactggggacagggcacattggtgaccgttagcagtgcttccactaagggcccctctgtgttccctttagcaccaagctccaaatcaacaagtgggggaaccgccgctctgggttgcctagtcaaggactattttcccgaacctgtgacggtaagctggaactctggcgccctcacttccggggttcataccttcccagcggtgctgcagtcaagcggactttacagtctgtcttccgtcgtgacagtgcccagctcgtctttgggcactcagacctatatctgtaatgtcaaccacaaaccttccaatacaaaggttgataaaaaggtggagccaaagtcatgcgacaaaacccatacgtgtccgccctgccctgcaccagagctcctgggtgggcccagtgtatttctgttccctccaaagcccaaagatactctcatgattagccgaacaccggaagtgacctgtgtcgtggttgacgtgtcccacgaggatcctgaagtcaagtttaactggtacgtggacggagtagaggttcataatgccaaaactaagccccgtgaggaacaatataactctacatacagagtggtcagcgtgttaaccgtcctgcaccaggattggcttaatggcaaagagtataagtgcaaggtgtcaaacaaagccttgccagctcctatcgaaaagacgattagtaaagcaaagggccagcccagggagccacaggtttacaccctgcccccttcccgggacgaactaactaaaaatcaagtgagcctcacatgtctggtaaaggggttctacccatctgatatcgctgtcgagtgggagtcaaacggacagccggaaaataactataagaccacaccccctgtgcttgacagtgacggtagctttttcctgtactccaaattgactgttgataagtctcgctggcagcaaggcaacgtgttttcgtgcagcgtcatgcacgaggccctccataatcactatacccagaaatccctgtcattaagtccagggaag

SEQ ID NO: 23456 - RNA, 654 nt, synthetic construct
  misc_feature 1..654: note = derived and/or modified sequence opt3 from Lintuzumab_LightChain1
  source 1..654: mol_type = other RNA
gacatccagatgacccaaagcccctcctctctgtcagccagtgtgggcgatagagtcacaattacttgcagggctagcgagtccgttgacaactacgggatatctttcatgaattggtttcagcagaagcctggaaaagcaccaaagctccttatctatgccgcgtcgaaccagggttcaggcgtgccgagccggttcagtgggtccggatctggcacggattttaccctgacaattagctccttgcaacccgacgatttcgctacttactattgtcagcagtcaaaagaagtaccttggacctttggtcaggggacaaaggtggagatcaaacgcaccgtcgccgcaccaagtgtgttcatttttccccctagcgacgaacaattaaagtctggaactgcctccgttgtgtgcctgctaaataacttctacccacgagaggctaaggtccagtggaaagtggataatgcactccagtcaggcaacagccaggaaagtgtaacagagcaagactctaaggattccacctatagcctgtcgtctacgcttactctgtccaaagccgactacgagaagcacaaagtttatgcttgtgaagtgacccatcagggcttgtcaagtcccgtcacaaagagctttaatcgtggggagtgc

SEQ ID NO: 23457 - RNA, 1350 nt, synthetic construct
  misc_feature 1..1350: note = derived and/or modified sequence opt3 from Lirilumab_HeavyChain1
  source 1..1350: mol_type = other RNA
caggtgcaactggtccagagcggcgccgaggttaagaaacccgggtcctctgtgaaggtatcatgcaaagctagtggaggtaccttcagcttttacgcaatctcctgggtgagacaggcccctggccaggggctcgaatggatgggaggcttcattccaatatttggtgcggctaactatgcccaaaagttccaggggagggtcacaatcactgcagacgagtctacgtcgaccgcctacatggaactttcaagcctgcggagtgatgacacagctgtgtattactgtgcacgcattccgtccggatcttattactatgattacgacatggatgtttggggccagggcactaccgtgacagtcagctccgcctcaaccaaagggcccagtgtgtttcctttggctccatgcagccgatctacttccgagtcaacagccgcgttaggatgtctggtaaaggactacttccccgaacctgttaccgtgagctggaatagtggtgcactaacgtctggcgtccacacttttccagccgtgctccagtccagcgggctgtattcgctttcttccgtggtcaccgttccctcaagtagcctgggaacaaagacttatacctgcaacgtggatcataaaccttccaatacaaaggtagacaaacgtgtggagtctaagtacggcccaccgtgtcccccttgcccagctcccgagttcttgggtgggcctagcgtctttctcttcccacccaaaccgaaggataccctgatgatctcaagaacgcctgaagtgacttgtgttgtggtcgacgtgagtcaagaggatcccgaagtacagtttaactggtacgttgacggagtggaggtccacaatgccaagacaaaaccaagggaggaacagttcaactccacctatcgggtggtcagcgtgctgactgttctccatcaggattggttaaatggcaaggagtacaaatgcaaggtgtctaacaaaggcctgccttcaagtattgaaaagacaatcagcaaagcaaaggggcaaccccgcgagccacaggtatatacccttcccccttcccaggaagagatgacgaagaatcaagtctctttgacctgtctggtgaaaggattttacccatcggacatagctgttgagtgggaaagcaacggtcagccggagaataactacaagacaactccccctgtgctagactccgatggctcattcttcctctatagtagactgaccgtcgacaaatctaggtggcaggaagggaatgtgtttagctgctccgtaatgcacgaggcccttcataaccactacacacagaagtcactgagcttgtctctcggaaaa

SEQ ID NO: 23458 - RNA, 642 nt, synthetic construct
  misc_feature 1..642: note = derived and/or modified sequence opt3 from Lirilumab_LightChain1
  source 1..642: mol_type = other RNA
gagatcgtgctgacccagagccccgtcacactctccctttctcctggcgaaagagccactctgtcatgcagggctagtcaaagcgtttcctcttacttggcatggtatcagcagaagccagggcaggccccgcggttactgatttacgacgcgtcgaaccgcgctacgggaatacccgcccgattctcaggtagcggcagtgggaccgattttacactaactatctcctctctcgagcctgaagacttcgcagtgtattactgtcaacagcgtagcaattggatgtatacctttggacagggcacaaaactggagattaagagaaccgtagccgctccatccgtgttcatctttcccccttcagatgaacagcttaaaagtggtactgcaagcgtcgtgtgcctgttgaacaatttctacccaagggaggccaaggttcaatggaaagtggacaacgctctccagtctggaaattcccaggagtcagtcacagaacaggatagcaaggacagtacctattctctgtccagcacgctgactctctcgaaggccgattacgagaaacacaaggtgtacgcgtgtgaagtaacccatcaagggttatcttcccccgttacaaaatcatttaaccggggcgagtgc

SEQ ID NO: 23459 - RNA, 1344 nt, synthetic construct
  misc_feature 1..1344: note = derived and/or modified sequence opt3 from Lodelcizumab_HeavyChain1
  source 1..1344: mol_type = other RNA
caggtgcaactggtccagagcggcgccgaggttaagaaacccggggcttccgtgaaggtatcttgcaaagcatcaggatacaccttcagtacaatgtatatgagctgggtgagacaggcccctggtcagggcctcgaatggatggggaggatcgacccagcgaacgagcacactaattacgctcaaaagtttcagggacgggtcacgatgacccgcgatacatccatttctactgcctatatggaactttcgcgactgacctcagacgatacagcagtgtactattgtgcccgtagctactattactacaacatggactattggggccagggtaccttggttactgtgagttccgcttctacaaaagggccgagcgtcttccccttagcaccttcctcaaagagtaccagcggaggcacggccgctctgggctgcctagtgaaggattactttccagagcccgtaactgtttcttggaactccggggccctcacctcaggagtgcatacattccctgcggtcctgcagagcagtggtctttattctctgtccagcgtggtgactgtcccatcgtcttccttgggcacccaaacatacatatgtaatgttaatcacaaaccctcaaacaccaaggtggacaaaagagtagaacctaagagttgcgataaaacgcatacttgtccaccgtgccccgcacctgaggccgctgggggaccaagcgtgtttctctttccccctaagccaaaggacacactgatgatctccaggacccccgaggtcacttgtgtggttgtggatgtctctcacgaagacccggaggtgaaattcaattggtatgtagatggcgttgaagtgcataacgccaagacaaaacctcgggaggagcagtacaatagcacctatcgcgtcgtgtcagtcctgacggtgctccaccaggactggttaaacggtaaggaatacaaatgcaaggttagtaataaagcactgcccgctccaattgagaagaccatctccaaggccaaagggcagcctagagaaccccaagtgtacacacttccacccagcagggaggaaatgactaagaaccaggtatctttgacctgtctggtcaaaggattctatccttcagatattgcggtggagtgggagagtaatggccagccagaaaacaattacaagacaactccgcccgttctagacagcgacggctcctttttcctctattctaaactgaccgtggataagtcgcggtggcaacaggggaacgtctttagctgctccgtgatgcacgaggcccttcataaccactacacacagaagtcactgagtttgtctcctggaaaa

SEQ ID NO: 23460 - RNA, 639 nt, synthetic construct
  misc_feature 1..639: note = derived and/or modified sequence opt3 from Lodelcizumab_LightChain1
  source 1..639: mol_type = other RNA
cagatcgtgctgacccaaagccccgccacactctccgtctctcctggcgagagagctactctttcatgcagggcaagtcagagcgtttcctacatgcactggtatcagcagaagccagggcaagccccgcggctgttgatttacggagtgttccgccgagcgacgggtatacccgaccgtttttctggctcggggtcaggaaccgatttcacattaactatcggcagactggaacctgaggactttgctgtatattactgtctacagtggagcagtgatccacccaccttcggtcaggggacaaaactcgaaattaagaggaccgtggccgcaccttccgtctttatcttcccaccctctgacgagcagctgaaaagcggaactgcctccgtggtttgccttctgaacaatttttatcctcgggaagctaaggtgcaatggaaagtcgataacgcattgcagtcaggcaatagtcaggagagcgtgacagagcaggactctaaggattccacctactcactcagcagtacgctgactctgtctaaggccgactatgaaaaacataaggtatacgcttgtgaggttacccaccaaggcctctccagcccagtgacaaaatcgttcaaccgcggggaatgc

SEQ ID NO: 23461 - RNA, 1356 nt, synthetic construct
  misc_feature 1..1356: note = derived and/or modified sequence opt3 from Lokivetmab_HeavyChain1
  source 1..1356: mol_type = other RNA
gaggtgcagctggtcgaaagcggcggggacctcgttaagcccggaggttcccttagactgtcttgcgtggcctcaggcttcacctttagtaactacgggatgagctgggtaaggcaagctcctggaaaaggcttgcagtgggtggcaacaatctcctatggtgggtcttacacttattacccagataatattaagggacggttcacgatatcgcgcgacaacgccaaaaataccttatatctgcagatgaactcactacgagcggaggatacagctatgtactattgtgtccgtggctacggctacgacactatggattattgggggcagggaaccctcgtgacagttagcagtgcctccaccactgcaccgtctgtgtttcccctggcccctagctgcggttccacatcaggcagtaccgtcgctcttgcatgtctggtgagcgggtacttcccagaacccgtaacggtttcttggaactccggatcattgactagcggcgtgcacacctttcctagtgtcctccaatcttccggtctgtatagcctgtcgtctatggtgacagtgccatcctcaagatggcccagtgagacttttacctgcaatgtcgcccatcctgctagcaagacaaaagttgacaagccagtgccgaagagggaaaatgggcgggtaccccgccctccagattgtcccaaatgccctgccccagagatgctcggaggcccctccgtgttcatcttcccgcctaagcccaaagacaccttactgattgcgagaacgccagaggtcacttgtgtggttgtggatcttgaccctgaagatcccgaggtccagatctcttggtttgtggacggcaagcagatgcagacagcaaaaacccaaccaagggaagaacagttcaacgggacttaccgggtagttagcgtgttgcccattggacaccaggattggctgaagggtaagcagtttacatgcaaagtcaataacaaggccctaccttcaccaatcgagcgcaccataagtaaagctcgaggccaagcccatcagccgtccgtgtatgtcctgccccctagcagagaggagctctctaagaatacggtgtcacttacctgtctgatcaaagacttctttccacccgacattgatgttgaatggcagagtaacgggcaacaggagcctgaaagcaagtacaggacaactccaccccagttggacgaggatggatcctatttcctctactctaaactgtcggtggacaagagccggtggcagcgtggcgataccttcatctgcgcagtaatgcacgaggctttacataatcactacacacaagaatccctgtcacacagtccgggt

SEQ ID NO: 23462 - RNA, 651 nt, synthetic construct
  misc_feature 1..651: note = derived and/or modified sequence opt3 from Lokivetmab_LightChain1
  source 1..651: mol_type = other RNA
gagatcgtgatgacccagagccccgcctccctgtctctctcacaagaagagaaggtcacaattacttgcaaagctagtcagagcgtttccttcgcaggcacggggcttatgcactggtaccagcagaagcctggacaagccccaaaactgttgatatatagagcgtctaacttagaagctggtgtgccgtcgaggttttcaggcagcgggagtggaaccgacttctcctttacaatctctagcctggagcccgaagatgtagccgtgtactattgtcagcagtcccgggagtacccttggactttcggccagggtaccaagctagagattaaacgcaatgacgcacaaccagccgtctatctctttcagccctcacctgatcagctgcatacagggagtgctagcgtggtttgccttctgaactctttctacccaaaggacatcaatgtgaagtggaaagtcgatggagtgattcaggacaccggcatccaagaatccgtaactgagcaggataaggactcaacatatagcttgagttctaccctcacgatgtccagcactgaatacctgtcgcacgagctgtactcttgtgagataacccataaatccctcccctcaacattaatcaagagttttcagcgaagcgaatgc

SEQ ID NO: 23463 - RNA, 1344 nt, synthetic construct
  misc_feature 1..1344: note = derived and/or modified sequence opt3 from Lorvotuzumab_mertansine_HeavyChain1
  source 1..1344: mol_type = other RNA
caggtgcaactggtcgagagcggcgggggagttgtgcagcccggtagatccctcaggctttcttgcgccgcttcaggcttcacctttagtagcttcgggatgcactgggtacggcaggcacctggaaagggcctggaatgggtggcctacatctcctctggttcgtttacaatttattacgcggactcagtcaaagggcgcttcactataagccgagataacagtaagaatacgttgtatttacagatgaactccctgcgtgctgaggacaccgccgtgtactattgtgcaagaatgaggaaaggatacgccatggattattggggccaaggcactctagttacagtgtctagcgcttccaccaaggggccatcagtctttccgctcgcacccagtagcaaatctacatccggaggtaccgccgctctgggctgccttgtgaaggactacttccctgaaccagtaactgtttcatggaatagcggggccctgacaagtggagtgcatacctttcccgcggtcttgcagtcttccggcctctacagcctgtcgtctgtggtgacggtcccttcctcaagtctgggtactcagacctatatctgtaacgttaatcacaagccaagcaacacaaaagtggataagaaagtagagcccaagtcctgcgacaaaactcatacctgtcctccatgcccggcacccgaactcttagggggaccttctgtgttcctgtttccacccaagcctaaggatacacttatgattagccggaccccagaggtcacgtgtgtggttgtggacgtctcacacgaggatcccgaagtgaaattcaattggtacgtagacggcgttgaggtgcataacgccaagactaaaccgcgcgaggaacagtataatagtacatacagagtcgtgtccgtcttgaccgtgctgcaccaagattggctaaacggcaaggagtataaatgcaaggttagcaataaagctctccctgcccccatcgaaaagactatttctaaggcaaaagggcagccaagggagcctcaggtgtacacactgcccccatcacgggacgaacttaccaagaaccaggtaagtctgacgtgtttggtcaaaggattttatcccagcgatatcgctgtggagtgggaatccaatggtcaacctgagaacaattacaagaccacaccaccggttctcgactctgacggctcgttctttctgtacagcaaattaactgtggataagtcccgctggcagcaggggaacgtcttctcatgcagtgtgatgcacgaggccctgcataaccactatacccaaaagtctctcagcctttcccccggaaaa

SEQ ID NO: 23464 - RNA, 657 nt, synthetic construct
  misc_feature 1..657: note = derived and/or modified sequence opt3 from Lorvotuzumab_mertansine_LightChain1
  source 1..657: mol_type = other RNA
gacgtggtcatgacccagagccccctgtccctccctgttacacttggccaaccagcctctatctcatgcagaagtagccagattataatccactccgatgggaacacttacctggagtggttccagcagaggccgggacaatctccccggcgcttgatttataaggtgtcgaatcgattttcaggtgtacctgaccgtttcagcggcagtgggtccggaacggattttaccttaaaaatctctagagtggaagctgaggacgtcggcgtgtactattgtttccagggtagccatgttccacacacatttgggcagggaactaaggtggaaattaaaaggaccgtcgcagccccctccgtgttcatctttcctccatcagatgagcagctgaagagtggcacagcgagcgtagtttgcctactcaacaatttctacccccgggaagctaaagtgcaatggaaggtcgacaacgccctgcagtctggcaattcccaggagtcagtgaccgagcaggatagcaaggacagtacttattctctttccagcacactgaccttgtcgaaagcagattacgaaaagcataaagtgtatgcctgtgaggtcacgcaccaagggctctcttcccctgttactaagtcatttaaccgcggagaatgc

SEQ ID NO: 23465 - RNA, 336 nt, synthetic construct
  misc_feature 1..336: note = derived and/or modified sequence opt3 from Lpathomab_VL
  source 1..336: mol_type = other RNA
gacgtggtcatgacccagacacccctgagcctccctgtttcccttggcgatcaagcctctatctcatgcacgagtgggcagagcctggtgcacattaacggaaatacttacttgcattggtatttacagaagccaggtcagtccccgaaactgctaatatacaaggtatctaacctcttctcgggcgtgcccgacagattttcagggagcggaagtggcaccgatttcacactgaaaatctccagggtcgaggctgaagaccttggtgtgtatttttgttctcaaagcactcacttcccttttaccttcgggacaggaaccaagctggagattaaa

SEQ ID NO: 23466 - RNA, 366 nt, synthetic construct
  misc_feature 1..366: note = derived and/or modified sequence opt3 from Lpathomab_gamma1-Chain_VDJ-Region
  source 1..366: mol_type = other RNA
caggtgcaactgcagcagagcggcgccgagctcgtcagacccgggacctccgttaaggtgtcttgcaaggcttcaggatacggtttcatcaactatcttattgaatggataaaacagaggcctggccaagggctggagtggatcggattgattaatccaggcagtgactacacaaactataatgaaaactttaaaggtaaggcaactttaacggccgataaaagctcctctaccgcgtacatgcacctgtcgtcactaacaagcgaggacagtgctgtatatttctgtgcccggcgctttgggtactatggatccggcaattacttcgattactggggccaggggactaccctcacagtgtctagc

SEQ ID NO: 23467 - RNA, 1350 nt, synthetic construct
  misc_feature 1..1350: note = derived and/or modified sequence opt3 from Lucatumumab_HeavyChain1
  source 1..1350: mol_type = other RNA
caggtgcaactggtcgagagcggcgggggagttgtgcagcccggtagatccctcaggctttcttgcgccgcttcaggcttcacctttagtagctacgggatgcactgggtacggcaggcacctggaaagggcctggaatgggtggccgtcatctcctatgaggaatctaaccgctaccatgcggactcggtgaaaggtcgattcacaatttcacgtgataatagcaagataactttgtatttacagatgaacagtctgagaacggaggacaccgctgtttactattgtgccagggatgggggaatcgcagccccaggcccggactactggggccaagggactctagtgacagtctcctctgctagcaccaaaggaccctccgtgtttcctctcgcaccagcctcaaagagtacaagcggtggcaccgctgccctggggtgccttgtaaaagattatttccccgaacctgttactgtgtcttggaactccggagcgctgacatcaggcgtccacacctttccagcagtgttgcagagcagtggtctctactctctgtccagcgtggtcacggttccctcgtcttccctggggactcagacctacatttgtaatgtgaatcataagccttcaaacacaaaggtagacaaacgggtggagccaaagagttgcgataaaactcacacctgtccgccctgccctgccccagagctcttaggaggccccagcgtcttcctgtttcctccaaagcccaaagacacacttatgatctcccgcaccccggaagtgacgtgtgttgtggtcgatgtgtctcatgaggaccctgaagtaaagttcaattggtatgttgatggcgtggaggtccacaacgctaagactaaacccagagaggaacagtacaatagcacatatagggtggtctcagtgttgaccgttctgcaccaagactggctaaacgggaaggagtacaaatgcaaggtgagtaataaagccctcccagcacctattgaaaagactatctccaaagctaagggacagccccgggagccacaggtatatacactgccccctagccgcgaagagatgaccaagaaccaggtctctcttacgtgtctggtgaaaggtttttacccatcagatatagccgttgagtgggaaagtaatggccaaccggagaacaattataagaccacaccccctgtgttggacagcgacgggtccttctttctctactctaaactgactgtcgataagtcgcgatggcagcagggaaacgtgttcagctgctccgtaatgcatgaagcgttacacaaccattacacccaaaaatcactgagtctctctccaggcaag

SEQ ID NO: 23468 - RNA, 657 nt, synthetic construct
  misc_feature 1..657: note = derived and/or modified sequence opt3 from Lucatumumab_LightChain1
  source 1..657: mol_type = other RNA
gacatcgtgatgacccagagccccctgtccctcacagtcactcctggcgagccagcctctatttcatgcagaagtagccaatcccttctgtactctaacgggtataattacttggattggtatttacagaagccgggacagtcgccccaggttctgatatcactaggtagcaacagggctagtggcgtgcctgaccggttctccgggtctggaagcggcacggattttaccctcaaaatctcccgcgtagaagcagaggacgtgggtgtctactattgtatgcaagcccgacagacaccattcacttttgggcccggaaccaaggtggatattcgtagaacagttgcggctccttcagtgttcatctttccacccagtgacgaacagctgaaaagcggcaccgcctctgtcgtgtgccttctgaataacttctaccctagggaggcaaaggtacagtggaaagttgataatgccttgcaatccggcaactcacaggaaagcgtgactgagcaggacagtaaggattctacatattccctcagctcgaccctgacgctgtctaaggctgactacgagaaacacaaggtctacgcatgtgaagtgactcatcaggggctctcctcaccagtgaccaaaagttttaatcggggagagtgc

SEQ ID NO: 23469 - RNA, 324 nt, synthetic construct
  misc_feature 1..324: note = derived and/or modified sequence opt3 from Lulizumab_pegol_LightChain1
  source 1..324: mol_type = other RNA
gacatccagatgacccaaagcccctcctctctgtcagccagtgtgggcgatagagtcacaattacttgcagggctagccggcctatatggccattcctcgagtggtaccagcagaagccggggaaagcacccaaacttctgatctattttacgtcccgcttgcgacacggagttccttctcgtttctcgggttcaggcagcgggacctgttttacattaactattagttccctgcagccagaagacttcgccacctactattgcctacaaaacgtggcgaatcccgctacattttctcagggaaccaaggtagagatcaagaga

SEQ ID NO: 23470 - RNA, 324 nt, synthetic construct; identical to SEQ ID NO: 23469
  misc_feature 1..324: note = derived and/or modified sequence opt3 from Lulizumab_pegol_LightChain
  source 1..324: mol_type = other RNA

SEQ ID NO: 23471 - RNA, 1194 nt, synthetic construct
  misc_feature 1..1194: note = derived and/or modified sequence opt3 from Lumiliximab_HeavyChain1
  source 1..1194: mol_type = other RNA
gaggtgcagctggtcgaaagcggcgggggactcgccaagcccggtggctcccttagactgtcttgcgctgcatcagggttcaggtttaccttcaacaattactatatggactgggttcggcaagcccctggacagggcttggagtgggtgttaacaactggtagtgatagctgggggcagggagtactggtgacggtctcctctgcgtcgaccaaaggcccatcagtgtttccgctagctcccagcagtaagtccacatctggcgggactgccgcactcggatgtctggttaaagactacttccctgaaccagtgaccgtcagctggaactccggtgcccttacatcaggcgtgcacacctttcccgctgtactgcagagtagcgggttgtattctctctcctcagttgtgactgtccctagcagttctctgggaacacaaacctacatctgcaatgtgaaccataagccatccaatacgaaagtggataagaaggtcgagcccaaaagctgtgacaagactcatacctgccctccatgtccggcacccgaactgctcggcggtccttcggttttcttatttccacccaaacctaaggatacactgatgatttctcgcactccagaggtgacctgcgtagtggtcgacgtgtcccacgaggatcccgaagttaaattcaactggtatgtggacggggtcgaggtgcacaatgccaagacaaagccgcgagaagaacagtacaactcaacctatcgtgtagttagtgtgcttacggtcttgcatcaggattggctgaatggaaaagagtacaagtgtaaagtgagcaacaaggctctacctgcccccatagagaaaactatctccaaggcgaaaggccagccaagagagcctcaagtctacacactgcccccatctagggacgaactcaccaagaatcaggtgagccttacttgcctggttaagggcttttatccctcagatattgcagtggagtgggaaagtaacgggcagcctgagaataactacaaaacaaccccaccggtattggactccgatggtagcttctttctctattctaagctgacggtcgacaaatcacggtggcagcaaggaaatgtgttcagttgtagcgttatgcacgaggccttacacaaccattacacccagaagtccctgtctctctcgcccggcaaa

SEQ ID NO: 23472 - RNA, 642 nt, synthetic construct
  misc_feature 1..642: note = derived and/or modified sequence opt3 from Lumiliximab_LightChain1
  source 1..642: mol_type = other RNA
gacatccagatgacccaaagcccctcctctctgtcagccagtgtgggcgatagagtcacaattacttgcagggctagccaggacatacggtactatctcaactggtaccagcagaagcctgggaaagcaccaaaacttctgatctatgttgcctcctctttgcaatcgggagtgccgtcacgcttcagcggtagtggctccgggacggagtttaccttaacagtatctagcctgcagcccgaagatttcgcgacttactattgtctacaggtgtactccacccctcgaacatttggacagggcaccaaggtcgagattaagcgtactgtggctgccccatcagttttcatctttccccctagtgacgaacaactcaaaagcggtacagcatctgtggtctgcctgcttaataacttctatccaagagaggccaaggtgcagtggaaggtagataatgctctgcagtccgggaactcacaggaaagcgttaccgagcaagacagtaaagattctacgtactccttgagctcgactctcaccctgtctaaggcagactacgagaaacacaaggtgtatgcctgtgaagtcacacatcagggactgtcctcacccgtgactaaaagttttaataggggcgagtgc

SEQ ID NO: 23473 - RNA, 1347 nt, synthetic construct
  misc_feature 1..1347: note = derived and/or modified sequence opt3 from Lumretuzumab_HeavyChain1
  source 1..1347: mol_type = other RNA
caggtgcaactggtccagagcggcgccgaggttaagaaacccggggcttccgtgaaggtatcttgcaaagcatcaggatacaccttcagaagtagctatatctcctgggtgaggcaggcccctggtcagggcctcgaatggatggggtggatttacgcgggaacaggctctccatcgtataaccaaaaacttcagggtcgggtcactatgacgaccgacacatcaactagcaccgcttacatggagctgcgcagtttgcgatccgatgacacagccgtgtattactgtgcacgtcacagagattattactctaatagcttaacctactgggggcagggaactctggttacagtgtcctcagccagtaccaagggcccgagcgtctttcccctagctccttcttccaagtcaacgagcggcgggactgcagccctcggatgcctggtgaaggactatttcccagaacccgtaaccgttagttggaactctggtgctcttacatccggcgtgcatacttttcctgccgtcctgcagagctcggggttgtactctctctcctcagtggtgaccgtcccaagtagctccctgggaacacaaacctatatatgtaatgttaaccacaaaccctctaatacgaaggtggataaaaaggtagagcctaaaagctgcgacaagactcatacatgtccaccgtgccccgcgcctgaactgctcggcggtccatcagtgttcttatttccccctaagccaaaagataccctgatgatcagtaggactcccgaggtcacatgtgtggttgtggacgtctcccacgaggatccggaagtgaagttcaactggtacgtagacggggttgaggtgcataatgcaaaaaccaagcctcgggaggaacagtataacagcacgtaccgcgtcgtgtctgtccttaccgtgttgcaccaggattggctgaatggaaaagagtataagtgcaaagtttcaaacaaggccctacccgctccaattgaaaagacaatcagtaaagccaagggccagcctagagagccccaagtgtacactctcccacccagcagggacgaactgaccaaaaatcaggtatcccttacatgtctggtcaagggcttttacccttctgatattgcagtggagtgggaatcgaacgggcagccagagaataactataaaactaccccgcccgttttggacagcgacggatccttctttctctactcaaagctgacagtggataagagtcggtggcaacagggtaatgtcttctcttgcagcgtgatgcacgaggctttacataaccactatacccagaaatccctgtcactcagccctggc

SEQ ID NO: 23474 - RNA, 660 nt, synthetic construct
  misc_feature 1..660: note = derived and/or modified sequence opt3 from Lumretuzumab_LightChain1
  source 1..660: mol_type = other RNA
gacatcgtgatgacccagagccccgattccctggccgtctctctcggcgagagagctacaattaactgcaagtcaagtcaaagcgttcttaattccgggaaccagaaaaattacctgacttggtatcagcagaagcctggacaaccaccgaaattgttaatatactgggcatctacgagggaatcgggtgtgcccgaccggttctcaggcagcgggagtggaaccgattttacactgactatctcctctctacaggccgaggacgtagcggtgtattactgtcagagcgattattcctacccttataccttcggccagggtacaaagctcgaaattaaacgcaccgtcgctgccccatcagtgtttatctttccccctagtgacgagcaacttaagagcgggactgcatctgttgtgtgcctgctgaacaatttctacccacgagaagccaaggtccagtggaaagtggataacgctttgcagtccggaaattcacaggagagcgtaacagagcaagacagtaaggattctacctactccctcagctcgacgctgactctgtctaaagcagactatgaaaagcacaaagtttacgcctgtgaggtgacccatcagggcctctcctcacccgtcacaaagagtttcaaccgtggcgaatgc

SEQ ID NO: 23475 - RNA, 1329 nt, synthetic construct; identical to SEQ ID NO: 23001
  misc_feature 1..1329: note = derived and/or modified sequence opt3 from Lutetium_(177Lu)_lilotomab_satetraxetan_HeavyChain1
  source 1..1329: mol_type = other RNA

SEQ ID NO: 23476 - RNA, 642 nt, synthetic construct; identical to SEQ ID NO: 23002
  misc_feature 1..642: note = derived and/or modified sequence opt3 from Lutetium_(177Lu)_lilotomab_satetraxetan_LightChain1
  source 1..642: mol_type = other RNA

SEQ ID NO: 23477 - RNA, 1350 nt, synthetic construct
  misc_feature 1..1350: note = derived and/or modified sequence opt3 from Margetuximab_HeavyChain1
  source 1..1350: mol_type = other RNA
caggtgcaactgcagcagagcggccccgagctcgtcaagcctggggcctcccttaaactgtcttgcaccgcttcaggattcaacatcaaggacacatacattcactgggttaaacagagaccagaacaaggtttggagtggataggcaggatctatccgactaatgggtacacgcggtatgatcccaagtttcaggacaaagcaaccattacagccgatacttcgagcaacaccgcgtacttacaggtgtcccgcctgacatctgaagacaccgctgtatattactgttcgcgatggggaggcgatggtttctatgccatggactactgggggcagggagcatcagtgactgtcagcagtgcctccacaaagggcccttctgtgtttccactagctcccagctccaagtcaaccagtggcgggacggcagccctcggatgcctggttaaagattacttccctgagccagtgactgtcagctggaactctggtgctcttacctccggcgtgcatacatttcccgccgtactgcaatcaagcgggttgtatagtctctcttccgttgtgactgtccctagctcgtctctgggaacccagacatacatctgtaatgtgaatcacaagccatccaacaccaaagtggacaagcgtgtcgaaccgaaatcatgcgataagacgcatacttgtcccccttgcccagcgcccgagctggttggcggtcctagtgtgttcctcttaccacccaagccgaaagacacactgatgattagcagaacccctgaggtaacttgtgtggtcgtggatgtttcccacgaagaccccgaggtgaagtttaattggtatgtcgatggggtggaagtacataacgcaaaaacaaagccacctgaggagcagtacaattctacccttagggttgtgagcgtcttgacggtgctgcaccaggactggctaaacggaaaagaatataagtgcaaagtctcaaataaggccctccccgctccaatcgagaagaccataagtaaagccaagggccaaccccgggaacctcaggtgtacacactgccaccgtcccgcgacgagcttactaaaaaccaggttagcctgacctgtttggtgaagggcttctatccctctgatatcgcagtagaatgggagtcaaatgggcaacctgagaacaattacaaaacaactccactcgtcctggacagtgatggtagctttttcttatactccaagctgaccgtggacaagtctagatggcagcagggaaacgtttttagttgcagcgtgatgcacgaagctctccataaccactatacacagaaatccctttcactgagtcccggcaag

SEQ ID NO: 23478 - RNA, 642 nt, synthetic construct
  misc_feature 1..642: note = derived and/or modified sequence opt3 from Margetuximab_LightChain1
  source 1..642: mol_type = other RNA
gacatcgtgatgacccagagccacaagttcatgtccacatctgtcggcgatagagtttcaattacttgcaaagccagtcaagacgtgaacacggctgtagcatggtaccagcagaagcccgggcatagccctaaactgctcatatattccgcctcttttaggtacaccggagtgccagatcggttcacaggttcgcgctcaggcactgactttaccttcacaatcagcagtgtccaggcggaggatcttgctgtgtattactgtcaacagcactataccactccgcccacatttgggggaggcaccaaggttgaaattaaacgaacggtggccgcaccttccgtcttcatctttccaccctctgacgagcagctgaaaagcggtactgcctccgtggtatgcttgttaaataacttctaccctcgtgaagctaaggttcagtggaaggtggataatgcactgcaatcagggaacagtcaggagagcgtcaccgaacaggactctaaggattccacatattcactaagcagtactctcaccctgtctaaagccgactacgagaagcataaagtgtacgcttgtgaggtgacacaccagggactttccagcccagtcaccaagtcgtttaatagaggcgaatgc

SEQ ID NO: 23479 - RNA, 762 nt, synthetic construct
  misc_feature 1..762: note = derived and/or modified sequence opt3 from Marzeptacog_alfa_HeavyChain1
  source 1..762: mol_type = other RNA
atcgtgggcgggaaggtctgccccaagggagagtgtccttggcaggttctgctccttgtgaacggtgcccaactgtgcggcgggaccttgattaatacaatatgggtagtgagcgctgcacactgtttcgacaagatcaaaaactggagaaatttaattgccgtcctgggagaacatgatctatccgagcacgacggcgatgaacagtctaggcgggtggcgcaggttatcattccatcaacttacgtgccgggtacgaccaaccatgacatcgctctcctgcgccttcaccagcccgtcgtgctgacagatcatgtagttcctttgtgcctcccagagcgaacttttagtgaacgtaccctggccttcgtgagatttagcctggtctccgggtggggaaggctcttagaccggggcgcaacagccctggagcttcaagtgttgaatgtgccccgcctgatgacccaggattgtctacagcagtctagaaaggtcggcgactcgcctaacataactgagtatatgttctgcgctgggtactcagatggaagcaaagacagttgtaagggtgattccggcgggccacacgcaacacactataggggaacctggtacctcacgggcatcgtttcttggggtcaagggtgcgccactgtgggacattttggcgtatatacccgggtgagccagtacattgaatggctgcagaaacttatgcgctccgagccccgacctggcgtcctgttgagagctccattcccg

SEQ ID NO: 23480 - RNA, 456 nt, synthetic construct
  misc_feature 1..456: note = derived and/or modified sequence opt3 from Marzeptacog_alfa_LightChain1
  source 1..456: mol_type = other RNA
gccaacgctttcctggaggaactcagacccggcagccttgagagggaatgcaaggaggaacagtgttcctttgaggaggcacgggaaatcttcaaagacgccgagcgcaccaagctgttttggatttcttactcagatggggaccaatgcgcgagtagcccttgtcagaatggaggttcctgcaaagatcagttgcagtcttatatatgtttctgcttaccagcttttgaaggccgaaactgtgagacacacaaggacgatcaactgatctgcgtgaatgagaacgggggatgtgaacagtactgctcggaccatactggcacgaaacgttcatgtagatgccacgagggttatagcctactcgccgatggggtcagttgcaatgcaaccgttgaatacccgtgtggaaagattcccatcctggagaagaggaacgcctccaaacctcagggccgg

SEQ ID NO: 23481 - RNA, 669 nt, synthetic construct
  misc_feature 1..669: note = derived and/or modified sequence opt3 from Matuzumab_HeavyChain1_variant_3c08_H
  source 1..669: mol_type = other RNA
caggtgcaactggtccagagcggcgccgaggttaagaaacccggggcttccgtgaaggtatcttgcaaagcatcaggatacaccttcacaagtcactggatgcattgggtgagacaggcccctggtcagggcctcgaatggatcggggagtttaacccaagcaatggaaggactaactataatgaaaagttcaaatccaaggcgacgatgaccgtcgacacatctactaacaccgcttacatggagctttcgtcactgcggagcgaagatacagccgtgtattactgtgcaagtcgcgactatgattacgacggccgatattttgattactggggtcaagggaccttggttactgtgtcctctgccagcacaaagggaccgtccgtcttccccttagctccttcaagtaaaagcacctctggcggcacggcagccctggggtgcctagtgaaggactactttccagagcccgtaactgtttcctggaactcaggagctctcaccagcggtgtgcacacattccctgccgtcctgcagagttctggcctttattccctgagctcggtggtgactgtcccatcttcctcattggggacccagacatacatttgtaatgttaatcataaacccagtaacaccaaggtggataaaaaggtagagcctaagagc

SEQ ID NO: 23482 - RNA, 669 nt, synthetic construct
  misc_feature 1..669: note = derived and/or modified sequence opt3 from Matuzumab_HeavyChain1_variant_3c09_C
  source 1..669: mol_type = other RNA
caggtgcaactggtccagagcggcgccgaggttaagaaacccggggcttccgtgaaggtatcttgcaaagcatcaggatacaccttcacaagtcactggatgcattgggtgagacaggcccctggtcagggcctcgaatggatcggggagtttaacccaagcaatggaaggactaactataatgaaaagttcaaatccaaggcgacgatgaccgtcgacacatctactaacaccgcttacatggagctttcgtcactgcggagcgaagatacagccgtgtattactgtgcaagtcgcgactatgattacgccggccgatattttgactactggggtcaagggaccttggttactgtgtcctctgctagcacaaagggaccgtccgtcttccccttagcaccttcaagtaaaagcacctctggcggcacggccgctctggggtgcctagtgaaggattactttccagagcccgtaactgtttcctggaactcaggagccctcaccagcggtgtgcacacattccctgcggtcctgcagagttctggcctttattccctgagctcggtggtgactgtcccatcttcctcattggggacccagacatacatttgtaatgttaatcataaacccagtaacaccaaggtggacaaaaaggtagagcctaagagc

SEQ ID NO: 23483 - RNA, 636 nt, synthetic construct
  misc_feature 1..636: note = derived and/or modified sequence opt3 from Matuzumab_LightChain1_variant_3c08_L
  source 1..636: mol_type = other RNA
gacatccagatgacccaaagcccctcctctctgtcagccagtgtgggcgatagagtcacaattacttgcagcgcttcctcttcggttacgtacatgtattggtaccagcagaagcctgggaaagcaccaaagctccttatatatgacacctcaaacctggccagcggagtgccgagtaggttctccggttctggcagcgggacagattacacttttaccatctcctcattgcagcccgaggacattgcgacatattactgtcaacagtggagtagccacatcttcacctttggacagggcactaaagtagaaattaagcggacagtggctgccccttctgtcttcatctttccaccctccgatgagcagttaaaatcaggtaccgcaagcgtggtttgcctgctaaataacttctatcctcgcgaagccaaggtgcaatggaaggtcgacaatgctctccagagtgggaactctcaggagtccgtgacggaacaggatagcaaagactcgacttactctctgtcctcaacccttacactgagtaaggcagattacgagaaacataaggtatatgcctgtgaggttactcaccaaggattgagctccccagtgaccaaatcttttaatcgaggcgaa

SEQ ID NO: 23484 - RNA, 636 nt, synthetic construct; identical to SEQ ID NO: 23483
  misc_feature 1..636: note = derived and/or modified sequence opt3 from Matuzumab_LightChain1_variant_3c09_B
  source 1..636: mol_type = other RNA

SEQ ID NO: 23485 - RNA, 1341 nt, synthetic construct
  misc_feature 1..1341: note = derived and/or modified sequence opt3 from Mavrilimumab_HeavyChain1
  source 1..1341: mol_type = other RNA
caggtgcaactggtccagagcggcgccgaggttaagaaacccggggcttccgtgaaggtatcttgcaaagtgtcaggatacaccctcacagaacttagtatccactgggtcagacaggcacctggtaagggcctggagtggatgggagggttcgacccagaagagaacgaaattgtgtatgcccagaggtttcaaggccgggttactatgacggaggataccagcacagacactgcgtacatggagttgtcctctttacgctcggaagataccgctgtgtattactgtgccatagtcggttcattcagcccgctgacactagggctctggggacagggcaccatggtgactgtaagttccgcatctacaaaaggccccagcgtttttcctctggccccatgctcccgatcaaccagtgagagcacggctgcacttgggtgtctggtgaaggactatttccccgaacctgtcactgtgtcttggaatagcggagccttgacctcaggtgtgcatacatttccagctgtcctccagagcagtggcctgtactctctgtccagcgttgtgactgtaccctcgtcttccctcgggaccaagacatatacctgcaacgtggatcacaaaccttcaaatacgaaggtcgacaaacgtgtggagagtaagtacggaccaccgtgtcccagctgccctgccccagagttcttaggcggtccctccgtttttctgttccctccaaaacccaaggatactcttatgatctctagaacaccggaagtgacctgtgtcgtggtagacgttagccaggaggatcctgaagtgcaatttaactggtacgtcgacggggtggaggtccataatgcgaagactaaacccagggaggaacagttcaactcaacatatcgggtggttagtgtgttgaccgtactgcaccaggattggctaaatggaaaggagtacaaatgcaaggtctccaacaaaggcctcccaagctctattgaaaagacgatctcaaaagcaaagggccagcctcgcgagccccaagtgtataccctgccacccagtcaggaagagatgacaaagaatcaggttagccttacttgtctggtgaaagggttttacccttccgacattgccgtcgaatgggagtctaacggacaaccagagaataactataagaccacaccgcccgtgttggattcggacggtagcttctttctctactccagactgactgtagacaaatcaaggtggcaggaaggcaatgtgttcagttgctctgttatgcatgaggctttacacaaccactatacccagaagtccctgtccctctcacttgggaaa

SEQ ID NO: 23486 - RNA, 651 nt, synthetic construct
  misc_feature 1..651: note = derived and/or modified sequence opt3 from Mavrilimumab_LightChain1
  source 1..651: mol_type = other RNA
cagagcgtgctgacccaacccccttccgtctctggcgccccagggcagagagttacaatctcatgcactggaagtggtagcaacattggcgctccgtacgacgtgtcctggtatcagcagctccccgggacggcacctaaacttctgatataccacaataacaagaggccatctggagtacccgatcggttctcgggctcaaagagcggtaccagtgcctccttggcgatcacagggttacaagctgaggacgaagccgattattactgtgcaactgtggaggccggactgtctggcagcgtctttggcgggggaaccaaactaacagtgctcggtcagcctaaggctgcaccatccgttaccctgtttcccccttcaagtgaggaacttcaggccaataaagctactctggtgtgcttgattagcgacttctatccaggcgccgtcacagtggcgtggaaggcagattcttccccggtaaaggccggggttgaaaccacgactccctcaaaacagagcaacaataagtacgctgccagttcttatctctccctgacccctgagcaatggaaaagccatcgctcgtactcttgtcaggtgacacacgagggatccactgtcgaaaagaccgtggcaccaacagagtgctca

SEQ ID NO: 23487 - RNA, 1359 nt, synthetic construct
  misc_feature 1..1359: note = derived and/or modified sequence opt3 from MDX-1303_HeavyChain1
  source 1..1359: mol_type = other RNA
caggtgcaactggtcgagagcggcgggggagttgtgcagcccggtagatccctcaggctttcttgcgccgcttcaggcttcacctttagttactatgggatgcactgggtacggcaggcacctggaaagggcctggaatgggtggccgtcatctggcatgacgagagcattgtgtactatgcggattccgttaaaggtcgcttcacaatatctcgagacaactcgaagaatactttgtacttacagatgaactcactgcgtgctgaagatacggccgtgtattactgtaccagagacccaggggatccgtattactactattacggactagacgtctggggccaaggcacaactgtgaccgtaagcagtgcatccacaaaagggccctctgtttttcctctcgccccaagctccaagtcaaccagtggaggtactgctgcactgggctgccttgtgaaagattatttccccgagcctgtcacagtgagctggaactctggggccctgacctccggagtgcacacgtttccagctgtcttgcagtcaagcggcctctacagtctgtcttccgttgtgactgtacccagctcgtctctgggtacccagacatatatctgtaatgtgaatcataagccttccaacactaaggtcgacaaaagggtggaaccaaagtcatgcgataaaacccacacatgtccgccctgccctgccccagagctcttagggggacccagtgttttcctgtttcctccaaagcccaaagacacccttatgattagccggacgccggaggtgacttgtgtcgtggtagatgtttcccatgaagaccctgaggtgaagttcaattggtacgtcgatggcgtggaagtccacaacgcgaagacaaaaccccgcgaggagcagtataattctacctacagagtggttagcgtgttgactgtactgcaccaagactggctaaacggcaaggaatacaaatgcaaggtctcaaataaagcactcccagcccctatcgagaagacaattagtaaagctaaggggcagcccagggaaccacaggtgtataccctgcccccttcccgggaggaaatgacgaagaaccaggttagccttacctgtctggtgaaaggattttacccatctgacatcgccgtcgagtgggagtcaaatggtcaaccggaaaacaattataagacaactccccctgtgttggatagtgacggcagcttctttctctactccaaactgaccgtagataagtctcgctggcagcaggggaacgtgttctcgtgcagcgttatgcatgaggcattacacaaccattatacacaaaaatccctgtcactcagtccaggaaag

SEQ ID NO: 23488 - RNA, 645 nt, synthetic construct
  misc_feature 1..645: note = derived and/or modified sequence opt3 from MDX-1303_LightChain1
  source 1..645: mol_type = other RNA
gagatcgtgctgacccagagccccggcacactctccctttctcctggggaaagagccactctgtcatgcagggctagtcaaagcgtctcctcttcgtacttggcatggtatcagcagaaaccaggacaggccccgcggttactgatttacggtgcgtcaagccgcgctacgggcatacccgaccgattcagtgggtccggatctggcaccgattttacactaactatcagccgtctcgagcctgaagacttcgccgtttattactgtcaacagtatggttcctcaatgtacacctttgggcagggaacaaaactggagattaagagaaccgtggcagccccaagtgtattcatctttccccctagcgatgaacagcttaaatctggcactgcttccgtggtctgcctgttgaacaatttctatccaagggaggcaaaggtgcaatggaaagttgacaacgccctccagtcaggcaatagccaggagagtgtgacagaacaggattctaaggactccacctacagcctgtcgtctacgctgactctctccaaggctgattacgagaaacacaaggtctatgcctgtgaagtgacccatcaagggttatcaagtcccgtaacaaagagctttaaccggggagagtgc

SEQ ID NO: 23489 - RNA, 1347 nt, synthetic construct
  misc_feature 1..1347: note = derived and/or modified sequence opt3 from Mepolizumab_HeavyChain1
  source 1..1347: mol_type = other RNA
caggtgaccctgagagagagcggccccgccctcgtcaagcctacacaaactcttacgctgacctgcacagtttccgggttctctttgacttcatacagtgtgcactgggtaaggcagccaccgggaaaaggtttagaatggctgggcgtgatctgggctagcgggggaaccgactataactccgcactaatgtctcggctctcgatttcaaaggatacaagccgcaatcaggtcgtgctgaccatgactaacatggaccccgttgatacagccacctactattgtgcgcgagaccctccaagttcccttctgcgtttggattactggggcagaggtacgcccgtgactgtctctagcgcttccaccaaagggccttcagtgtttccactcgcccccagtagcaagtctacatccggaggcactgcagccctgggctgcctggtaaaagactatttccctgagccagttaccgtgtcatggaatagcggggctctcacaagtggagtccatacctttccggcagtgttacagtcttccggtctgtacagcctttcgtctgtggtcacggttccctcctcaagtttgggcactcaaacatatatatgtaacgtgaatcacaagcctagcaacaccaaggtagataaaagggtggaaccaaagtcctgcgacaaaactcatacatgtcccccttgcccagcccccgagctgctagggggaccgtctgtcttcctctttcctcccaagccaaaagataccctgatgatcagccggacgcctgaagtgacctgtgttgtggtcgacgtgtcacacgaggatcccgaggtaaagttcaattggtacgttgacggcgtggaagtccataacgctaagacaaaaccacgcgaggaacagtacaatagtacttatagagtggtctccgtgcttaccgttctgcaccaggattggttgaacggtaaggagtacaaatgcaaggtgagcaataaagccctccccgcgcctattgagaagacaatctctaaagcaaaggggcagccaagggaaccgcaagtatatactctgcccccttcacgggaggaaatgaccaagaaccaggtcagtttaacatgtctggtgaaaggattttacccaagcgacattgccgttgagtgggaatccaatggccagcccgagaacaattataagaccactcctccagtgctcgactctgatggctcgttctttctttacagcaaactgacggtcgacaagtcccgctggcagcaagggaacgtgttctcatgcagtgtaatgcacgaggctttgcataaccactatacacagaaatctctaagcctgtcccccggaaag

SEQ ID NO: 23490 - RNA, 660 nt, synthetic construct
  misc_feature 1..660: note = derived and/or modified sequence opt3 from Mepolizumab_LightChain1
  source 1..660: mol_type = other RNA
gacatcgtgatgacccagagccccgattccctggccgtctctctcggcgagagagctacaattaactgcaagtcaagtcaaagccttctgaactccgggaatcagaaaaattacttggcatggtatcagcagaagcctggacaaccaccgaaattactgatatacggtgcctctactagggaatcgggcgttcccgaccggttctcagggagcggaagtggcacggattttaccctaacaatctcctctctccaggcggaggacgtggctgtatattactgtcagaacgtgcacagcttcccttttactttcggtgggggaaccaagctggaaattaaacgcacagtcgccgcaccatccgtgtttatctttcccccttcagatgagcagcttaagagtggcaccgccagcgttgtgtgcctgttgaataacttctatccacgagaagctaaggtccaatggaaagtggacaatgcactccagtctggcaactcccaggagtcagtaactgagcaggatagcaaggacagtacatactctctgtccagcaccctgacgctctcgaaagccgattatgaaaagcataaagtttacgcttgtgaggtgactcaccaagggttatcttcccccgtcaccaagtcattcaatcgtggagaatgc

SEQ ID NO: 23491 - RNA, 1350 nt, synthetic construct
  misc_feature 1..1350: note = derived and/or modified sequence opt3 from Metelimumab_HeavyChain1
  source 1..1350: mol_type = other RNA
gaggtgcagctggtcgaaagcggcgggggagttgtgcaacccggtagatccctcaggctttcttgcgccgcttcaggcttcacctttagtagctacgggatgcactgggtacggcaggcacctggaaaggagctggaatgggtggccgtcatctcctatgacggctctattaaatactatgcggattcggtgaagggtcgcttcacaatatcacgagacaacagcaaaaatactttgtacttacagatgaacagtctgcgtgctgaggatacggccgtttattactgtgcaagaaccggggaatattccggatacgacacagatccacagtactcttggggccaaggcactaccgtgacagtcagctccgcctcaaccaaggggccgagtgtgtttcccctagctccttgcagcaggtctacttccgagtcaacagcagccctcggatgtctggtaaaagactatttcccagagcccgttaccgtgagctggaatagtggtgctcttacgtctggcgtccatacttttcctgccgtgctgcagtccagcgggttgtactcgctctcttccgtggtcaccgttccatcaagtagcctgggaacaaagacttatacctgcaacgtggatcacaagccctccaatacaaaagtagacaagcgggtggaatctaaatacggccctccatgtccgagctgccccgcgcctgagttcctgggtgggccatcagtctttctctttccccctaagccaaaacccaccttaatgatcagtcgcacgccggaagtgacttgtgttgtggtcgatgtgtcccaggaggaccctgaggtacagttcaactggtatgttgatggagtggaagtccataatgcaaagacaaagcccagagaggaacaattcaacagcacctacagggtggtctctgtgctgactgttcttcaccaggactggttgaatggcaaagagtataagtgcaaagtgtcaaacaagggcctgccaagtagcattgagaaaacaatctccaaggccaaagggcagcctcgggaaccccaggtatacaccctaccaccctctcaagaggaaatgacgaagaatcaggtctcgctcacctgtctggtgaagggattttaccctagcgatattgctgttgagtgggaatccaacggtcagccagagaataactataaaacaactccgcccgtgcttgactcagacggcagtttctttctgtactctcgcttgaccgtcgataagagccgatggcaagaagggaatgtgttctcctgctcagtaatgcatgaggccctccacaaccactatacacagaaaagcctgtctttatccctgggaaag

SEQ ID NO: 23492 - RNA, 639 nt, synthetic construct
  misc_feature 1..639: note = derived and/or modified sequence opt3 from Metelimumab_LightChain1
  source 1..639: mol_type = other RNA
gagatcgtgctgacccagagcccctcctctctctcagccagtgtcggcgacagagttacaattacttgcagggctagccaagggataggagatgaccttggttggtaccagcagaagcctggcaaagcaccaatcctgttgatttatgggacgtccaccttacagtctggagtgccgtcgcggttctcaggcagcggtagtgggacagattttactctgaccatcaactccctacaacccgaagacttcgccacatactattgtctccaggattctaattaccctctgacctttggaggcggcactcgccttgagattaagcgaacagtagcggctccaagcgtgttcatctttcccccttccgacgaacagctgaaatcagggaccgccagtgtcgtgtgcttgctcaacaatttctatccacgtgaggcaaaggttcagtggaaagtggataacgccctgcaaagcggaaattctcaggaatccgtcacggagcaggactcaaaggatagcacttacagtctgtcttccaccctcacattaagcaaggctgactatgagaaacacaaggtgtacgcatgtgaagtaactcatcagggtctgtcgcccgttaccaaatcttttaacagaggcgagtgc

SEQ ID NO: 23493 - RNA, 1350 nt, synthetic construct
  misc_feature 1..1350: note = derived and/or modified sequence opt3 from Milatuzumab_HeavyChain1
  source 1..1350: mol_type = other RNA
caggtgcaactgcagcagagcggctccgagctcaagaaacccggggcctctgtcaaggtttcatgcaaagctagtggatacaccttcacaaactatggtgtgaattggatcaagcaggcacctggccaagggcttcagtggatgggatggattaacccaaatactggcgaaccgacgtttgacgatgacttcaaaggtagatttgccttcagcctggatacctccgtatctacagcgtacttgcagatatcgtcattaaaggctgacgatactgccgtgtatttttgtagcaggagtcgggggaagaacgaggcatggttcgcctactggggacagggcaccctggtcacagtgtcctctgctagcaccaaaggcccctccgtttttcctctagcaccatcaagtaagagcacttctgggggaacagccgctctcggttgcctggtgaaagactatttccccgaacctgtcaccgtgtcctggaactcaggcgcccttacgagcggggtacacacttttccagcggttctgcaaagttctggattgtactccctcagctcggtggtcaccgtgccctcttcctcactgggcacacagacttatatctgtaatgtgaatcataagcctagtaacaccaaagtcgataagcgcgttgagccaaagagctgcgacaaaacacacacctgtccgccctgccctgcaccagaactgctcggtgggccctccgtgttcttatttcctccaaagcccaaagatacgctgatgatttctcgaactccggaggtaacatgtgtggtcgtggacgttagccatgaggatcctgaagtgaagttcaattggtacgtcgacggagtggaggtacacaacgccaaaaccaagccccgtgaggaacagtacaattcaacttatagagttgtgagtgtccttacagtgttgcatcaggattggctgaacggcaaagagtacaagtgcaaggtctccaataaagctctaccagcccctatcgaaaagaccattagcaaagcaaagggccaacccagggagccacaggtgtatacgctgcccccttctcgggaagagatgaccaaaaaccaggtttcactcacatgtcttgtgaaggggttttacccaagtgacatcgctgtagaatgggagagcaatggacaaccggagaacaactataagactacaccccctgtcctggactccgatggttctttcttcttgtactcgaaactcaccgtggacaagagccgctggcagcagggcaatgtgttttcctgctcagttatgcacgaagccctgcacaaccattatactcagaaaagtttatctctgagcccagggaag

SEQ ID NO: 23494 - RNA, 657 nt, synthetic construct
  misc_feature 1..657: note = derived and/or modified sequence opt3 from Milatuzumab_LightChain1
  source 1..657: mol_type = other RNA
gacatccagctgacccaaagccccctctcccttcctgtgacactgggccagccagcctctatttcatgcagaagtagccagtccttggtccacaggaacgggaatacttacttacattggttccagcaacggccgggacagtctccccgcctgctaatatatacggtttcgaaccgattttcaggtgtgcctgatcgtttcagcggcagtgggtccggaaccgactttacactcaagatctctagagtagaggctgaagatgtgggcgtctacttctgtagccagtcctcacacgtgccacccacttttggtgcagggaccaggctggagattaaacggacagttgccgcgcctagtgtgttcatctttccacccagcgacgaacagcttaagtctggaaccgcttccgtcgtgtgcctgttgaataacttctatcctcgcgaggccaaagtacaatggaaggttgataatgcactccagtcaggcaacagccaggaaagtgtgactgagcaggactctaaagattccacatacagcctgtcgtctaccctgacgctctccaaggccgactatgagaagcataaagtctacgcttgtgaagtgactcaccaaggcttatcaagtccagtgaccaagagctttaatagaggggagtgc

SEQ ID NO: 23495 - RNA, 1341 nt, synthetic construct
  misc_feature 1..1341: note = derived and/or modified sequence opt3 from Mirvetuximab_HeavyChain1
  source 1..1341: mol_type = other RNA
caggtgcaactggtccagagcggcgccgaggttgtgaagcccggggcttccgtaaaaatctcttgcaaggcatcaggatacaccttcacaggttattttatgaactgggtgaaacagagtcctggccagagcctcgaatggattgggagaatacacccatacgacggagatactttctataatcaaaagtttcagggcaaagccacgcttaccgtcgacaagtcctctaacacagcgcatatggagctgttgtcgttaacttcagaagatttcgctgtgtactattgtaccaggtacgacggtagccgggccatggattattgggggcagggaacaaccgttactgtgagttccgcatctacaaagggcccgagcgtctttcccctggccccttcctcaaaaagtaccagcggcgggacggctgcactaggatgcctcgtgaaggactacttcccagagcccgtaactgtttcttggaactccggtgccctgacctcaggcgtgcacacatttcctgctgtccttcagagcagtgggctgtactctttgtccagcgtggtgactgtcccatcgtcttccctcggaacccaaacatatatctgtaatgttaatcataaaccctcaaacaccaaggtggataaaaaggtagaacctaagagttgcgacaaaacgcacacttgtccaccgtgccccgcccctgagctgctgggcggtccaagcgtgttcctctttccccctaagccaaaagatacattaatgatttcccgcacccccgaggtcacttgtgtggttgtggacgtctctcatgaagatccggaggtgaagttcaattggtacgtagacggggttgaagtgcacaacgcgaaaacaaagcctcgagaggagcagtataatagcacctaccgtgtcgtgtcagtcctgacggtgcttcaccaggattggttgaacggaaaagaatataagtgcaaggttagtaataaagcactgcccgccccaatcgagaagaccatttccaaagctaagggccagcctagagaaccccaagtgtacacactaccacccagcagggacgagctcactaaaaaccaggtatctctgacctgtcttgtcaagggcttttatccttcagacatcgccgtggaatgggagagtaatgggcagccagagaacaattacaagacaactccgcccgttctggatagcgacggatccttctttttgtactctaaactcaccgtggataagtcgcggtggcaacagggtaacgtcttcagctgctccgtgatgcatgaagcactgcacaaccattatacacagaaatcattaagtctgtctcctggc

SEQ ID NO: 23496 - RNA, 654 nt, synthetic construct
  misc_feature 1..654: note = derived and/or modified sequence opt3 from Mirvetuximab_LightChain1
  source 1..654: mol_type = other RNA
gacatcgtgctgacccagagccccctctcccttgccgtctctctgggccaacctgctattatatcatgcaaggcaagtcagagcgtttccttcgccgggacatctttgatgcactggtaccatcagaaaccaggacagcaaccgagattactgatctatagggcgtcgaacctagaggctggtgtgcccgatcggttttcaggcagcgggagtaagactgacttcacgctcaccatttcccctgtagaagccgaggatgcagccacatactattgtcagcagtctcgcgaatacccatatacttttggaggcggtaccaaactggagatcaagcgaacagtggctgcacccagcgtcttcatttttcctccatccgacgaacagcttaaatcagggaccgccagtgtggtttgcctgttgaataacttctacccccgtgaggctaaggtgcaatggaaggtcgataatgccctccagagcggaaactctcaggagtccgtgactgaacaggactcaaaagatagcacatatagtctgtcttccaccctgacgctcagcaaggcggactacgagaaacacaaggtatacgcatgtgaagttactcatcaaggcttatcgtctcctgtgaccaaatcctttaatagaggcgagtgc

SEQ ID NO: 23497 - RNA, 1344 nt, synthetic construct
  misc_feature 1..1344: note = derived and/or modified sequence opt3 from Modotuximab_HeavyChain1
  source 1..1344: mol_type = other RNA
caggtgcaactgcagcagcccggcgccgagctcgtcgaacctgggggaagcgttaaactttcctgcaaggcttctggttacaccttcacatcacactggatgcattgggtgaagcagagaccaggccaagggctggagtggatcggagaaattaacccgagtagcggcaggaataactataatgagaaatttaagtccaaagcaactttgacggtagacaagtcttcgtcaaccgcctacatgcagttcagcagtttaacatccgaagattctgcggtgtattactgtgtccggtattacggttatgacgaggctatggattactgggggcagggaactagcgtgaccgtttcctcagccagtacaaagggccccagcgtgtttcctctggcaccatcttccaaatcaaccagcggcgggactgccgctctaggatgcctcgtcaaggactacttccccgagcctgtgacagtaagttggaactctggtgcactgacctccggcgttcacacgtttccagccgtgcttcagagctcggggctgtattctttgtcctcagtcgtgactgtgcccagtagctccctcggaacccaaacatacatatgtaatgtcaaccataaaccttctaatactaaggttgataaacgcgtggaaccaaagagctgcgacaagacccacacatgtccgccctgccctgctccagagctgctgggcggtccctcagtattcctctttcctccaaaacccaaggataccttaatgatcagtcgaacgccggaagtgacttgtgtcgtggttgacgtgtcccatgaggatcctgaggtcaaattcaactggtatgtggacggggtagaagttcacaatgccaagacaaaaccccgtgaggaacagtacaacagcacctatagagtggtctctgtgctgactgtccttcaccaggattggttgaatggaaaggagtacaaatgcaaggtgtcaaacaaggcgctgccagcacctattgagaaaacaatcagtaaggccaaaggccagcccagggaaccacaagtttataccctaccccctagccgggaggaaatgacgaagaatcaggtgtccctcacctgtctggtaaaaggcttttacccatctgacattgctgtcgagtgggaatcgaacgggcagccggagaataactacaagacaactccccctgtgcttgatagcgacggatccttctttctgtattcaaagttgaccgttgacaaaagtcgctggcaacagggtaacgtgttctcttgcagcgtcatgcatgaagccctccacaatcattacacacagaagtccctgtcattaagcccaggc

SEQ ID NO: 23498 - RNA, 657 nt, synthetic construct
  misc_feature 1..657: note = derived and/or modified sequence opt3 from Modotuximab_LightChain1
  source 1..657: mol_type = other RNA
gacatcgtgatgacccaggccgctttcagcaaccccgtcacactgggcacttccgcatctatttcatgcagaagtagcaagtccctccttcactctaatgggataacgtacctgtattggtacttgcaaaaacctggacagtcgccacagttactgatctatcagatgtcaaacctagccagcggtgttccggataggtttagttcctctggcagcgggaccgacttcacactccggatttcccgcgtggaggcggaagatgtaggagtgtactattgtgctcaaaatctggagcttccctacacttttggcggtgggaccaagctggaaatcaaacgaacagtcgccgcaccttcagtgttcatttttccacccagtgacgagcagctcaagagcggaaccgcctctgttgtgtgcttgctgaacaatttctatcctcgtgaagctaaagtccagtggaaggtggataacgcactgcagtccggcaattcacaagagagcgtaactgagcaggacagtaaggattctacatactccctcagctcgaccttaacgctgtctaaagccgactacgaaaagcataaagtttatgcttgtgaggtgactcaccagggcctttcctcaccagtcaccaagagttttaacagaggggaatgc

SEQ ID NO: 23499 - RNA, 1347 nt, synthetic construct
  misc_feature 1..1347: note = derived and/or modified sequence opt3 from Mogamulizumab_HeavyChain1
  source 1..1347: mol_type = other RNA
gaggtgcagctggtcgaaagcggcggggacctcgttcaacccggaagatcccttaggctgtcttgcgctgcttcaggtttcatctttagtaactacggcatgagctgggtgcggcaggcacctgggaagggattggagtgggtagccaccatttcctctgcgtcgacatattcatactatccagatagcgtgaaaggccgcttcactataagtcgagacaatgctaagaactccttatacctgcagatgaactctctacgtgtcgaagatacggccctctattactgtggtagacacagcgacgggaattttgcattcggatattggggccagggcaccctggtgacagtttcctcagccagtactaaagggccgagcgtgtttccccttgctccttcttccaagtcaaccagcggaggtacagcagccctgggctgcttggtcaaagattacttcccagagcccgtgaccgtaagttggaactctggggctctcacttccggagttcatacatttcctgccgtgctgcaaagctcgggcctgtactctctctcctcagtcgtgaccgtgccaagtagctccttaggtacgcagacttatatctgtaatgtcaatcacaagccctctaacaccaaggttgacaaaaaggtggaacctaaaagctgcgataagacacatacttgtccaccgtgccccgcgcctgagctgcttgggggaccatcagtattcttgtttccccctaaaccaaaggacaccctgatgattagtaggacacccgaggtgacctgtgtcgtggttgatgtgtcccacgaagacccggaggtcaagttcaattggtacgtggatggcgtagaagttcataacgcaaaaacgaagcctcgggaggagcagtataatagcacttaccgcgtggtctctgtgctaacagtcctccaccaggactggctgaacggcaaagaatataagtgcaaagtgtcaaataaggcccttcccgctccaatcgagaaaaccattagtaaggccaaggggcaacctagagaaccccaggtttacactctgccacccagcagggatgagttgaccaaaaaccaggtgtccctcacatgtctggtaaagggattttatccttctgacatcgcagtcgaatgggagtcgaatggtcagccagagaacaactacaaaacgaccccgcccgtgttagacagcgatggctccttctttctgtactcaaagctcacagttgacaaaagtcggtggcaacaggggaatgtgttctcttgcagcgtcatgcacgaagcccttcataaccactatactcagaagtccctgtcattgagccctggaaag

SEQ ID NO: 23500 - RNA, 657 nt, synthetic construct
  misc_feature 1..657: note = derived and/or modified sequence opt3 from Mogamulizumab_LightChain1
  source 1..657: mol_type = other RNA
gacgtgctgatgacccagagccccctctcccttcctgtcacaccaggcgagccggcctctatctcatgcagaagtagcaggaacattgttcacataaatggggatacttacctggaatggtatttgcaaaagcccggacagtcccctcagttactgatctacaaagtgtctaaccggttctcgggtgtaccagaccgcttttcaggcagcgggagtggaacggatttcaccctaaagatttcccgagtggaggctgaagacgtcggcgtgtattactgttttcagggttctctcctgccctggacattcgggcaaggaactaaagttgagatcaagcgtaccgtggcagcccctagcgtctttattttcccaccctccgatgaacagcttaaatcaggcacagcgagtgtggtatgcctgttgaataacttttatcctagagaggctaaggttcagtggaaggtggacaatgccctccagagcggcaactctcaagagtccgtcaccgaacaggattcaaaagacagcacttacagtctgtcttccacactgaccctcagcaaggcagattatgagaaacataaggtgtacgcctgtgaagtgacgcaccaggggttatcgtctccagtcactaaatccttcaataggggagagtgc

SEQ ID NO: 23501 - RNA, 1356 nt, synthetic construct
  misc_feature 1..1356: note = derived and/or modified sequence opt3 from Monalizumab_HeavyChain1
  source 1..1356: mol_type = other RNA
caggtgcaactggtccagagcggcgccgaggttaagaaacccggggcttccgtgaaggtatcttgcaaagcatcaggatacaccttcacaagttattggatgaactgggtgagacaggcccctggtcagggcctcgaatggatggggaggatcgacccatacgatagcgagactcactatgcgcaaaaacttcagggacgggtcacgatgaccacagacacttccacctctacagcttacatggaactgcgctcgttgcgatcagatgacaccgccgtgtattactgtgcacgtggcggttatgattttgacgttgggactttatactggttctttgatgtgtggggacagggcacaaccgtcacggtgagcagtgcctccactaagggcccgtctgtattccccctggctccttgcagcagatccacctcagagagtacagcagccctagggtgtctcgttaaggactactttccagaacccgtgactgtcagctggaactctggagctctgacctccggtgtgcatacattccctgccgtgcttcagtcaagcggcctgtatagtttgtcttccgtcgttaccgtgccaagctcgtctctcgggacgaagacttacacatgcaatgtagatcacaaaccctccaataccaaggtggacaaaagggtcgagtcaaagtatggacctccatgtccgccctgccctgcgccagagtttctgggcggtcccagtgtgttcctgtttcctccaaaacccaaggatactctcatgattagccggacaccggaagttacctgtgtggtcgtggacgtatcccaagaggatcctgaagttcagttcaactggtacgtggacggggtcgaggtgcataatgcaaagacgaaaccccgcgaggaacagtttaactctacctatagagtcgtgagcgttttaacagtgctgcaccaggactggcttaatggaaaggagtacaaatgcaaggtatcaaacaaaggcttgccaagttccatagaaaagactatcagcaaagccaagggccaacctagggagccccaggtctataccctgccaccctctcaggaagagatgacaaagaatcaagtgtcactaacttgtctcgttaaagggttctaccctagtgatattgctgtggagtgggaaagcaacggacagccagagaataactacaagaccacaccgcccgtcctggactccgatggttcgtttttcctttattctcggctgaccgtggacaaaagccgctggcaggaaggcaatgtattctcctgctcagtgatgcatgaggccttgcacaaccactacactcagaagagtctctctctgagcttagggaaa

SEQ ID NO: 23502 - RNA, 642 nt, synthetic construct
  misc_feature 1..642: note = derived and/or modified sequence opt3 from Monalizumab_LightChain1
  source 1..642: mol_type = other RNA
gacatccagatgacccaaagcccctcctctctgtcagccagtgtgggcgatagagtcacaattacttgcagggctagcgagaacatatactcctatctcgcatggtaccagcagaagcctgggaaagccccaaaacttctgatctataatgcgaagacgttggctgaaggagttccgtctcggttctcgggttcaggcagcgggaccgactttacattaactattagttccctgcagcccgaggatttcgccacctactattgtcaacaccattacggaacacctcgcacctttggcggtgggactaaggtggaaatcaaacgaacagtagcagccccatctgtgttcatttttccccctagcgacgagcagctaaagtccggaaccgcttcagtcgtgtgcctcctgaacaatttctatccacgtgaagcaaaggttcagtggaaagtggataacgcccttcagagtggcaatagccaagagtctgtcacggagcaggactccaaggattcaacttacagcctgagttctaccttgacactctccaaagctgactacgaaaagcacaaagtgtatgcctgtgaggtaactcatcagggcctgagctcgcccgttaccaagtcttttaacagaggggaatgc

SEQ ID NO: 23503 - RNA, 1350 nt, synthetic construct
  misc_feature 1..1350: note = derived and/or modified sequence opt3 from Motavizumab_HeavyChain
  source 1..1350: mol_type = other RNA
caggtgaccctgagagagagcggccccgccctcgtcaagcctacacaaactcttacgctgacctgcacattctccgggttttctttgtcaactgctggaatgagtgttggttggatcaggcagccaccgggcaaagcattagaatggctggccgacatttggtgggatgacaagaaacactacaaccccagcctaaaggatcggctcaccatatccaaagacacatctaagaatcaggtggtactgaaggtgaccaacatggatcctgcggacactgctacatattactgtgcccgcgatatgatcttcaatttttatttcgacgtctgggggcagggaaccacggtgactgtttcgtcagcaagcaccaaaggcccaagtgtgtttccccttgccccttcctctaagagcacatccggtgggactgctgcactgggatgcttggtcaaagattacttcccagagcccgtgaccgtatcatggaacagtggcgccctcacaagcggcgttcatacctttcctgctgtgctgcaatcttccgggctgtattcactcagcagtgtcgtgacggtgccatcttccagcttaggaactcagacatacatttgtaatgtcaaccacaagccgtcgaataccaaagttgacaagcgagtggaacccaagtcttgcgataaaactcatacatgtcctccatgccccgcccctgagctgcttggtggcccatccgtattcttgtttcccccgaagcctaaagacaccctgatgatctcacgtacgcccgaagtgacctgtgtcgtggttgatgtgagtcacgaggacccagaggtcaagttcaactggtatgtggacggggtagaagttcataatgcgaaaacaaagcctagagaggaacagtacaacagcacttacagggtggtctccgtgctaaccgtcctccaccaggattggctgaatggaaaagagtataagtgcaaggtgtctaacaaagcacttcccgccccaattgagaagacaatcagcaaagctaagggccaaccccgggaacctcaggtttacactctgccaccgtcacgcgaggaaatgaccaaaaatcaggtgagtttgacatgtctcgtaaagggtttttatccctccgacatagccgtcgagtgggaaagcaacgggcagcctgagaataactacaagaccactccacccgtgctggattctgacggatcattctttttatatagtaaactgacggttgataagagcagatggcaacagggcaacgtgttctcctgctctgtcatgcacgaggcactccataatcactacacacagaaatcgcttagcctgtcccctggcaag

SEQ ID NO: 23504 - RNA, 1350 nt, synthetic construct; identical to SEQ ID NO: 23503
  misc_feature 1..1350: note = derived and/or modified sequence opt3 from Motavizumab_HeavyChain_variant
  source 1..1350: mol_type = other RNA

SEQ ID NO: 23505 - RNA, 639 nt, synthetic construct
  misc_feature 1..639: note = derived and/or modified sequence opt3 from Motavizumab_LightChain
  source 1..639: mol_type = other RNA
gacatccagatgacccaaagcccctccacactgtctgcctcagtgggcgatagagtcactattacgtgcagtgctagctccagggttgggtacatgcactggtatcagcagaagcctggaaaagcaccaaagctccttatatacgacacctctaaactggcctcgggtgtgccgtcacggttcagcggcagtgggtccggaacagagtttactttgaccatctctagcttacagcccgatgacttcgcgacatattactgttttcaaggctccggttatcctttcacctttgggggaggcactaaggtagaaattaaacgcacagtggctgccccatcagtcttcatctttccccctagtgatgagcagctgaagtcaggcaccgcatctgtggtttgcctactcaacaatttctacccacgagaagccaaggtgcagtggaaagtcgacaacgctctgcagtccgggaatagccaagagagcgtgacggaacaggatagtaaggactctacttattcccttagctcgaccctgacattgtctaaagcagattacgagaagcataaagtatacgcctgtgaggttactcaccagggactctcctcacccgtgaccaagagttttaaccgtggtgaatgc

SEQ ID NO: 23506 - RNA, 639 nt, synthetic construct; identical to SEQ ID NO: 23505
  misc_feature 1..639: note = derived and/or modified sequence opt3 from Motavizumab_LightChain_variant
  source 1..639: mol_type = other RNA

SEQ ID NO: 23507 - RNA, 1428 nt, synthetic construct
  misc_feature 1..1428: note = derived and/or modified sequence opt3 from Moxetumomab_pasudotox_HeavyChain1
  source 1..1428: mol_type = other RNA
atggaggtgcagctggtcgaaagcggcgggggactcgttaagcccggtggctcccttaaactgtcttgcgccgcttcagggttcgcatttagtatctacgacatgagctgggtgagacaaacccctgagaagtgtttggaatgggtagcctatatttcctctggaggcggtacaacttactatccagatacggtgaaagggaggttcaccatatcgcgggacaacgcgaagaatacattatacctgcagatgtcaagcctaaaaagtgaggatactgctatgtattactgcgcccgccactccggatatggcacccattggggcgtcctctttgcatactgggggcagggaacactggtgaccgtttctgccaaggctagcggtggcccggaagggggatcccttgcagccctgactgctcaccaggcctgtcatttgcccctcgagacattcacccgacaccgtcaacctagaggctgggagcagctggaacagtgcggttacccagtgcagaggctggtcgcgctctatttagcagcccggctgtcatggaaccaagtggaccaggtaatccgcaatgctcttgccagtcccgggagcggaggcgatttgggcgaggcaattagagaacagcctgagcaggctaggctggccctaacgctcgcggccgcagagtctgaacggtttgttcgccaagggactggaaacgacgaggctggtgccgctaatggcccagccgattccggggacgcactgcttgaacgaaactaccccaccggagccgagttcctgggcgatggtggggacgtgtcatttagcacaagaggcactcagaattggaccgtcgaaaggttgctccaggctcatcggcaactggaggagcgtggatatgtgttcgtgggctaccacgggacatttttagaagcggcacagagtatcgtcttcggaggtgttcgcgccagatctcaggatctggacgctatttggaggggcttttatatcgccggggatcctgcactcgcctacggatatgctcaggaccaagagccagacgcccggggccgaatacgcaacggtgcacttctgagagtgtacgtaccgaggtccagcttgcccgggttctaccggacctcgctaacgctggcggctcctgaagccgcaggcgaggtggaacgcctcatcggacacccactgccccttagactggatgccattactggccctgaggaggaagggggaaggttggagacaatcctcggttggccactggctgaacgtaccgtcgtgattccctctgccatcccgactgaccctcggaatgttggcggggatttagacccctcctcaataccagataaggagcaggcaattagtgctctgcctgactatgccagccagcccggaaaaccaccccgagaagatctaaag

SEQ ID NO: 23508 - RNA, 324 nt, synthetic construct
  misc_feature 1..324: note = derived and/or modified sequence opt3 from Moxetumomab_pasudotox_LightChain1
  source 1..324: mol_type = other RNA
atggacatccagatgacccaaacaactagctccctgtctgcctcactcggcgatagagtgacgattagttgcagggctagccaggacatatccaactaccttaattggtatcagcagaagcccgatgggaccgtcaaactgttgatctactatacatctattttacactcgggagttccttcacggttcagcggtagtggctccgggactgactactctctgaccatcagcaacctagagcaagaagattttgcaacatatttctgtcagcagggaaataccctcccatggacttttggctgcggtacaaagctggagattaaa

SEQ ID NO: 23509 - RNA, 1350 nt, synthetic construct
  misc_feature 1..1350: note = derived and/or modified sequence opt3 from Muromonab-CD3_HeavyChain
  source 1..1350: mol_type = other RNA
caggtgcaactgcagcagagcggcgccgagctcgctagacccggggcatccgtcaagatgtcttgcaaagcctcaggatacaccttcacaaggtatactatgcactgggttaagcagcggcctggtcaaggccttgaatggatcgggtacattaacccaagtcgcggatatacgaattacaaccagaaatttaaggacaaagcgaccctgacaactgataagagctcctctaccgcttatatgcagttgtcgtcattaacaagcgaggacagtgccgtgtactattgtgcacgatactacgatgaccattattgcctggattactggggccagggtaccactctaacagtatcctctgccaagaccacggctccgagcgtgtatcccctcgcacctgtctgtgggggaactaccggctcctcagtgacactgggctgccttgttaaagggtacttcccagaacccgtgactctgacctggaatagtggtagcttgtcttccggagtccacacatttcctgccgtgctccaatcagacctgtataccctgagcagttctgtaacggttacttccagcacatggccatcgcagtctataacctgtaacgtggctcatcccgcctcctcaactaaggtcgataaaaagatcgagcctcgtccaaaaagttgcgacaagacacacacctgtccgccctgccctgcgccagaactcttaggcgggcccagcgtgttcctgtttcctccaaagcccaaagatacgcttatgatttccagaaccccggaggtgacatgtgtcgttgtggacgtatctcatgaggatcctgaagtgaagttcaattggtacgtcgacggagtggaggttcacaacgcaaaaactaagcccagggaggaacagtataatagcacctaccgggtggtctcagtgttgacagtactgcaccaggattggctaaacggcaaagagtacaagtgcaaagttagtaataaggccctcccagctcctatcgaaaagactatttccaaagccaagggtcaaccccgcgagccacaggtgtataccctgccccctagcagagacgaacttaccaaaaaccaggtctctctgacatgtttggtgaaggggttttacccatcagacatcgcagtcgagtgggaaagtaatggacaaccggagaacaattataaaactacgccccctgtgctcgatagcgacggctccttctttctgtactctaagttaacagttgataagtcgaggtggcagcagggcaacgtgttcagctgctccgtaatgcatgaggctctgcacaatcattatacccagaaatcactcagtctttctccagggaag

SEQ ID NO: 23510 - RNA, 639 nt, synthetic construct
  misc_feature 1..639: note = derived and/or modified sequence opt3 from Muromonab-CD3_LightChain
  source 1..639: mol_type = other RNA
cagatcgtgctgacccaaagccccgccattatgtccgcttctcctggcgagaaggtgacaatgacttgctcagcaagtagctccgtttcttacatgaactggtatcagcagaaatcggggacgtcaccaaagagatggatatacgacaccagcaaactcgccagtggagtgccggcgcacttcaggggttccggctctgggacaagctattcccttactatctcaggaatggaagctgaggatgccgcaacctactattgtcagcaatggagtagcaatccctttacattcggctctggtaccaagctggaaattaaccgggccgacactgctcctacagtatccatctttccaccctcaagcgagcagttgaccagtgggggagcatctgtggtctgcttcttaaataacttttaccctaaagatattaatgtgaagtggaagatcgacggctccgaacgccagaacggcgttctgaatagctggacggatcaggactcgaaagattctacttattccatgtcaagtaccctaacactcactaaggacgagtacgagcgacataacagctacacctgtgaagccacacacaaaacctccacgtctccaatagtcaagagcttcaatcgtaacgagtgc

SEQ ID NO: 23511 - RNA, 1347 nt, synthetic construct
  misc_feature 1..1347: note = derived and/or modified sequence opt3 from Namilumab_HeavyChain1
  source 1..1347: mol_type = other RNA
caggtgcaactggtccagagcggcgccgaggttaagaaacccggggcttccgtgaaggtatcttgcaaagcattcggatacccttttaccgactatctccttcactgggtgagacaggccccaggtcagggcctggaatgggtcgggtggttgaacccgtactcaggagatacaaattatgcgcaaaagttccagggcagggtgactatgacgcgggacaccagtatcagcacagcttacatggagttatcccgcctgcgatctgatgacactgccgtttattactgtacccgtacaaccctaatttcggtgtattttgattactggggtcaggggactatggtcacagtgtcaagcgcaagtaccaaaggaccctccgtattccctctcgccccatctagcaagtccacgtcaggcggcactgctgcactggggtgccttgttaaggactactttcccgaacctgtgaccgtcagttggaacagcggagccctgacatctggtgtgcatactttcccagctgtgttgcagtcctcaggcctctatagcctgagttctgtcgttaccgtgccctccagctcgctggggacacaaacctacatatgtaatgtaaaccacaaaccttctaatacgaaggtggataaaaaggtcgagccaaaatcctgcgacaagactcatacatgtccgccctgccctgccccagaactcttaggaggcccctcagtgtttctgttccctccaaagcccaaagatacccttatgatcagtagaactccggaggttacatgtgtggtcgtggacgtaagccacgaggatcctgaagttaagtttaactggtatgtggacggtgtcgaggtgcataatgcgaaaaccaagcccagggaggaacagtacaactccacgtatcgggtcgtgtctgttttgaccgtgctgcaccaggattggctaaatgggaaagagtacaagtgcaaagtaagcaacaaggcactcccagcccctattgaaaagacaatctcaaaagctaagggacagccccgcgagccacaagtctatactctgccccctagtagagacgaacttaccaaaaatcaggtgtccctgacatgtttggttaagggcttctacccaagcgacattgccgtggagtgggaatctaacggccagccggagaataactacaaaactacaccccctgtcctcgattcagacgggagctttttcctgtatagtaagttaaccgtggataagtccaggtggcaacagggaaatgtattttcttgctcggtgatgcacgaggcactgcataaccactacacccagaaaagcctctccctttcaccaggtaag

SEQ ID NO: 23512 - RNA, 642 nt, synthetic construct
  misc_feature 1..642: note = derived and/or modified sequence opt3 from Namilumab_LightChain1
  source 1..642: mol_type = other RNA
gacatccagatgacccaaagcccctcctctgtgtcagccagtgtcggcgatagagttacaattgcttgcagggcaagccagaacatacggaatatcctgaactggtaccagcagcgccctgggaaggccccacaactccttatttatgcggcttccaatctgcagtctggagtgccgtcgcgattctcaggtagcggcagtgggactgactttacgttgaccatcaactccttacagcccgaggatttcgccacatactattgtcagcaatcttacagcatgcctcgtacttttggaggcggtaccaaactggaaattaagagaacagtagcagccccatccgtgttcatctttcccccttcagacgagcagctaaaaagtgggaccgctagcgtcgtgtgcctcctgaataacttctatccaagggaagcaaaggttcagtggaaagtggataatgcccttcagtctggaaactcccaagagtcagtcactgaacaggacagcaaggatagtacatactctctgtccagcaccttgacgctctcgaaggctgactatgagaaacacaaggtgtacgcctgtgaggtaactcatcagggcctgtcttcccccgttaccaaatcatttaatcggggcgaatgc

SEQ ID NO: 23513 - RNA, 1374 nt, synthetic construct
  misc_feature 1..1374: note = derived and/or modified sequence opt3 from Naptumomab_estafenatox_HeavyChain
  source 1..1374: mol_type = other RNA
gaggtgcagctgcaacagagcggccccgacctcgtcaagcctggggcctccgttaaaatctcttgcaaggcttcaggatacagtttcaccggttattacatgcactgggtgaaacagagcccaggcaaggggcttgaatggattggaagaataaacccgaataacggcgtaacactgtataatcagaaatttaaggataaggcaactttgacggtggacaaatcctctaccacagcctacatggagttaaggtcgctgacttcagaagatagcgcggtctattactgtgctcggagtaccatgatcacaaactatgtgatggactactggggtcaagggacctccgttactgtgtctagcgccaagacaacgcccccttccgtctacccactagcacccggatcagccgctcagaccaatagtatggtgactctcggctgcctggtaaaaggctatttccctgagccagttaccgtgacatggaacagcgggtctctttcctcaggagtccatacttttcccgcagtgctgcagagcgatttgtacaccctcagttcttccgtgacagtccctagctcgacctggccatctgaaacggttacttgtaatgtggcccacccggcttcctcaacaaaggtagacaaaaagattgtgccccgcgatagtggtggccctagcgagaagtccgaggaaatcaacgagaaagacctgcgaaagaaatctgaactgcaggggaccgccctcggaaatttaaagcaaatttattactataacagcaaagcgatcacttcaagtgagaagtccgcagatcagttcctgacaaatacccttttgtttaaaggcttctttacgggtcatccatggtacaacgacctgctagtcgatctcgggagcaccgccgctacatctgagtatgaaggatcaagtgtggacctgtacggcgcctactatggctaccagtgcgcagggggaactcccaataagaccgcttgtatgtatggtggcgttacacttcacgataacaatcgtctgactgaggaaaagaaagtgcctataaacttgtggatcgacgggaagcagaccacagtcccaattgacaaagtgaagaccagcaaaaaggaggtaactgttcaagaactcgatctgcaggccagacattacttacacggaaagttcggcctgtataactccgactcttttggtgggaaagtgcagaggggcctcatcgtcttccactcgagcgagggatccacggtgtcatacgatctttttgacgcgcaaggccagtatcccgatacactgttgcggatttaccgcgacaataccactatcagttctaccagcctatccatatcactgtacctctatacaacc

SEQ ID NO: 23514 - RNA, 642 nt, synthetic construct
  misc_feature 1..642: note = derived and/or modified sequence opt3 from Naptumomab_estafenatox_LightChain
  source 1..642: mol_type = other RNA
agcatcgtgatgacccagacacccacttccctgctcgtctctgccggcgacagagttacgattacctgcaaggcttcacaaagtgtgagcaacgatgtagcatggtaccagcagaaacctgggcagtccccaaaacttctgatatcttatacatcgtcaaggtacgccggagtgccggaccggttcagcggtagtggctatgggactgattttaccttgacaatctcctctgtccaagcggaggacgctgccgtgtacttctgtcagcaggattataatagccctcccacctttggaggcggtactaagttagaaattaagcgcgcagacgccgctccaacagtttccatctttcccccttcaagtgagcagctgaccagcgggggagcatctgtggtctgcttcctaaacaatttctacccaaaagatattaacgtgaagtggaagatcgacggctccgaacgacaaaatggcgtactcaactcatggacggatcaggacagcaaagatagtacttattctatgtccagcaccctgacacttactaaggacgagtacgaacgtcacaattcgtacacctgtgaggccacacataaaacctctacgtcccccatagttaagtcatttaacagaaatgagagt

SEQ ID NO: 23515 - RNA, 1356 nt, synthetic construct
  misc_feature 1..1356: note = derived and/or modified sequence opt3 from Narnatumab_HeavyChain1
  source 1..1356: mol_type = other RNA
gaggtgcagctggtcgaaagcggcgggggactcgttcaacccggtggctcccttagactgtcttgcgccgcttcagggttcacctttagtagctacttgatgacatgggtgaggcaggcacctggaaagggcttagagtgggtagccaacatcaaacaggacggttccgaaaagtattacgtggattctgtcaaagggcggttcactatttcgcgcgacaatgcgaagaactcactgaatctacagatgaacagcctccgagctgaggatacggccgtgtattactgtacccgtgacggatatagttccggcagacactacggcatggatgtttgggggcaaggaacaactgtgatagtctctagcgcatccaccaaaggtccatcagtgtttccgctggcccccagtagcaagtctacatccggcgggaccgctgcacttggatgcctggtaaaggactatttccctgaaccagttactgtgtcatggaatagcggcgccttgacaagtggtgtccatacctttcccgctgtgctccagtcttccgggctgtacagcctgtcgtctgtggtcacggttccttcctcaagtctcggaactcagacctacatctgtaacgtgaatcacaaaccaagcaacacaaaggtagataaaagggtggagcccaagtcctgcgacaaaactcatacctgtcctccatgcccggcccccgagttactgggcggcccttctgtcttcctttttccacccaagcctaaggatacattgatgattagccggaccccagaagtgacgtgtgttgtggtcgacgtgtcacacgaggatcccgaagtaaaattcaattggtatgttgacggggtggaggtccataacgcgaagactaaaccgcgcgaggaacagtacaatagtacatatagagtggtctccgtgctgaccgttctacaccaagattggctcaacggaaaggagtacaaatgcaaggtgagcaataaagcactgcctgcccccatcgaaaagactatttctaaggctaaaggtcagccaagggagcctcaggtatatacacttcccccatcacgggaagagatgaccaagaaccaggtcagtctgacgtgtttggtgaaaggcttttaccccagcgacatcgccgttgagtgggaatccaatgggcaacctgagaacaactataagaccacaccaccggtgctcgactctgatggatcgttctttctgtacagcaaattaactgtcgacaagtcccgctggcagcagggcaatgtgttctcatgcagtgtaatgcacgaagcactgcataaccactacacccaaaagtctctcagcctttcccccggtaaa

SEQ ID NO: 23516 - RNA, 642 nt, synthetic construct
  misc_feature 1..642: note = derived and/or modified sequence opt3 from Narnatumab_LightChain1
  source 1..642: mol_type = other RNA
gagatcgtgctgacccagagccccgccacactctccctttctcctggcgaaagagctactctgtcatgcagggcaagtcaaagcgtctcccggtacttggcctggtatcagcagaagccagggcaggcgccgcgcttactgatttacgacgcttctaaccgagccacgggaatacccgcacgtttctcgggttcaggcagcgggaccgattttacactaactatcagttccctcgagcctgaagacttcgccgtttattactgtcaacagagatctaattggccaaggacctttggacagggcacaaaagtggagattaagcggaccgtagctgcacccagcgtgttcatctttcctccatccgatgaacagctgaaatcaggtactgccagtgtcgtgtgccttctgaacaatttctatccccgcgaggctaaggttcaatggaaagtggacaacgccttgcagagcggaaattctcaggagtccgtcacagaacaggattcaaaggacagcacctacagtctctcttccacgctgactctgagcaaggcggattatgagaaacacaaggtgtacgcatgtgaagtaacccatcaagggctctcgtctcctgttacaaaatcctttaacagaggcgagtgc

SEQ ID NO: 23517 - RNA, 1350 nt, synthetic construct
  misc_feature 1..1350: note = derived and/or modified sequence opt3 from Natalizumab_HeavyChain1
  source 1..1350: mol_type = other RNA
caggtgcaactggtccagagcggcgccgaggttaagaaacccggggcttccgtgaaggtatcttgcaaagcatcaggattcaacatcaaggacacctacattcactgggtgagacaggcccctggtcagaggctcgaatggatgggccggatagatccagcgaatgggtatacaaaatacgacccgaagtttcaaggacgcgtcactatcacggctgataccagtgccagcacagcatatatggagctttcctctctgcgatcggaagacactgccgtgtactattgtgctcgtgagggctactatggtaactacggggtttacgcaatggattattggggacagggcaccttggtgacagtctcaagcgccagtaccaagggcccctccgtgttccctttagctccatgctctagaagcacttccgaatcaacagccgcgctggggtgtctagtaaaagactactttcccgagcctgttaccgtgagttggaatagcggagcactcacgtctggtgtccatactttcccagccgtgctgcagtcctcaggcctttatagcctgagttctgtggtcaccgttccctccagctcgttggggacaaagacttatacctgcaacgtggatcacaaaccttctaatacaaaggtagacaaaagggtggagtccaagtacggaccaccgtgtccctcatgccctgctccagaatttctcggcggtcccagtgtcttcctgtttcctccaaagcccaaagataccctgatgattagccggacgccggaggtgacttgtgttgtggtcgacgtgtcccaggaagatcctgaggtacaattcaactggtacgttgacggggtggaggtccataatgccaagacaaaaccccgcgaggaacagtttaactctacctatagagtggtcagcgtgctcactgttttacaccaggattggctgaatggaaaggaatacaaatgcaaggtgtcaaacaaaggccttccaagttccatcgagaagacaattagcaaggcaaaaggccagcctagggaaccccaagtatacaccttgccaccctctcaggaggagatgacgaagaatcaggtctcactgacctgtctagtgaaagggttctatcctagtgacatcgctgttgaatgggagagcaacggacaaccagaaaataactacaagacaactccgcccgtgctcgactccgatggttcgtttttcctgtattctcggcttaccgtcgacaaaagccgctggcaggagggcaatgtgttttcctgctcagtaatgcatgaagccctgcacaaccactacacacagaagagtttgtctctcagcctggggaag

SEQ ID NO: 23518 - RNA, 639 nt, synthetic construct
  misc_feature 1..639: note = derived and/or modified sequence opt3 from Natalizumab_LightChain1
  source 1..639: mol_type = other RNA
gacatccagatgacccaaagcccctcctctctgtcagccagtgtgggcgatagagtcacaattacttgcaagacgagccaggacataaacaaatacatggcttggtatcagcagacccctgggaaggcaccaaggctccttatccactacacatccgccctgcaaccgggtattccctctcggttctcgggatcaggcagcgggcgcgattatacttttaccatcagttccttgcagcctgaggacattgcgacatactattgtttacagtacgataatctgtggaccttcggacagggcactaaagttgaaatcaagcgaacagtggctgccccatctgtatttatatttccccctagcgacgagcaactaaaatccggtaccgcatcagtggtctgcctcctgaacaatttctatccacgtgaagccaaggtgcagtggaaggttgataacgcacttcagagtgggaatagccaggagtctgtgacggaacaagactccaaagattcaacttacagcctgagttctaccttgacactctccaaggctgactacgagaaacataaggtctatgcctgtgaggtgactcaccagggactgagctcgcccgtaaccaaatctttcaacagaggcgaatgc

SEQ ID NO: 23519 - RNA, 1335 nt, synthetic construct
  misc_feature 1..1335: note = derived and/or modified sequence opt3 from Navicixizumab_HeavyChain1
  source 1..1335: mol_type = other RNA
caggtgcaactggtccagagcggcgccgaggttaagaaacccggggcttccgtgaagatctcttgcaaagcatcaggatacagtttcaccgcctattacattcactgggtaaagcaggcgcctggtcagggcctcgaatggatagggtatatcagcaactacaatagagctacaaactataatcaaaaatttaagggaagggtgactttcacgaccgacacatccacttctaccgcctacatggagcttcggtcgctgcgctcagatgacacagcagtctattactgtgcccgagattacgactatgatgtgggcatggactactggggtcaggggaccttggttactgtgagcagtgcttccacaaagggaccatctgtctttccgttagcaccctgcagccgttccacctcagaaagtacggccgctctgggctgtctagtgaaagattatttccctgagccagtaactgttagctggaactctggcgccctcacctccggggtgcatacatttcccgcggtcctgcagtcaagcggactttacagtctgtcttccgtggtgactgtccctagctcgaatttcggtacccagacatatacctgcaacgttgaccacaagccatctaatacgaaagtggataagactgtagaaagaaaatgttgcgtggagtgtcccccttgcccagcaccgcccgtcgccggcccttccgtgtttttgttcccacccaagcctaaggacacactcatgatttcaaggaccccagaggttacttgtgtggtcgtggatgtaagtcatgaagaccccgaggttcaatttaactggtacgtggatggggtcgaagtgcacaatgctaaaacaaagccgcgggaggagcagttcaacagcacctttcgcgtcgtgtccgttctgacggtggtacatcaggactggctgaatggaaaagaatataagtgcaaagtctctaacaagggcctccctgcccccatcgagaaaaccattagcaagacaaagggtcagccaagagaacctcaagtgtacactttacccccatcaagggaggaaatgaccaaaaatcaggttagtctgacatgtcttgtggaggggttctacccctccgacatcgcagtcgagtgggaaagcaacggacagcctgagaataactataagactaccccaccgatgttggattctgacggctcatttttcctgtacagtgaactaacagtggataaaagccggtggcaacagggcaacgtattctcctgctctgtgatgcacgaggctctccacaatcattatacccagaagtcgctgagcctttcccccgggaaa

SEQ ID NO: 23520 - RNA, 1341 nt, synthetic construct
  misc_feature 1..1341: note = derived and/or modified sequence opt3 from Navicixizumab_HeavyChain2
  source 1..1341: mol_type = other RNA
caggtgcaactggtccagagcggcgctgaggttaagaaacccggggcttccgtgaaggtatcttgcaaagcatcaggatacaccttcacaaactattggatgcactgggtgagacaggcccctggtcagggcctcgaatggatgggggacatcaatccaagtaacggaaggactagctacaaggagaaatttaagcggcgcgtcacgctttccgtggataagtcttcgtcaaccgcgtatatggaactgagcagtttgcgatccgaggacacagctgtttacttctgtactattcattatgatgacaaatactatccgttaatggattactggggccaaggtaccctggtgacagtctctagcgcctccaccaaggggccctcagtgtttcctctagcaccatgcagtcgtagcacttctgaatccacagccgctctcggatgtctggtaaaagactacttccccgagcctgttaccgtgtcatggaatagcggcgcacttacgagtggcgtccacacttttccagccgtgctgcagtcttccgggttgtatagcctctcgtctgtggtcaccgttccctcctcaaacttcggaacacagacttatacctgcaatgtggatcataagcctagtaacacaaaagtagacaagaccgtggagagaaagtgttgcgtcgaatgtccaccgtgccccgctcctccagtggccggtcccagcgtttttctgttccctccaaaacccaaggatacgctgatgatatccaggactccggaggtgacatgtgtcgtggtagacgtttctcacgaagatcctgaggtgcagtttaattggtacgtcgacggcgtggaggtccataacgcgaaaaccaagccccgggaggaacaattcaatagcacttttcgcgtggtttcagtgctcacagtagtccaccaggattggttaaacgggaaagaatacaagtgcaaagtgagtaataagggactgccagcacctatcgagaagaccatttccaaaacgaagggccagcccagagaaccacaggtttatacccttccccctagcagggagaaaatgacaaagaaccaagtgtctttgacttgtctggtcaaaggtttctacccatcagacatcgccgtggagtgggaaagtaatgggcagccggagaacaattataagaccacaccccctatgctaaagagcgacggatcctttttcctctactctaaactgactgtagataagtcgcggtggcagcaaggcaacgtgttcagctgctccgttatgcacgaagcccttcataaccactacacccagaaatcactgagtttgtctccaggcaag

SEQ ID NO: 23521 - RNA, 654 nt, synthetic construct; identical to SEQ ID NO: 23125
  misc_feature 1..654: note = derived and/or modified sequence opt3 from Navicixizumab_LightChain1
  source 1..654: mol_type = other RNA

SEQ ID NO: 23522 - RNA, 1368 nt, synthetic construct
  misc_feature 1..1368: note = derived and/or modified sequence opt3 from Navivumab_HeavyChain1
  source 1..1368: mol_type = other RNA
caggtgcaactggtccagagcggcgccgaggttaagaaacccggggcttccgtgaaggtatcttgcaaaacctcaggatacagtttcagcacatatggtgtgtcctgggtcagacaggcacctggccaggggccagaatgggtgggatggatctctgcctacactggcattacggactatgcgcaaaagtttcagggtagggttaccctcacaactgatgctaccacagccaccgcattccttgacctgcggtcgttgcgcccggatgacactgccacatacttttgtgctcgagataaagtgcaggggcgtgtcgaggtgggatcaggcggcagacacgactattgggggcagggaaccttagtaatagttagcagtgcatccacgaagggtccctctgtgttccctctggccccaagctccaagtcaacttcgggcgggaccgctgccctaggatgcctcgtcaaagattactttcccgaacctgtgacagtgagctggaactctggcgcgctgacttccggtgtccataccttcccagcagttcttcaatcaagcgggctgtatagtttgtcttccgtggtaacagtgcccagctcgtctctcggaacccagacgtacatctgtaatgtcaaccacaagccttccaatactaaagtggacaagaaagttgagccaaagtcatgcgataagacacatacctgtccgccctgccctgccccagaactgctgggcggccccagtgtgtttctcttccctccaaaacccaaggacactttaatgattagcaggacaccggaggtcacctgtgtggtagttgatgtgtcccacgaggaccctgaagtcaaatttaactggtacgtggatggggtcgaggtgcataatgctaagacgaaaccccgggaagaacagtataactctacctaccgcgttgtgagcgtactgacagtccttcaccaggactggttgaatggaaaggagtataaatgcaaggtgtcaaacaaggccctgccagcacctatcgagaaaactattagtaaggctaaaggtcaacccagagagccacaggtttacaccctacccccttccagggacgaactcacaaagaatcaggtgagcctgacttgtcttgtcaaaggcttctatccatctgatatcgccgtggagtgggaatcaaacgggcaaccggagaataactacaagaccacaccccctgtactggacagtgatggcagctttttcttgtattccaagctcaccgtggacaaatctcggtggcagcagggaaatgtttttagttgcagcgtcatgcacgagggtctgcataaccactacactcagaagtccttatcactgagtccagggaaa

SEQ ID NO: 23523 - RNA, 645 nt, synthetic construct
  misc_feature 1..645: note = derived and/or modified sequence opt3 from Navivumab_LightChain1
  source 1..645: mol_type = other RNA
gaggtggtcctgacccagagccccggcacactcgcccttcctccaggggaacgggctactctgtcctgcagggcatctcaccgggttggatcaacgtacatcgcctggtatcaacagaagagtggtcaggcgccgcgccgattgatttacggcgctagcaaccgtgccaccgacatacccgatagattctccgggtctggatcgggcacagactttactttaaccatcaggcggctggagcctgaagattcagcagtgtattactgtcagcaattcagcgtaagtccatggacatttggtcaggggacccgcgtggagattaaaagaactgtcgccgctccctccgtgttcatctttcctccatctgacgaacagctaaagagcggaacagcatccgttgtgtgcctcctgaataacttctatcccagggaggccaaagtccagtggaaggtggataatgcccttcaatcaggcaacagtcaggagagcgtaaccgaacaggactctaaagattccacgtactcactgagcagtactttgaccctctctaaggctgactatgagaagcataaagtttacgcgtgtgaagtgacacaccagggcctgtccagccctgtcactaagtcgtttaatagaggggagtgc

SEQ ID NO: 23524 - RNA, 2172 nt, synthetic construct
  misc_feature 1..2172: note = derived and/or modified sequence opt3 from Ndimab-varB_HeavyChain
  source 1..2172: mol_type = other RNA
caggtgcaactggtcgagagcggcgggggagttgtgcagcccggtagatccctcaggctttcttgcgccgcttcaggcttcatctttagtagctacgcaatgcactgggtacggcaggcccctgggaacggactggaatgggtggcgttcatgtcctatgacggctctaataagaaatacgctgattcggtcaagggtcgctttaccatttcacgagacaacagcaaaaatacattgtatttacagatgaacagtctgcgtgccgaggatactgcagtgtactattgtgccagagacagggggatatccgctggaggcaattactattactacggcatggatgtttgggggcaaggaacgaccgtgacagtctctagcgcatccactaagggtccatcagtgttcccgctagcccccagtagcaaatctacctccggcgggacagctgccctcggatgcctggtaaaggactattttcctgaaccagttaccgtgtcatggaacagcggcgcgcttacaagtggtgtccatacattccccgcagtgctgcagtcttccgggttgtacagcctctcgtctgtggtcaccgttccttcctcaagtctgggaacgcagacttatatctgtaatgtgaaccacaagccaagcaataccaaagtagataagcgggtggagcccaaatcctgcgacaagacacatacttgtcctccatgcccggcccccgaactgctcggcggcccttctgtctttttattcccacccaaacctaaggataccctgatgattagccgcacaccagaggtgacctgtgttgtggtcgacgtgtcacacgaggatcccgaagtaaagtttaactggtacgttgacggggtggaggtccataatgctaaaacgaagccgagagaggaacagtataacagtacttacagggtggtctccgtgcttacagttttgcaccaagattggctgaatggaaaagagtataagtgcaaagtgagcaacaaggccctacctgcacccatcgaaaagaccatttctaaggctaagggtcagccacgggagcctcaggtatacactcttcccccatcacgcgaagagatgactaaaaatcaggtcagtctgacctgtcttgtgaagggcttctaccccagcgacatcgccgttgaatgggagtccaacgggcaacctgagaacaattataaaacgaccccaccggtgctggactctgatggatcgtttttcttgtacagcaagctcacagtcgacaaatcccgatggcagcagggcaacgtgttttcatgcagtgtaatgcacgaagcgctgcataatcactatactcaaaagtctttaagcctgtcccccggtaaagggggcggaggctcagggggaggtggcagccaggtgcagctcgttcagtctggggccgaggtcaaaaagcctggatccagtgtgaaagtgagctgtaaggcatctggcggtaccttctccacatacgggatatcatgggtcagacaagctccaggccagtgccttgaatggatgggaggcatcattcccatcttcgatactgggaacagtgcccagagctttcagggaagggttaccattacagctgacgagtcgacctccactgcctatatggaactgtctagcttgcggtcagaggatacggcagtgtactattgcgcccgtagttcccgcatctacgacctaaatccttctctgacagcttactatgatatggacgtgtggggtcaaggcaccatggtaactgtcagctccgggggaggcggttcagggggcggaggcagcgggggaggcggtagtgggggaggcggttctcagtccgtgctcacccagccacccagcgtttcggcggcaccgggccagaaagtgacaatatcatgttctgggagttccagcaacattggaaataactacgtctcttggtatcaacagctgcctggcaccgccccaaagctcctgatctacgataataacaagagacccagcgggattcctgacaggttctccggatcaaaaagtggcactagcgctacattgggtatcacggggctccagaccggagatgaggccgactattactgcggcacttgggactcttccctgtcagcatgggtgtttggttgtggcacaaagttaaccgttctg

SEQ ID NO: 23525 - RNA, 645 nt, synthetic construct
  misc_feature 1..645: note = derived and/or modified sequence opt3 from Ndimab-varB_LightChain
  source 1..645: mol_type = other RNA
gagatcgtgctgacccagagccccgccacactctccctttctcctggcgaaagagctactctgtcatgcagggcaagtcaaagcgtctactcctatttggcctggtaccagcagaagccagggcaggcgccgcggttactgatttatgacgcttctaaccgcgccataggaatccccgcacgattctcgggttcaggcagcgggacggattttaccctaacaattagttccctcgagcctgaagacttcgccgtttactattgtcaacagcgttctaattggccaccctttactttcggacctggcaccaaagtggatatcaagagaacagtagctgcaccaagcgtgtttatttttcccccttccgacgagcagctgaaatcaggtaccgccagtgtcgtgtgccttctgaacaatttctacccaagggaagctaaggttcagtggaaagtggataacgccttgcaaagcggaaattctcaggagtccgtcactgagcaggactcaaaggatagcacatatagtctctcttccaccctgacgctgagcaaggcggactacgaaaaacacaaggtgtacgcatgtgaggtaactcatcaggggctctcgtctccggttaccaaatccttcaaccggggcgaatgc

SEQ ID NO: 23526 - RNA, 1353 nt, synthetic construct
  misc_feature 1..1353: note = derived and/or modified sequence opt3 from Necitumumab_HeavyChain1
  source 1..1353: mol_type = other RNA
caggtgcaactgcaggagagcggccccgggctcgtcaagccttcccagaccctttctctgacatgcactgtttcaggaggtagtatcagctccggcgactactattggtcttggattagacagccaccggggaaaggattggaatggataggctacatctattactcgggttcaacggattataaccccagcttaaagagtagggtgaccatgtccgtagacacatctaaaaatcaattcagcctgaaggtgaactccgtcactgccgctgataccgcagtgtactattgtgcccgggtttcaatttttggggtgggaacattcgactactggggccagggcaccctagtcactgtgagtagcgcgtctacaaaagggccttccgtactcccactggctccctcaagcaagagtacctctggaggtacggccgcacttggctgcctggttaaggattactttcctgagccagtgactgtctcctggaatagcggggccttgacctcgggagtgcacacattccccgctgtgctccagtcttccggcctgtattcactgagtagcgtcgttactgtgccttcctctagcctcggtacccagacatacatctgtaacgtaaatcataaaccatcaaacaccaaggtggacaaacgcgtcgaaccgaagagttgcgataaaacgcacacttgtcccccttgcccagcacccgagttacttgggggaccttccgtgtttctgttcccacccaagccgaaggacacattgatgattagccgaacccctgaagttacttgtgtggtcgtggatgtatctcatgaggaccccgaggttaaatttaattggtatgtggatggcgtcgaagtgcacaacgccaagacaaaaccacgtgaggaacaatacaattcaacctatagagtcgtgagtgttctgacggtgctacatcaggactggctcaacggcaaggagtacaaatgcaaggtaagcaataaagctctgcctgcccccatcgagaagaccatatccaaggcgaaagggcagccaagggaaccccaggtctatacacttcctccatctcgggaggaaatgactaagaaccaagtgtcgctgacctgtttggttaaaggattctacccgagcgatatcgcagtggagtgggaatccaatggtcagcccgagaacaattacaagacaactcctccagtcctcgactcagacggcagctttttcctgtattctaaattaaccgtggataagagccgctggcagcaagggaacgtattttcctgctcagtgatgcacgaggccctgcacaaccattacacacagaagagtctctctctttcccccggaaaa

SEQ ID NO: 23527 - RNA, 642 nt, synthetic construct
  misc_feature 1..642: note = derived and/or modified sequence opt3 from Necitumumab_LightChain1
  source 1..642: mol_type = other RNA
gagatcgtgatgacccagagccccgccacactgtccctctctcctggcgaaagggctactctttcatgcagggcaagtcaaagcgtctcctcttacctggcctggtatcagcagaagccagggcaggcgccgcggttgttaatttacgacgcttcgaaccgcgccacgggaatacccgcacgattctcaggtagcggcagtgggaccgattttacactgactatctcctctctagagcctgaagacttcgccgtttattactgtcaccaatatggaagcaccccactcacatttggcggtgggaccaaagctgagattaagcgtactgtggcagccccctccgtattcatctttcctccatcagatgaacagctgaaaagtggaacagctagcgtggtctgccttctgaataacttctaccccagagaggccaaggtgcagtggaaagttgacaatgcgttgcagtctggcaactcccaagagtcagtgaccgaacaggatagcaaggacagtacgtattctctctccagcactctgaccctgtcgaaggcagattacgagaaacataaggtctacgcctgtgaagtgacacaccagggcctctcttcccctgtaactaaatcatttaatagaggggagtgc

SEQ ID NO: 23528 - RNA, 396 nt, synthetic construct
  misc_feature 1..396: note = derived and/or modified sequence opt3 from Neliximab_HeavyChain_VH-Region
  source 1..396: mol_type = other RNA
gaggtgcagctgcaacagagcggccccgaactcgtcaagcctggggcctccgttaaaatgtcttgcaaggcttcaggatacaccttcaccacttatgtgatgcactgggtaaaacagaagccaggtcagggccttgagtggatcgggtacattaacccgtataatgacggaacgaactacaatgaaaaatttaagggcaaggcaaccctgacaagtgataaaagctcctctactgcctatatggagttgtcgaccttaacatcagaagacagcgcggtgtactattgtgctgagttcataaccaagactgtcggtgggagtaactggtacctggatgtgtggggagccggcacaaccgttacggtgtcctctgcaaaaactacaccccctaagcta

SEQ ID NO: 23529 - RNA, 372 nt, synthetic construct
  misc_feature 1..372: note = derived and/or modified sequence opt3 from Neliximab_HeavyChain_VH-Region_variant1
  source 1..372: mol_type = other RNA
caggtgcaactgaagcagagcggccccgaactcgtcaaacctggggcctccgttaagatgtcttgcaaggcttcaggatacaccttcacaacttatgtgatgcactgggtaaaacagaaaccaggtcagggccttgaatggatcgggtacattaacccgtataatgacggaacgaactacaatgagaagtttaagggcaaagcaaccctgacaagtgataagagctcctctactgcctatatggaattgtcgaccttaacatcagaggacagcgcggtgtactattgtgctgagttcataaccaaaactgtcggtgggagtaactggtacctggatgtgtggggagccggcacaaccgttacggtgtcctct

SEQ ID NO: 23530 - RNA, 318 nt, synthetic construct
  misc_feature 1..318: note = derived and/or modified sequence opt3 from Neliximab_LightChain_VL-Region
  source 1..318: mol_type = other RNA
gacatcgtgctgacccagagccccgccattatgtccgcttctcctggcgagaaggtcacaatgacttgctcagcaagtagctccatatcttacatccactggttccaacagaaaccagggacgtcgccgaagagatggatttatgatacctcaaaactccccagcggagttcctgccaggtttagtggttccggctctgggacaagctactcccttactatctcaagtatggaagcggaggacgctgccacctattactgtcatcagcggagctcttatacatggaccttcggaggcggtactaagctggaaattaaa

SEQ ID NO: 23531 - RNA, 354 nt, synthetic construct
  misc_feature 1..354: note = derived and/or modified sequence opt3 from Neliximab_LightChain_VL-Region_variant1
  source 1..354: mol_type = other RNA
cagatcgtgctgacccaaagccccgccattatgtccgcttctcctggcgagaaggtcacaatgacttgctcagcaagtagctccatatcttacatccactggttccagcagaaaccagggacgtcgccgaagagatggatttatgacacctcaaaactccccagcggagttcctgccaggtttagtggttccggctctgggacaagctactcccttactatctcaagtatggaagcggaggatgctgccacctattactgtcatcagcggagctcttatacatggaccttcggaggcggtactaagctggaaattaaacgcgcagacgccgctccaacagtgtccgcagccgct

SEQ ID NO: 23532 - RNA, 1335 nt, synthetic construct
  misc_feature 1..1335: note = derived and/or modified sequence opt3 from Nemolizumab_HeavyChain1
  source 1..1335: mol_type = other RNA
caggtgcaactggtccagagcggcgccgaggttaagaaacccggggcttccgtgaaggtatcttgcaaagcatcaggatacaccttcacaggttatatcatgaactgggtgagacaggcccctggccaggggctcgaatggatgggacttattaatccatacaacggcggtactgactataatccgcaatttcaggatagggtcacgataaccgcggacaagagtacaagcactgcttacatggagctgtcctctttgcggtcggaagataccgccgtgtattactgtgcacgcgacgggtatgatgacggaccctacacattagagacctggggccagggcactctggttacagtgtcaagcgccagtaccaaagggccttccgtcttcccactagctccctctagcaagtccacgtcaggaggtactgcagccctcggctgcctggtgaaggattactttcctgaaccagtaaccgttagttggaacagcggggctcttacatctggagtgcacactttccccgccgtcctgcagtcctcaggcttgtatagcctcagttctgtggtgaccgtcccttccagcaattttggtacacaaacctacacgtgtaacgttgaccataaaccatcgaatactaaggtggataaaacagtagagcgaaagtcttgcgtggagtgtccgccctgccctgcgccacccgtcgcagggccttccgtgttcctgtttccacccaaaccgaaggacaccctgatgatctcacgtactcctgaagttacatgtgtggtcgtggatgtaagtcaggaggaccccgaagttcagttcaactggtatgtggatggagtcgaggtgcacaatgccaagaccaaaccaagagaggaacagtttaacagcacgttcagggtcgtgtccgttctcaccgtggtacatcaagactggttaaatggcaaggagtacaaatgcaaggtctctaacaaaggcctgcctgctcccattgaaaagacaatcagcaaaactaaggggcagccacgggagccccaggtgtatacccttcctccatcacaagaagagatgacaaagaatcaggttagtttgacttgtctggtgaaaggattttacccgtccgacattgccgtcgagtgggaaagcaacggtcagcccgagaataactataagaccacacctccaatgctagattctgacggctcattctttctctacagtaaactgaccgtggataagagccgctggcaggaagggaacgtattctcctgctctgtgatgcacgaggcacttcataatcactacactcaaaaatcgctgagcttgtccccc

SEQ ID NO: 23533 - RNA, 642 nt, synthetic construct
  misc_feature 1..642: note = derived and/or modified sequence opt3 from Nemolizumab_LightChain1
  source 1..642: mol_type = other RNA
gacatccagatgacccaaagcccctcctctctgtcagccagtgtgggcgatagagtcacaattacttgccaggctagcgaggacatatactccttcgttgcatggtatcagcagaagcctgggaaagccccaaagctccttatctacaacgcgcaaacggaagctcagggagtgccgtctaggttttcgggttcaggcagcgggaccgatttcacactgactattagttccttgcagcccgaggactttgccacctattactgtcagcaccattatgattctcctttaacattcggaggcggtaccaaagtagaaatcaagcggactgtggcagccccaagcgtctttatttttcccccttccgacgagcaactgaaatcagggacagctagtgtggtttgcctactcaataacttctacccacgcgaagcaaaggtgcagtggaaggtcgataatgccctgcagagcggaaactctcaggagtccgtgaccgagcaagactcaaaagatagcacgtatagtctttcttccactctgaccttgagcaaggctgactacgaaaaacacaaggtatacgcctgtgaggttacacatcagggcctctcgtctcccgtgactaaatccttcaatcgaggcgaatgc

SEQ ID NO: 23534 - RNA, 1356 nt, synthetic construct
  misc_feature 1..1356: note = derived and/or modified sequence opt3 from Nesvacumab_HeavyChain1
  source 1..1356: mol_type = other RNA
gaggtgcagctggtcgaaagcggcgggggactcgttcaacccggtggctcccttagactgtcttgcgccgcttcagggttcacctttagtagctacgacatccactgggtgaggcaggcaacaggaaagggcttggagtgggtatccgccattggtcctgcgggggatacttattacccaggatctgtgaaaggccggttcacgatatcgcgcgaaaacgctaaaaattcattatatctgcagatgaacagcctacgagccggcgacaccgcagtctactattgtgcccgtgggctcatcacatttggaggtctgattgctccgttcgattactggggccaggggactcttgtgaccgttagttccgcatctacaaagggacccagcgtgtttcctctggccccatcctcaaagagtaccagcggcggtactgctgccttggggtgcctcgtcaaagactatttccccgagcctgtgacagtatcttggaactccggagcgctgacctcaggcgttcatacgtttccagcagtgctgcaaagcagtggcctctactctttatccagcgtcgtgactgtgccctcgtcttccctggggacccagacatacatctgtaatgtcaatcacaagccttcaaacactaaggttgataaaaaggtggaaccaaaaagttgcgacaagacccatacatgtccgccctgccctgccccagagcttttgggaggtcccagcgtattcctgtttcctccaaaacccaaggataccctaatgatttccagaacgccggaggtgacttgtgtcgtggttgacgtgtctcacgaagatcctgaggtcaagttcaattggtatgtggacggcgtagaagttcataacgctaaaacaaagcccagggaggagcagtacaatagcacctatcgggtggtctcagtgctcactgtcctgcaccaggattggcttaacgggaaagaatacaagtgcaaagtgagtaataaggccctgccagcacctatcgagaaaacaatatccaaggctaagggacaaccccgcgaaccacaggtttataccttgccccctagcagagacgagctcacgaaaaaccaggtgtctctgacctgtttagtaaagggcttttacccatcagatatcgccgtcgaatgggagagtaatggtcagccggagaacaattataaaacaactccccctgtgctggacagcgacgggtccttctttctctactctaaacttaccgttgataagtcgaggtggcaacagggcaacgtgttcagctgctccgtcatgcacgaagcgctgcataaccactacacacagaagtcattgagtctatctccaggaaag

SEQ ID NO: 23535 - RNA, 642 nt, synthetic construct
  misc_feature 1..642: note = derived and/or modified sequence opt3 from Nesvacumab_LightChain1
  source 1..642: mol_type = other RNA
gagatcgtgctgacccagagccccggcacactctccctttctcctggggaacgggccactctgtcatgcagggctagtcaaagcgtctcctctacgtacttggcatggtatcagcagaagccaggacaggccccgcggttactgatttacggtgcgtcgtcacgcgctaccggcatacccgaccgattcagcgggagtggatccggcacagattttactctaaccatctctcgtctcgagcctgaagacttcgccgtttattactgtcaacactatgataacagccagacatttggtcaggggaccaaagtggagattaagagaactgtagcagccccatccgtgttcatctttcccccttcagacgaacagctgaaaagtggaacagctagcgtcgtgtgccttctgaataacttctacccaagggaggcaaaggttcaatggaaagtggataatgccttgcagtctggcaactcccaggagtcagtcaccgaacaggacagcaaggatagtacgtattctctctccagcactctgaccctgtcgaaggctgactacgagaaacataaggtgtacgcctgtgaagtaacacaccaaggcctctcttcccccgttactaaatcatttaatagaggggagtgc

SEQ ID NO: 23536 - RNA, 1362 nt, synthetic construct
  misc_feature 1..1362: note = derived and/or modified sequence opt3 from Neuradiab_HeavyChain1
  source 1..1362: mol_type = other RNA
gaggtgcagctgcaacagagcggccccgaactcgtcaagcctggggcctccgttaaaatgtcttgcaaggcttcaggatacaccttcacaagttatgtggtacactgggtgaaacagaacccaggtcagggccttgagtggatcgggtacattaatccgtttaacgacggaactaagtataatgaaaacttcaaatgtaaggcaacgctgaccagcgatagatcctcttcgacagcctacatggagttgagtagcttaacttcagaagagtccgcggtctatttttgcgctagggacatgggccgggagggtttcgcctactgggggcaaggaaccctggtgacagtttctgcagccaagaccactccccctagcgtgtatccactagctcccggctgtggcgatacaaccgggtcctcagtcacgctcggatgcctggtgaaaggttactttcctgaaagtgtaactgttacctggaatagcggctctctttcctcaagcgtgcatacattcccagcactgttgcagagtgggctctacactatgtcttccagcgtcaccgtgccctcgtctacatggccttcccagatagtgatctgttcagtcgcccacccagctagtagcaccacggttgacaagaaactggagccgtccggacccatttctactatcaacccttgcccaccctgtaaggaatgccataaatgtcctgccccaaatctggagggcggtcccagcgtgtttattttcccgcctaacatcaaggatgtactcatgatatcattaacacccaaggtgacctgcgtcgtggttgacgtgagtgaggatgacccagatgtccagatctcctggtttgtgaataacgtagaagttcacactgcgcaaacacagacccatcgcgaggactataatagcacgattcgagtggtctctaccctgcctatccagcaccaggattggatgtcagggaaagagttcaagtgtaaagtgaacaataaggaccttcccagtccaattgaacgtacaatcagcaaaataaagggattggtcagagcaccccaagtgtacattctgcctccaccggccgaacagctatccaggaaagatgtttctctcacttgcctggtggtaggctttaaccccggcgacatctcggtcgagtggaccagcaatgggcacacagaggaaaactataaggacactgctcctgtgcttgattccgacggatcatacttcatttatagtaagctgaacatgaaaacctctaagtgggagaaaacagatagcttttcctgcaatgttcggcatgaaggtttgaagaactactatctcaaaaagaccatctcacgcagcccaggcaag

SEQ ID NO: 23537 - RNA, 657 nt, synthetic construct
  misc_feature 1..657: note = derived and/or modified sequence opt3 from Neuradiab_LightChain1
  source 1..657: mol_type = other RNA
gacatcgtgatgacccaggccgctttcagcaaccccgtcacactgggcacttccgcatctatttcatgcagaagtagcaagtccctccttcactctaatgggataacgtacctgtattggtacttgcaaaaacctggacagtcgccacagttactgatctatcagatgtcaaacctagccagcggtgttccggataggtttagttcctctggcagcgggaccgacttcacactccggatttcccgcgtggaggcggaagatgtaggagtgtactattgtgctcaaaatctggagcttccccgaacttttggcggtgggaccaagctggaaatcaaacgtgccgacgcagcccctacagtctcaattttcccacccagtagcgagcagttgacctctggaggcgcttccgtggtttgctttctcaacaatttctaccctaaggatatcaacgtgaaatggaagatagacggctcagaaagacagaatggggtcctgaacagctggactgatcaggacagtaaggattctacatattccatgagctcgaccctgacgctcactaaagacgagtacgagaggcataattcttacacctgtgaagcaacacacaagacttccacctcaccaatcgtgaaaagttttaaccggaatgagtgc

SEQ ID NO: 23538 - RNA, 369 nt, synthetic construct
  misc_feature 1..369: note = derived and/or modified sequence opt3 from Nimotuzumab_HeavyChain1
  source 1..369: mol_type = other RNA
caggtgcaactgcagcagagcggcgccgaggtcaagaaacccgggtcctctgttaaggtgtcatgcaaagctagtggatacaccttcacaaactattacatctattgggtaagacaggcacctggtcaaggcctcgaatggattgggggaataaatccaactagcggcggttccaactttaatgagaagttcaaaacgagggtgaccatcacagtcgacgaatctactaacaccgcctacatggagctttcgtcactgcggagcgaagatacagcgttttatttctgtgctcgccaggggttgtggtttgacagtgatggacgaggcttcgacttttggggccaggggtccaccgtgactgtttctagc

SEQ ID NO: 23539 - RNA, 342 nt, synthetic construct
  misc_feature 1..342: note = derived and/or modified sequence opt3 from Nimotuzumab_LightChain1
  source 1..342: mol_type = other RNA
gacatccagatgacccaaagcccctcctctctgtcagccagtgtgggcgatagagtcacaattacttgcaggagctcccagaacatagttcactctaatgggaacacgtacctcgactggtatcagcagacccctggaaaggctccaaaacttctgatctacaaggtgtcgaatcggttctcaggtgtaccgagccgctttagtggctccgggtctggaacagatttcacttttaccattagctccttgcaacccgaggacatcgcaacatattactgtttccagtattcacatgtgccttggacctttggccagggtactaaattacagattacacgagaa

SEQ ID NO: 23540 - RNA, 1320 nt, synthetic construct
  misc_feature 1..1320: note = derived and/or modified sequence opt3 from Nivolumab_HeavyChain1
  source 1..1320: mol_type = other RNA
caggtgcaactggtcgagagcggcgggggagttgtgcagcccggtagatccctcaggcttgactgcaaggcctctggcatcaccttctcaaacagtgggatgcactgggtacggcaggctcctggaaaaggcctggaatgggtggcagtcatttggtacgatggtagcaagcgctattacgccgactccgtgaaagggcgatttacaatatctcgtgataattcgaagaacactttgttcttacagatgaactcactgagagcggaggacacggctgtttattactgtgccaccaatgatgactattggggacaaggcacactcgtgactgtcagcagtgcatccaccaaaggcccatctgtgtttccgctcgccccctgcagcaggtccacatcagaaagtaccgctgcactggggtgtcttgtaaaggattacttccctgagccagttactgtgagctggaactctggagccctgacatccggtgtccatacctttcccgctgtgttgcagtcaagcggcctctatagtctgtcttccgtggtcacggttcctagctcgtctctggggactaagacctacacatgcaatgtggaccacaaaccatccaatactaaggtagataaacgggtggaatcaaagtacggacccccttgtccaccgtgccccgcccctgagttcctcggcggtccaagtgtctttttatttccccctaaaccaaaggacaccctgatgatcagccgcacacccgaggtgacctgtgttgtggtcgatgtgtcccaggaagacccggaggtacagttcaactggtatgttgatggggtggaagtccataatgcgaagacgaaacctagagaggagcaattcaactctacttacagggtggtcagcgtgcttacagttttgcaccaggactggctgaatggaaaggaatataaatgcaaggtgtcaaacaaaggcctacccagttccattgagaagaccatcagcaaagcaaagggccagccacgggaacctcaggtatacactctacccccatctcaagaggaaatgacaaagaatcaggtctcactgacctgtcttgtgaaagggttttatcccagtgacattgccgttgagtgggagagcaacggacagcctgaaaataactacaagacgaccccaccggtgctggattccgacggttctttctttttgtattcgcgcctcacagtcgataaaagccgatggcaagagggcaacgtgttctcctgctcagtaatgcatgaagctctgcacaatcactacactcagaagagtttatctctgagcctcgggaaa

SEQ ID NO: 23541 - RNA, 642 nt, synthetic construct
  misc_feature 1..642: note = derived and/or modified sequence opt3 from Nivolumab_LightChain1
  source 1..642: mol_type = other RNA
gagatcgtgctgacccagagccccgccacactctccctttctcctggcgaaagagctactctgtcatgcagggcaagtcaaagcgtctcctcttacttggcctggtatcagcagaagccagggcaggcgccgcggttactgatttacgacgcttcgaaccgcgccacgggaatacccgcacgattctcaggtagcggcagtgggaccgattttacactaactatctcctctctcgagcctgaagacttcgccgtttattactgtcaacagagctccaattggccacgtacctttggacagggcacaaaagtggagattaagagaaccgtagctgcaccctcagtgttcatctttcctccaagtgatgaacagctgaaaagcggtactgcctctgtcgtgtgccttctgaacaatttctatcccagggaggctaaggttcaatggaaagtggacaacgccttgcagtccggaaattcacaggagagcgtcacagaacaggatagtaaggactctacctactccctcagctcgacgctgactctgtctaaggcggattatgagaaacacaaggtgtacgcatgtgaagtaacccatcaagggctctcctcacctgttacaaaaagttttaaccggggcgagtgc

SEQ ID NO: 23542 - RNA, 1347 nt, synthetic construct
  misc_feature 1..1347: note = derived and/or modified sequence opt3 from Obiltoxaximab_HeavyChain1
  source 1..1347: mol_type = other RNA
caggtgcagctgcagcagagcggccccgagctcaagaaacctggggcctccgtcaaggtttcttgcaaagactcaggatacgctttcagtagctcctggatgaactgggtgagacaggcaccaggtcaaggccttgaatggatcgggaggatttatccgggagatggcgacaccaattacaacggtaagtttcaggggcgggtaacaataactgccgataaatcttcgtcaacggcgtatatggagctgagcagtttgcgctccgaagacaccgctgtgtacttctgtgcccgatctggattactgcgttatgcaatggattactggggccagggcactctagtcacagtgagctccgcctcaaccaaggggcccagtgtttttcctctcgctccaagctctaagtccacatcaggaggtaccgcagccctgggctgccttgtgaaagactatttccccgagcctgtcactgtgagctggaatagtggggctctgacatctggagtacacacctttccagccgttttgcagtccagcggcctctactcgctgtcttccgtggtcacggtgccctcaagtagcctgggtactcaaacctacatctgtaacgtgaatcataagccttccaacacaaaagtcgataagaaagttgaaccaaagtcttgcgacaagactcacacctgtccgccctgccctgcgccagagctcttagggggacccagcgtgttcctgtttcctccaaaacccaaggatacacttatgatttcaagaaccccggaggtaacgtgtgtggtcgtggacgttagtcatgaagatcctgaggtgaaattcaattggtatgtcgacggcgtggaagtacacaacgcaaagactaaacccagggaggagcagtacaattccacatatcgggttgtgagcgtcttgaccgtgctgcatcaggattggctaaacggcaaggaatacaaatgcaaggtctctaataaggccctcccagctcctatcgagaaaactatttcaaaggccaaagggcagccccgcgaaccacaagtgtatacactgccccctagtagagacgagcttaccaagaaccaggttagcctgacgtgtttggtgaaaggattttacccatccgacatcgcagtagaatgggagtctaatggtcagccggagaacaattataagaccacaccccctgtcctcgattcggacggcagcttctttctgtactccaagttaactgtggataaatcaaggtggcaacaggggaacgttttcagttgctctgtgatgcacgaagctctgcacaaccattacacccaaaagagcctctccctttcaccaggaaaa

SEQ ID NO: 23543 - RNA, 642 nt, synthetic construct
  misc_feature 1..642: note = derived and/or modified sequence opt3 from Obiltoxaximab_LightChain1
  source 1..642: mol_type = other RNA
gacatccagatgacccaaagcccctcctctctgtcagccagtgtgggcgatcgggtcacaattacttgcagggctagccaggacatacggaactacctcaattggtatcagcagaagcctgggaaagcagttaaacttctgatctactatacgtcccgcttgttaccaggagtgccgtctcgattctcgggttcaggcagcgggaccgattacagtctgacaatttcctctcaagagcaggaagacatcggaacttatttttgtcagcagggcaacaccctaccctggacattcggtcaagggaccaaggtagagattcgtagaactgtggccgcgcctagcgtctttatcttcccaccctccgatgaacagctcaagtcaggaacagctagtgtggtttgcctgcttaataacttttaccctagggaggccaaagtgcagtggaaggtcgacaatgcactgcagagcggcaactctcaagaatccgtgaccgagcaggattcaaaggacagcacgtatagtttgtcttccactctcaccctgagcaaagccgattacgagaagcacaaagtatacgcttgtgaagttacacatcagggcctgtcgtctccagtgactaagtccttcaatagaggggagtgc

SEQ ID NO: 23544 - RNA, 1347 nt, synthetic construct; identical to SEQ ID NO: 22948
  misc_feature 1..1347: note = derived and/or modified sequence opt3 from Obinutuzumab_HeavyChain1
  source 1..1347: mol_type = other RNA

SEQ ID NO: 23545 - RNA, 657 nt, synthetic construct; identical to SEQ ID NO: 22949
  misc_feature 1..657: note = derived and/or modified sequence opt3 from Obinutuzumab_LightChain1
  source 1..657: mol_type = other RNA

SEQ ID NO: 23546 - RNA, 1350 nt, synthetic construct
  misc_feature 1..1350: note = derived and/or modified sequence opt3 from Ocaratuzumab_HeavyChain1
  source 1..1350: mol_type = other RNA
gaggtgcagctggtccagagcggcgccgaagttaagaaacccggggagtccctcaagatctcttgcaaaggatcaggtagaaccttcacaagttacaacatgcactgggtgaggcagatgcctggcaaggggcttgaatggatgggagctatttatccactgactggcgacacgagctacaatcagaaatccaagttgcaggtaaccatatctgcagataagtcgatctcaacagcctatttacaatggagcagtctgaaagcgtccgacactgctatgtactattgtgcccggtctacctacgtgggtggggattggcagtttgacgtctggggaaagggcacaaccgtgactgttagctccgcatcaacaaaaggcccgagtgtgttccccctagcccctagctctaagtccacctcagggggaacggctgcactcggttgcctggtcaaagattattttccagagcccgtgactgtaagctggaacagtggcgcccttacctctggggttcatacattccctgctgtgctgcagtccagcggattgtactcgctctcttccgtcgtgactgtgccatcaagtagcctgggcacccagacatacatttgtaatgtcaaccacaagccctccaataccaaggttgacaaaaaggtggaacctaaatcttgcgataagacgcatacttgtccaccgtgccccgcccctgagctgctcggtgggccaagcgtatttttatttccccctaaaatcaaggacacactgatgatttcacgcaccccagaggtgacttgtgtcgtggttgatgtgagtcacgaagaccccgaggtcaaattcaactggtatgtggatggagtagaagttcataatgcgaagacaaagccgcgagaggagcaatacaactccacctatcgtgtggtcagcgtgcttacggtcttgcaccaggactggctgaatggcaaagaatacaagtgcaaagtgtctaacaaggcactacctgcccccatcgagaaaaccatatcaaagcagaagggccagccaagagaacctcaagtttatacactgcccccaagtagggatgagctcactaaaaatcaggtgagccttacctgtctggtaaaggggttctacccctccgacatcgctgtcgaatgggagtctaacggacagcctgagaataactataaaacaactccaccggtgttggactcggatggtagctttttcctctactccaagctgaccgttgacaaatcacggtggcaacagggcaatgtgtttagttgctctgtcatgcacgaagccttacataaccactacacacaaaagagcctgtccctctcacccggg

SEQ ID NO: 23547 - RNA, 639 nt, synthetic construct
  misc_feature 1..639: note = derived and/or modified sequence opt3 from Ocaratuzumab_LightChain1
  source 1..639: mol_type = other RNA
gagatcgtgctgacccagagccccggcacactctccctttctcctggggaaagagccactctgtcatgcagggctagtagctccgtcccatacattcactggtatcaacagaagccgggacaggcaccccggttgttaatatacgccacgtctgcgctggcttcgggtatccctgaccgcttctcaggcagcgggagtggaaccgattttacactaactatttcccgactcgagccagaagacttcgccgtttattactgtcagcaatggctgtctaatccccctacctttggccagggtacaaaacttgagatcaagcgtaccgtggcagccccaagcgtattcatttttcccccttccgatgaacagctgaaatcagggactgctagtgtggtctgcttgctcaacaacttctatccaagagaggcaaaggtgcagtggaaagttgacaatgccctgcaaagcggaaactctcaggagtccgtgacagaacaggattcaaaggacagcacctacagtctgtcttccacgctcactttaagcaaggctgattatgagaaacataaggtctacgcctgtgaagtgacccaccagggcctgtcgtctccggtaacaaaatcctttaataggggcgagtgc

SEQ ID NO: 23548 - RNA, 1356 nt, synthetic construct
  misc_feature 1..1356: note = derived and/or modified sequence opt3 from Ocrelizumab_HeavyChain1
  source 1..1356: mol_type = other RNA
gaggtgcagctggtcgaaagcggcgggggactcgttcaacccggtggctcccttagactgtcttgcgccgcttcagggtacaccttcacaagttataacatgcactgggtgaggcaggcacctggaaagggcttggagtgggtaggtgccatctacccagggaatggagacactagctataaccagaaatttaagggccggttcacgatttccgtggataaatctaagaataccttatacctgcagatgaactcgctacgcgcggaagacacagctgtctattactgtgcccgagtggtttattactcaaatagctactggtattttgatgtgtggggccaagggactctcgtcaccgtgagttccgcatctacaaaaggaccgagcgtattccccctggccccttcctcaaagagtaccagcggtggcactgctgcacttgggtgcctggttaaggactactttccagagcccgtgacagtctcttggaactccggagccttgacctcaggcgtgcatacgttccctgctgtgctccagagcagtggtctgtattctctgtccagcgtcgttactgtgccatcgtcttccctcgggacccagacatacatatgtaatgtaaaccacaaaccctcaaatactaaggtggataaaaaggtcgaacctaaaagttgcgacaagacccatacatgtccaccgtgccccgcccctgagttactgggaggcccaagcgtgtttctttttccccctaagccaaaagataccttgatgatctcccgtacgcccgaggttacttgtgtggtcgtggacgtatctcacgaagatccggaggttaagttcaactggtatgtggacggcgtcgaagtgcataatgcgaaaacaaagcctagagaggagcagtacaacagcacctatagggtcgtgtcagttctgactgtgctacaccaagattggctcaatgggaaagaatacaagtgcaaagtaagtaacaaggcactgcccgccccaattgagaagacaatctccaaagctaagggacagcctcgggaaccccaggtctacacccttccacccagccgcgaggaaatgacgaaaaatcaggtgtctctgacctgtttggttaagggtttctatccttcagacattgccgtggagtgggagagtaacggccaaccagaaaacaattacaaaacaactccgcccgtcctcgatagcgacgggtcctttttcctgtattctaagttaaccgtggacaagtcgagatggcagcagggaaacgtatttagctgctccgtgatgcacgaggcactgcataatcactacacacaaaaatcactcagtctttctcctggcaag

SEQ ID NO: 23549 - RNA, 639 nt, synthetic construct
  misc_feature 1..639: note = derived and/or modified sequence opt3 from Ocrelizumab_LightChain1
  source 1..639: mol_type = other RNA
gacatccagatgacccaaagcccctcctctctgtcagccagtgtgggcgatagagtcacaattacttgcagggctagctcctctgtttcgtacatgcactggtatcagcagaagcctgggaaagcaccaaagccgctcatatacgccccctcaaaccttgcgagcggagtgcctagtcggttctccggttctggcagcgggacggactttaccctgacaatctcctcattgcagccagaggatttcgctacttattactgtcaacagtggagttttaatccccctaccttcggacagggcacaaaagtagaaattaagcgcaccgtggccgcaccaagcgtctttatctttcccccttctgacgagcagttaaaatccggtactgcctcagtggtttgcctgctaaacaatttctatccacgagaagctaaggtgcaatggaaggtcgataacgcactccagagcgggaatagtcaggagtctgtgacagaacaggactccaaagatagcacctactcgctgtcttccacgcttactctgtcaaaggccgactatgagaaacataaggtatacgcttgtgaggttacccaccaaggattgagtagcccggtgacaaaatccttcaaccgtggcgaatgc

SEQ ID NO: 23550 - RNA, 1356 nt, synthetic construct
  misc_feature 1..1356: note = derived and/or modified sequence opt3 from Ofatumumab_HeavyChain1
  source 1..1356: mol_type = other RNA
gaggtgcagctggtcgaaagcggcgggggactcgttcaacccggtagatcccttaggctgtcttgcgccgcttcaggcttcacctttaacgactacgcaatgcactgggtgcggcaggcccctgggaagggattggagtgggtaagtacaatcagctggaatagcggctctattggttatgcggattcggtgaaagggcgcttcactatatcacgagacaacgctaagaaatccttatacctgcagatgaatagtctacgtgccgaagatacggcactctattactgtgccaaggacatccagtatggaaactactattacggcatggatgtctggggccaagggaccacagtgactgtttcctctgctagcaccaaaggaccatccgtgtttccgctggcaccctcaagtaagagcacatctggtggcaccgccgctcttgggtgcctggtcaaggactacttccctgagccagtgactgtatcctggaactcaggagccttgacaagcggcgttcatacctttcccgcggtgctccagagttctggtctgtattccctgagctcggtcgtgacggtgccttcttcctcactcgggactcagacctacatttgtaatgtcaatcacaaaccaagtaacacaaaggttgataaaagagtggaacccaagagctgcgacaaaactcatacctgtcctccatgcccggcacccgagttactgggaggcccttccgtattcctttttccacccaagcctaaggatacattgatgatctctaggaccccagaggtgacgtgtgtcgtggttgacgtgagccacgaagatcccgaggtcaaattcaattggtatgtggacggcgtagaagttcataacgccaagactaaaccgcgggaggagcagtacaattcaacatatcgcgtggtcagtgtgctgaccgtcctacaccaagattggctcaacgggaaggaatacaaatgcaaggtgtccaataaagctctgcctgcccccattgagaagactatcagcaaggcaaaaggacagccaagagaacctcaggtttatacacttcccccatctagggaggaaatgaccaagaaccaggtgtcactgacgtgtttggtaaaaggtttttaccccagtgacatagctgtcgagtgggagagcaatggccaacctgaaaacaactacaagaccacaccaccggtgctcgactccgatgggtctttctttctgtattcgaaattaactgttgacaagagccggtggcagcagggaaatgtgttctcctgctcagtcatgcacgaggccctgcataaccactacacccaaaagagtctctctcttagccccggcaaa

SEQ ID NO: 23551 - RNA, 642 nt, synthetic construct
  misc_feature 1..642: note = derived and/or modified sequence opt3 from Ofatumumab_LightChain1
  source 1..642: mol_type = other RNA
gagatcgtgctgacccagagccccgccacactctccctttctcctggcgaaagagctactctgtcatgcagggcaagtcaaagcgtctcctcttacttggcctggtatcagcagaagccagggcaggcgccgcggttactgatttacgacgcttcgaaccgcgccacgggaatacccgcacgattctcaggtagcggcagtgggaccgattttacactaactatctcctctctcgagcctgaagacttcgccgtttattactgtcaacagcgtagcaattggccaattacctttggacagggcacaagactggagatcaaaaggaccgtggctgcaccctccgtattcatttttcctccatcagatgaacagcttaagagtggtactgccagcgtggtctgcctgttgaacaatttctatccccgggaggctaaagtgcaatggaaggttgacaacgccctccagtctggaaattcccaggagtcagtgacagaacaggatagcaaagacagtacctactctctgtccagcacgctgactctctcgaaggcggattatgagaagcacaaagtctacgcatgtgaagtgacccatcaagggttatcttcccctgtaacaaagtcatttaaccgcggcgagtgc

SEQ ID NO: 23552 - RNA, 1371 nt, synthetic construct
  misc_feature 1..1371: note = derived and/or modified sequence opt3 from Olaratumab_HeavyChain1
  source 1..1371: mol_type = other RNA
cagctgcaactccaggagagcggccccgggcttgtgaagccttccgaaaccctgtctttgacatgcactgtctcaggaggtagtatcaacagctcctcttactattggggctggttaagacagtcgccagggaaaggactggagtggattggctcattcttttacacgggtagcacctattacaatccgagtctaaggtcccggctcacaatatctgttgacactagcaagaaccagttctccctgatgctttcaagtgtgaccgccgctgatacagcagtatattactgtgcccgccaaagcacctattactacgggtctggaaattattacggctggtttgaccgatgggatcagggcactctggtgacagtctcctcagcgagcaccaaagggcccagtgtgttccctttggctccatcttccaagagcacgtcgggaggtactgccgcactcggctgcctggttaaagactattttcccgaacctgtgaccgtctcttggaactccggggccctgacatcaggagtgcacactttcccagctgtactccagagtagcggcttatactccctgtctagcgttgtgaccgtcccctcaagttcccttggtacacagacctatatctgtaatgtgaaccataagcctagcaatacgaaggtggataaacgtgtcgagccaaagtcttgcgacaaaactcacacatgtccgccctgccctgcaccagaattgctcgggggaccctcagtttttctattccctccaaagcccaaagataccctcatgattagtagaactccggaggtgacatgtgtagtggtcgacgtgagccatgaggatcctgaagttaagtttaactggtacgtggacggcgtcgaggtgcacaatgccaagaccaaacccagggaggaacaatataactccacgtaccgggtagtttctgtgctgaccgtccttcatcaggattggctgaatggcaaggagtacaaatgcaaggtgtcgaacaaagccttgccagctcctatcgaaaagacaattagcaaagcgaaggggcagccccgcgagccacaggtctatactctgcccccttccagagaagagatgaccaagaatcaagtgtcactgacatgtttagttaaaggattctacccaagtgacatcgcagtggaatgggagtctaacggtcagccggagaataactataagactacaccccctgtactggatagcgacggctcctttttcctctactcaaaacttaccgtcgacaagtctaggtggcagcaagggaacgtgtttagctgctccgttatgcacgaagccctgcacaatcattatacccagaaaagtttgagcctatctccaggaaag

SEQ ID NO: 23553 - RNA, 642 nt, synthetic construct
  misc_feature 1..642: note = derived and/or modified sequence opt3 from Olaratumab_LightChain1
  source 1..642: mol_type = other RNA
gagatcgtgctgacccagagccccgccacactctccctttctcctggcgaaagagctactctgtcatgcagggcaagtcaaagcgtctcctcttacttggcctggtatcagcagaagccagggcaggcgccgcggttactgatttacgacgcttcgaaccgcgccacgggaatacccgcacgattctcaggtagcggcagtgggaccgattttacactaactatctcctctctcgagcctgaagacttcgccgtttattactgtcaacagcgtagcaattggccacccgcttttggacagggcaccaaagtggagattaagagaacagtagcagccccttccgtgttcatctttccaccctcagatgaacagctgaaaagtggtaccgctagcgtcgtgtgccttctgaacaatttctatcctagggaggccaaggttcaatggaaagtggacaacgcgttgcagtctggaaattcccaggagtcagtcactgaacaggatagcaaggacagtacatactctctctccagcaccctgacgctgtcgaaggcagattatgagaaacacaaggtgtacgcctgtgaagtaactcatcaagggctctcttccccagttaccaaatcatttaaccggggcgagtgc

SEQ ID NO: 23554 - RNA, 1341 nt, synthetic construct
  misc_feature 1..1341: note = derived and/or modified sequence opt3 from Olizuab_HeavyChain1
  source 1..1341: mol_type = other RNA
gaggtgcagctggtcgaaagcggcgggggactcgttcagcccggtggctcccttagactgtcttgcgccgtgtcagggtacagtatcaccagcggatattcctggaactggattaggcaggctcctggcaagggtttggagtgggtagcatctataacatacgacgggtcgactaattataacccatcagtgaaaggacggatcacgattagccgcgatgacagtaagaataccttctacttacagaactccctgcgagccgaagatacagcggtctattactgtgctcgtggctctcactattttggccattggcacttcgccgtgtgggggcagggaactctagttaccgtgagctccgcatcaacaaaaggtccgagtgtctttcccctcgcccctagctctaagtccacctcaggcgggactgctgcactgggatgccttgtgaaagactacttcccagagcccgtaacagttagctggaatagtggcgccctgacctctggtgtgcatacgtttcctgctgtcttgcaatccagcgggctctactcgctgtcttccgtggtgactgtcccatcaagtagcctgggaacccagacatatatctgtaacgttaatcacaagccctccaacactaaggtggataaaaaggtagaacctaaatcttgcgacaagacccatacatgtccaccgtgccccgcccctgagctcttaggcggcccaagcgtgttcctgtttccccctaaaccaaaggatacccttatttcaagaacgcccgaggtcacttgtgtggttgtggacgtcagtcacgaagatccggaggtgaagttcaattggtacgtagacggggttgaagtgcacaacgcgaaaacaaagcctagggaggagcagtataattccacctaccgggtcgtgagcgtcttgactgtgctgcatcaggattggctaaacggaaaagaatataagtgcaaagtttctaataaggcactccccgccccaatcgagaaaacaatatcaaaggctaagggtcaacctcgcgaaccccaggtgtacaccctgccacccagtagagaggaaacgaaaaaccaggtaagccttacctgtctggtcaagggcttttatccttccgacatcgccgtggagtgggagtctaatgggcagccagaaaacaactacaaaacaactccgcccgttttggattcggacggcagcttctttctctactccaagctgaccgtggacaaatcaaggtggcaacagggaaatgtcttcagttgctctgtgcacgaggcattacataaccactatacacaaaagagcctgtccctctcacctggtaag

SEQ ID NO: 23555 - RNA, 651 nt, synthetic construct
  misc_feature 1..651: note = derived and/or modified sequence opt3 from Olizuab_LightChain1
  source 1..651: mol_type = other RNA
gacatccagctgacccaaagcccctcctctctctcagccagtgtgggcgatagagtcacaattacttgcagggctagccagtccgttgactacgatggggactcttataactggtaccagcagaagcctggaaaagcaccaaaacttctgatatatgccgcgtcgtacttggagtcaggtgtgccgagccggttcagtggctccgggtctggaacggattttaccttaacaatcagctccctgcaacccgaagacttcgctacttattactgtcagcagtcacacgaggatccttatacctttggccagggtacaaaagtagaaattaagcgcaccgtggccgcaccaagtgtcttcatctttccccctagcgacgagcaactaaaatctgggactgcctccgtggtttgcctcctgaataacttctacccacgagaagctaaggtgcagtggaaggtcgataatgcacttcagtcaggaaacagccaggagagtgtgacagagcaagactctaaagattccacctacagcctgtcgtctacgttgactctctccaaggccgactatgaaaaacataaggtatacgcttgtgaggttacccaccagggcctgtcaagtcccgtgacaaagagctttaatcgtggcgaatgc

SEQ ID NO: 23556 - RNA, 1341 nt, synthetic construct
  misc_feature 1..1341: note = derived and/or modified sequence opt3 from Olokizumab_HeavyChain1
  source 1..1341: mol_type = other RNA
gaggtgcagctggtcgaaagcggcgggggactcgttcaacccggtggctcccttagactgtcttgcgccgcttcagggttcaactttaatgactacttcatgaactgggtgaggcaggcacctggaaagggcttggagtgggtagcccagatgcggaataaaaactatcagtacggtacctattacgcggaaagtttagaggggcgctttacaatcagccgagatgactccaaaaattctctgtatctacaaatgaactcgctcaagactgaagatacggctgtgtactattgtgcccgtgagtcatactacggattcaccagctattggggccagggcacactggtcactgtgagttccgcatctaccaaggggccaagcgtttttccgcttgccccctgctccagatcaacaagtgagagcaccgctgcactgggatgtttggtgaaagactacttccctgaaccagtcactgtgtcttggaactccggtgccctcacatcaggcgtacacacctttcccgctgttctgcagagcagtgggctgtattctctctccagcgtggtcacggtgccttcgtcttccttaggaactaagacctacacatgcaatgtggatcataagccatcaaatactaaagtcgacaagagggttgagagtaaatatggtcccccttgtccaccgtgccccgcccctgagttcctgggcgggccaagcgtgtttctttttccccctaagccaaaagataccttgatgatttcccggacacccgaggtaacctgtgtggtcgtggacgtttctcaggaggatccggaagtgcaatttaactggtacgtcgacggagtggaggtacacaatgcgaagacgaagcctcgcgaagaacagttcaacagcacttatagagttgtgtcagtcctgacagtgctacatcaggattggctcaatggcaaagaatacaagtgcaaagtcagtaacaagggcctgccctccagcatagagaaaaccatctctaaggcaaaagggcagccaagggagcctcaagtgtacactcttcccccatcacaggaagagatgacaaagaatcaggttagtctgacctgtttggtgaagggattttatcccagcgacattgccgtagaatgggagtccaacggtcaacctgaaaacaattacaaaacgaccccaccggtcctcgattctgacggctcgttcttcctgtatagccggttaacagtggacaagtcccgctggcaggaggggaacgttttctcatgcagtgtgatgcacgaggctctgcataatcactacactcagaaatctctcagcctttccctgggaaag

SEQ ID NO: 23557 - RNA, 642 nt, synthetic construct
  misc_feature 1..642: note = derived and/or modified sequence opt3 from Olokizumab_LightChain1
  source 1..642: mol_type = other RNA
gacatccagatgacccaaagcccctcctctctgtcagccagtgtgggcgatagagtcacaattacttgccaggctagccaggacatagggatctccctctcttggtaccagcaaaagcctggaaaagcaccaaaacttctgatttataacgccaataacttggcggatggtgttccgtcgaggttctcaggcagcgggagtggaacggactttaccttaacaatctcctctctgcagcccgaggatttcgctacttactattgtctacagcacaatagcgccccttacacctttggccagggtacaaagctcgaaattaagcggaccgtggcagccccatccgtattcatctttcccccttcagacgagcaactgaaaagtgggactgctagcgtggtctgccttctgaacaatttctatccacgcgaagcaaaggtgcagtggaaggttgataacgccttgcagtctggaaattcccaggagtcagtgacagaacaagacagcaaagatagtacctactctctctccagcacgctgactctgtcgaaggctgactatgagaaacataaggtctacgcctgtgaggtgacccaccagggcctctcttcccccgtaacaaaatcatttaaccgaggcgaatgc

SEQ ID NO: 23558 - RNA, 1341 nt, synthetic construct
  misc_feature 1..1341: note = derived and/or modified sequence opt3 from Omalizumab_HeavyChain
  source 1..1341: mol_type = other RNA
gaggtgcagctggtcgaaagcggcgggggactcgttcaacccggtggctcccttagactgtcttgcgccgtgtcagggtacagtatcaccagcggatattcctggaactggattaggcaggctcctggcaagggtttggagtgggtagcatctataacatacgacgggtcgactaattatgccgattcagtgaaaggacggttcacgatcagccgcgacgatagtaagaacaccttttacttacagatgaactccctgcgagcggaagacacagctgtctattactgtgcccgtggctctcactatttcggccattggcactttgcagtgtgggggcagggaactctagttaccgtgagctccggtccatcagtcttcccgctcgcccccagtagcaaatctacatccggcgggaccgctgcactgggatgccttgtgaaggattactttcctgagccagtaactgtttcatggaatagcggcgccctgacaagtggtgtgcataccttccccgctgtcttgcaatcttccgggctctacagcctgtcgtctgtggtgacggtcccttcctcaagtctgggaactcagacctatatttgtaatgttaaccacaaaccaagcaatacaaaggtggacaagaaagccgaacccaagtcctgcgataaaactcatacctgtcctccatgcccggcgcccgagctcttaggcggcccttctgtatttctgttcccacccaagcctaaagacacacttatgatcagcagaaccccagaggtgacgtgtgtcgtggttgatgtgtcacacgaagaccccgaggtcaagtttaactggtacgtggatggggtagaagttcacaatgcaaagactaaaccgagggaggagcagtataacagtacataccgggtggtctccgtgttgaccgtcctgcatcaggactggctaaatggaaaggaatataaatgcaaggtgagcaacaaagccctccctgctcccattgagaagactatctctaaagccaagggtcaaccacgcgaacctcaggtttacacactgcccccatcaagagatgagcttaccaagaatcaggtgagtctgacgtgtttggtaaaaggcttctatcccagcgacatagcagtcgaatgggagtccaacgggcagcctgagaataactacaagaccacaccaccggtgctcgactctgatggatcgtttttcctgtacagcaaattaactgttgacaagtccaggtggcaacagggcaacgtgttttcatgcagtgtcatgcacgaagctctgcataatcactatacccagaaatctctcagcctttcccccggtaag

SEQ ID NO: 23559 - RNA, 645 nt, synthetic construct
  misc_feature 1..645: note = derived and/or modified sequence opt3 from Omalizumab_LightChain
  source 1..645: mol_type = other RNA
gacatccagctgacccaaagcccctcctctctctcagccagtgtgggcgatagagtcacaattacttgcagggctagccagtccgttgactacgatggggactcttatatgaactggtaccagcagaagcctggaaaagcaccaaaacttctgatatatgccgcgtcgtacttggagtcaggtgtgccgagccggttcagtggctccgggtctggaacggattttaccttaacaatcagctccctgcaacccgaagacttcgctacttattactgtcagcagtcacacgaggatccttatacctttggccagggtacaaaagtagaaattaagcgcaccgtggccgcaccaagtgtcttcatctttccccctagcgacgagcaactaaaatctgggactgcctccgtggtttgcctcctgaataacttctacccacgagaagctaaggtgcagtggaaggtcgataatgcacttcagtcaggaaacagccaggagagtgtgacagagcaagactctaaagattccacctacagcctgtcgtctacgttgactctctccaaggccgactatgaaaaacataaggtatacgcttgtgaggttacccaccagggcctgtcaagtcccgtgacaaagagctttaatcgt

SEQ ID NO: 23560 - RNA, 1347 nt, synthetic construct
  misc_feature 1..1347: note = derived and/or modified sequence opt3 from Onartuzumab_HeavyChain1
  source 1..1347: mol_type = other RNA
gaggtgcagctggtcgaaagcggcgggggactcgttcaacccggtggctcccttagactgtcttgcgccgcttcagggtacaccttcacaagttattggttgcactgggtgaggcaggcacctggaaagggcttagagtgggtaggtatgatcgacccaagcaactccgatactcggtttaatccgaacttcaaagaccgctttacgatttctgccgatacctcgaagaatacagcgtacctgcagatgaactcactacgagctgaagacactgccgtgtattactgtgcaacctatcgtagctacgtcacacccctcgattattgggggcagggaaccctggtgactgttagttccgcctctacaaaaggccctagcgtgttcccacttgctccctcctcaaagagtaccagcggcgggacggcagccctgggatgcttggtcaaagactactttcctgagccagtgactgtatcttggaatagcggtgctctcacctcaggcgttcatacattccccgccgtgctgcaaagcagtgggctgtactctctctccagcgtcgtgactgtgccttcgtcttccttaggaacccagacatatatatgtaacgtcaatcacaagccatcaaacaccaaggttgataaaaaggtggaaccgaaaagttgcgacaagacgcatacttgtcccccttgcccagcgcccgagctgcttggcggtcctagcgtatttttgttcccacccaaaccgaaggatacactgatgatctccagaacccctgaggtgacttgtgtcgtggttgacgtgtctcacgaagatcccgaggtcaagtttaattggtacgtggacggggtagaagttcataacgcaaaaacaaagccaagggaggagcagtataatagcacctaccgggtggtctcagtgctaacggtcctccaccaggattggctgaacggaaaagaatataagtgcaaagtgagtaataaggcccttcctgctcccattgagaaaaccatctccaaggccaagggccaaccacgcgaaccccaggtttacacactgcctccaagcagagaggaaatgactaaaaaccaggtgtctttgtcatgtgcagtaaagggcttctatccgagtgacattgctgtcgagtgggagagcaatgggcagcccgaaaacaactacaaaaccacacctccagtgctcgactccgatggatcgtttttcctggtttctaagttaactgtggacaaatccaggtggcaacagggtaatgtcttttcctgctcagtgatgcacgaggccctgcataaccactacacccagaagagtctctctcttagccccggcaag

SEQ ID NO: 23561 - RNA, 681 nt, synthetic construct
  misc_feature 1..681: note = derived and/or modified sequence opt3 from Onartuzumab_HeavyChain2
  source 1..681: mol_type = other RNA
gacaagacccacacatgtcccccttgcccagccccggagctgctcggcgggcccagcgtgttcctttttcctccaaaacccaaggatactctgatgatctccagaacgcctgaagttacctgcgtcgtggtagacgtgtctcatgaggatccagaagtcaaattcaactggtacgtggacggagttgaggtgcacaatgctaagacaaaacccagggaagaacagtataactcaacttaccgggtcgtgagtgtattgaccgttttacatcaagattggctgaatggtaaggagtataagtgtaaagtgagcaacaaggcactacctgccccaattgagaaaacaatatccaaggcgaaaggccagccgcgcgagccccaggtctacaccctccctccatctcgagaagagatgactaagaatcaggtgtcgctgtggtgccttgtgaaggggttttatccctcagacatcgctgtcgagtgggaaagcaacggacaacctgagaataactacaaaacaaccccacccgttctggatagtgacggctccttctttttgtattctaagctcacggtggataaaagccgttggcagcagggtaatgtattctcctgttcagtgatgcacgaagccctgcataaccactacactcagaagagtctgagcctctctccggggaaa

SEQ ID NO: 23562 - RNA, 660 nt, synthetic construct
  misc_feature 1..660: note = derived and/or modified sequence opt3 from Onartuzumab_LightChain1
  source 1..660: mol_type = other RNA
gacatccagatgacccaaagcccctcctctctgtcagccagtgtgggcgatagagtcacaattacttgcaagagctcccagtctctcctttacacgtcgtcacagaaaaactatctggcttggtaccagcaaaagcctgggaaagcaccaaagttgttaatatattgggccagcaccagggagagtggagttccgtcccggttctctggtagcggctccgggacagactttactctgaccatctcaagtctacagcccgaagatttcgcgacatactattgtcagcagtactatgcttacccttggacctttggacaaggcactaaagtggagattaagcgcacagtagccgcaccaagcgtgttcatctttcccccttctgacgaacagctcaagtccggtaccgcctcagtcgtgtgcctgcttaataacttctacccacgagaggctaaagttcagtggaaggtggataatgcactgcagagcgggaacagtcaagaatctgtcacggagcaggactccaaagatagcacttattcgttgtcttccaccctcacactgtcaaaggccgactacgagaaacacaaggtgtatgcttgtgaagtaactcatcagggactgagtagccccgttaccaagtcctttaatcgtggcgagtgc

SEQ ID NO: 23563 - RNA, 1362 nt, synthetic construct
  misc_feature 1..1362: note = derived and/or modified sequence opt3 from Ontuxizumab_HeavyChain1
  source 1..1362: mol_type = other RNA
caggtgcaactgcaggagagcggccccgggctcgtcagaccttcccagaccctttctctgacatgcactgcctcaggatacacgttcaccgactatgttatccactgggtgaagcagccaccgggtaggggcttggaatggattgggtacataaacccctatgatgacgatacaacttacaatcaaaaatttaagggacgggtaaccatgttagtggacacaagtagcaacaccgcttatctgcgcctatcctctgtcactgcagaggatacagccgtgtactattgtgcgcgacgtggcaattcgtacgacggttacttcgattattcaatggactactgggggagcggaacccctgttacggtgagttccgcttctactaaaggcccaagcgtctttcccctcgccccttcctcaaagagtaccagcggcgggacagcagccctgggatgccttgtgaaagattatttcccagaacccgtaactgtttcttggaactccggtgctctgacctcaggcgtgcatacatttcctgcagtcttgcagagcagtgggctctactctctgtccagcgtggtgaccgtcccatcgtcttccctgggaacgcagacttatatctgtaatgttaaccacaagccgtcaaatacaaaggtggacaaaaaggtagagcccaaaagttgcgataagacccatacttgtcctccatgccccgcccctgaactcttaggcggtccaagcgtgttcctgtttcccccgaaacctaaggacacacttatgatttccagaacccccgaggtcacgtgtgtggttgtggatgtctctcacgaggacccagaagtgaagttcaactggtacgtagacggggttgaggtgcataatgctaaaaccaagcctagggaagaacagtataacagcacataccgggtcgtgtcagtcttgactgtgctgcaccaagattggctaaatggaaaagagtacaagtgcaaagttagtaacaaggccctccccgcgccaatcgagaaaaccatttccaaggcaaagggccagccccgcgagcctcaggtgtatacactgccaccgagcagagacgaacttactaaaaatcaggtatctctgacctgtttggtcaagggcttttacccctcagatatcgccgtggagtgggaaagtaacgggcaacctgagaataactataaaacaaccccacccgttctcgacagcgatggattctttttcctgtactccaagttaactgtggacaaatctaggtggcagcagggtaacgtcttttcgtgcagcgtgatgcacgaggctctgcataatcactatacgcaaaagtccctctcacttagtcctggcaag

SEQ ID NO: 23564 - RNA, 645 nt, synthetic construct
  misc_feature 1..645: note = derived and/or modified sequence opt3 from Ontuxizumab_LightChain1
  source 1..645: mol_type = other RNA
gacatccagatgacccaaagcccctcctctctgtcagccagtgtgggcgatagagtcacaattacttgcagggctagccagaacgttgggacggcagtggcctggctccagcagacccctggaaaggcgccaaaacttctgatatactccgcttctaatcggtatacaggtgtaccgtcgcgcttctcaggcagcgggagtggaactgactacacctttacaatctcctctttgcaacccgaggatattgccacctattactgtcagcagtatactaactaccctatgtatacattcggccagggtaccaaggtgcaaatcaaacgaacggtcgcagccccaagcgtgtttatttttcccccttccgacgaacagttaaagtcagggactgctagtgttgtgtgcctgctaaataacttctacccacgtgaggcaaaagtccagtggaaggtggataatgccctccagagcggaaactctcaagaatccgtaaccgagcaggactcaaaggatagcacatacagtctgtcttccactcttaccctgagcaaagctgactatgaaaagcacaaagtttacgcctgtgaggtgacacatcagggcttgtcgtctcccgtcaccaagtccttcaatagaggcgagtgc

SEQ ID NO: 23565 - RNA, 1341 nt, synthetic construct
  misc_feature 1..1341: note = derived and/or modified sequence opt3 from Opicinumab_HeavyChain1
  source 1..1341: mol_type = other RNA
gaggtgcagctgctcgaaagcggcgggggacttgtccaacccggtggctccctgagattgtcttgcgccgcttcagggttcacctttagtgcatacgagatgaagtgggttaggcaggcccctggaaaaggcttagaatgggtgagcgtaatcggtccatccgggggattcacattttatgcggactctgtgaagggccggttcactatttcgcgcgataacagcaaaaatacgctgtacctacagatgaactcactccgagctgaggacaccgccgtctattactgtgcaacagaaggcgataatgacgcctttgatatatgggggcagggaactaccgtgacagttagttccgcttctaccaagggtccgagcgtgttccccctggcaccttcctcaaaaagtactagcggcgggacagccgctcttggatgcctggtcaaggactattttccagagcccgtgaccgtatcttggaactccggcgccttgacgtcaggtgttcacactttccctgcggtgctccaaagcagtgggctgtactctctgtccagcgtcgtgaccgtgccatcgtcttccctcggaacacagacttatatctgtaatgtcaaccataagccctcaaataccaaagttgataagaaagtggagcctaagagttgcgacaaaacacacacctgtccaccgtgccccgcacctgaattactgggcggcccaagcgtatttctttttccccctaagccaaaggatacgttgatgatttcccgtactcccgaggtgacatgtgtcgtggttgacgtgtctcatgaagatccggaggtcaaattcaactggtacgtggacggggtagaggttcacaatgccaagaccaaacctagagaggaacagtacaacagcgcttatagggtggtctcagtgctgactgtcctacatcaggattggctcaatggaaaggaatacaaatgcaaggtgagtaacaaagccctgcccgcaccaatcgagaagacaatttccaaggctaaaggtcaacctcgggaaccccaggtttatacccttccacccagccgcgacgagctgacgaagaatcaggtgtctttgacctgtctcgtaaaaggcttctacccttcagacatcgccgtcgagtgggaaagtaacgggcagccagagaataactataagacaactccgcccgtgctggatagcgacggatcctttttcttatactctaaactgaccgttgataagtcgagatggcaacagggcaacgtgttcagctgctccgtcatgcacgaagcgctccacaatcattatacacagaagtcacttagtctgtctcctggt

SEQ ID NO: 23566 - RNA, 645 nt, synthetic construct
  misc_feature 1..645: note = derived and/or modified sequence opt3 from Opicinumab_LightChain1
  source 1..645: mol_type = other RNA
gacatccagatgacccaaagccccgccacactgtccctctctcctggcgagagagctactctttcatgcagggcaagtcagagcgtgtcctcttacctggcctggtatcagcagaagccagggcaagcgccgcggttgttaatttacgatgcttcgaaccgcgccacgggaatacccgcacgattctcaggtagcggcagtgggaccgactttacactgactatctcctctctagaacctgaggatttcgccgtctattactgtcagcagcgtagcaattggccaatgtatacctttggacagggcacaaaactcgaaattaagagaaccgttgctgcaccctccgtgttcatctttcctccatcagacgagcaactgaaaagtggtactgccagcgtagtgtgccttctgaacaatttctaccccagggaagctaaggtccagtggaaagtggataacgccttgcagtctggaaattcccaggagtcagttacagagcaagacagcaaggatagtacctattctctctccagcacgctgactctgtcgaaggcggactacgaaaaacacaaggtgtacgcatgtgaggtcacccatcaggggctctcttcccctgtgacaaaatcatttaaccggggcgaatgc

SEQ ID NO: 23567 - RNA, 1941 nt, synthetic construct
  misc_feature 1..1941: note = derived and/or modified sequence opt3 from Oportuzumab_monatox_HeavyChain1
  source 1..1941: mol_type = other RNA
caccatcaccatcaccatgacatccagatgacccaaagcccctcctctctgtcagccagtgtgggcgatagagtcacaattacttgcaggagcacgaagtccctccttcactctaacgggataacctacctgtattggtaccagcagaaacctggaaaggctccaaaattgttaatctatcagatgtcgaatctggcatcaggtgttccgagccggttcagttcctctggcagcgggacagactttactctaaccatttcctcactccaacccgaggatttcgccacatactattgtgcgcagaacctggaaatccctcgcacctttggacagggcactaaggtggagcttaaacgagctacaccaagtcacaatagccatcaggtaccctctgccggtgggcctaccgcaaactccggaacgtcaggcagcgaagtgcaactggtccagagtggcccagggttggtgcagcccggaggttctgttcgtatttcctgcgccgctagcggctacactttcaccaattatgggatgaactgggtgaagcaggcacctggaaagggcctcgagtggatgggttggatcaatacatacactggggaatcgacctacgccgactcttttaaaggaagattcacattttccctggatacctcagctagtgccgcgtatctgcaaataaacagcctcagggcagaggacacggccgtctactattgtgctcggttcgccatcaagggcgattactggggccaggggactttactgacagtgtcctctgagtttggaggtgcaccagagttcccgaaacccagcacccctccaggctcaagtgggcttgaaggaggctccttggctgccctgactgcgcaccaggcctgccatctacccctcgaaacatttacccgccacagacaacctaggggttgggagcagctggagcagtgtgggtatccagtacagcggcttgttgcactgtacttggctgcccgcctcagctggaatcaagtggaccaggtcattcgaaacgctctggcctctcccggctcaggaggcgatttaggggaagcaatcagagagcagccggaacaggccaggctggctctcacgcttgcggcagccgagagtgaacggttcgtgcgtcaaggaaccggtaatgacgaggctggcgccgcaagcgccgatgtggtctccctgacatgccctgttgctgccggggagtgtgcaggacccgcggactctggcgatgctttgctagaacgcaactatccaactggtgccgagtttctgggggacggcggagacgtgtcgttcagcaccagaggcacacagaattggactgtagaaaggctcctgcaggcacaccggcagcttgaggaacgagggtacgtgttcgtcggataccatggtacctttctggaggccgctcaatccattgtgttcggcggggttcgcgccagatcacaggatttggacgcaatctggaggggattttatatagctggcgatcctgccctcgcgtacggttatgcccaggaccaggagcccgatgctcgggggcgcattagaaacggcgcactgttaagggtgtacgtcccacgtagttctctgcccggattctatcggacaggcctaaccctcgccgctcctgaagccgcaggggaggtggaacgactgatcggacacccacttccgttgagactggacgcgattactggccccgaggaagagggtgggaggctcgagacgatcctgggatggcctcttgccgaacgcacagtagttatcccaagcgctattcccaccgatcctcggaatgtgggcggtgacctggatccatcctcaatacccgacaaggagcaagccatcagcgcattgccggattacgcttctcagcctggcaaaccaccccatcaccatcaccaccataaggacgaactc

SEQ ID NO: 23568 - RNA, 1941 nt, synthetic construct; identical to SEQ ID NO: 23567
  misc_feature 1..1941: note = derived and/or modified sequence opt3 from Oportuzumab_monatox_SingleChain_variable_fragment
  source 1..1941: mol_type = other RNA

SEQ ID NO: 23569 - RNA, 762 nt, synthetic construct
  misc_feature 1..762: note = derived and/or modified sequence opt3 from Oreptacog_alfa_HeavyChain1
  source 1..762: mol_type = other RNA
atcgtgggcgggaaggtctgccccaagggagagtgtccttggcaggttctgctccttgtgaacggtgcccaactgtgcggcgggaccttgattaatacaatatgggtagtgagcgctgcacactgtttcgacaagatcaaaaactggagaaatttaattgccgtcctgggagaacatgatctatccgagcacgacggcgatgaacagtctaggcgggtggcgcaggttatcattccatcaacttacgtgccgggtacgaccaaccatgacatcgctctcctgcgccttcaccagcccgtcaatctgacagatcatgtggtacctttgtgcctcccagagcgaacttttagtgaacgtaccctggccttcgttagatttagcctggtgtccgggtggggacaactcttagacaggggcgcaacagccctggagcttatggtcttgaacgtgccccggctgatgacccaggattgtctacagcagtctcgcaaggtgggcgactcgcctaatataactgagtatatgttctgcgctgggtactcagatggaagcaaagacagttgtaagggtgattccggcgggccacacgcaacacactatagaggaacctggtacctcacgggcatcgtctcttggggtcaagggtgcgccactgttggacattttggcgtgtataccagggtaagccagtacattgaatggctgcagaaacttatgcggtccgagccccgccctggcgtgctgttgcgagctccattcccg

SEQ ID NO: 23570 - RNA, 456 nt, synthetic construct
  misc_feature 1..456: note = derived and/or modified sequence opt3 from Oreptacog_alfa_LightChain1
  source 1..456: mol_type = other RNA
gccaacgctttcctggaggaactcagacagggcagccttgagagggaatgcaaggaggaacaatgttcctttgaggaggcacgggaaatcttcgaggacgaagaggagaccaaactgttttggatttcttactcagatggggaccagtgcgccagtagcccctgtcagaatggaggttcctgcaaggatcagttgcaatcttatatatgtttctgcttacctgcgtttgaaggccgcaactgtgagacacacaaagacgatcagctgatctgcgtgaatgaaaacgggggatgtgagcagtactgctcggaccataatggcactaagcgatcatgtcgttgccacgaaggttatagcctactcgctgatggggtcagttgcacgccaaccgttgagtacccgtgtggaaaaattcccatcctggagaagagaaacgcctccaagcctcagggcagg

SEQ ID NO: 23571 - RNA, 1353 nt, synthetic construct
  misc_feature 1..1353: note = derived and/or modified sequence opt3 from Orticumab_HeavyChain1
  source 1..1353: mol_type = other RNA
gaggtgcagctgctcgaaagcggcgggggacttgtccaacccggtggctccctgagattgtcttgcgccgcttcagggttcacctttagtaacgcatggatgagctgggttaggcaggcccctggaaagggcttagagtgggtgtcctctatctcggtaggtgggcaccggacatactatgcggactcagtgaaaggacgcagcactattagtcgagataattccaagaacacgctgtacctacagatgaatagcctccgtgctgaagacaccgccgtctattactgtgcaagaataagggtgggcccatctggcggggccttcgattattggggacagggtacactggttactgtgtcctcagctagtaccaaaggcccgagcgtctttccccttgcaccttcttccaagtcaacaagcgggggaaccgccgctctgggctgcttggtgaaagactacttcccagagcccgtaactgttagttggaactctggtgccctcacatccggggtgcatacctttcctgcggtcctgcaaagctcgggactgtattctctctcctcagtggtgacggtcccaagtagctccttaggcactcagacctacatctgtaatgttaaccacaagccctctaatacaaaggtggataaaaaggtagaacctaaaagctgcgacaagactcatacctgtccaccgtgccccgcacctgagctgcttggcgggccatcagtgttcttgtttccccctaaaccaaaggatacactgatgattagtcggacccccgaggtcacgtgtgtggttgtggacgtctcccacgaagatccggaggtgaagttcaactggtacgtagacggagttgaagtgcataatgccaaaactaagcctcgcgaggagcagtataacagcacatacagagtcgtgtctgtcctaaccgtgctccaccaggattggctgaatggtaaagaatataagtgcaaagtttcaaacaaggcccttcccgctccaatcgagaaaactattagtaaggcaaagggccaacctagggaaccccaggtgtacacactgccacccagccgggacgagttgaccaaaaatcaggtatccctcacgtgtctggtcaaggggttttatccttctgatatcgctgtggaatgggagtcgaacggacagccagagaataactacaaaaccacaccgcccgttttagacagcgacggctccttctttctgtattcaaagctcactgtggataaaagtcgctggcaacagggtaacgtcttctcttgcagcgtgatgcacgaagcccttcataatcactacacccagaagtccctgtcattgagccctgggaag

SEQ ID NO: 23572 - RNA, 648 nt, synthetic construct
  misc_feature 1..648: note = derived and/or modified sequence opt3 from Orticumab_LightChain1
  source 1..648: mol_type = other RNA
cagagcgtgctgacccaacccccttccgcctctggcacaccagggcagagagtcactatctcatgcagtggaagcaacacgaatattggtaagaactacgtttcctggtatcagcagctcccgggcaccgctcccaaacttctgatatacgcaaattctaacaggccttcgggggtgccagaccggttctcaggaagcaagagtggcacatccgcctctttggcgatcagcggtttacgctccgaggatgaagctgactattactgtgcctcatgggatgcaagtctgaatgggtgggtatttggaggcggcactaaactaaccgtgctcgggcaacccaaggccgctcctagcgtcacactgttcccaccctcttccgaggaacttcaggcaaacaaagccaccctggtgtgcttgatttcagacttttatcctggagctgttactgtggcctggaaggcggatagcagtccagtcaaggccggtgtggagacaaccacgccgtctaaacagtccaataacaagtacgcagctagctcgtatctctctctgactcccgaacagtggaaatcccaccgatcatacagttgtcaagtaacccatgagggcagcacagttgagaagactgtggcccctaccgaatgctcc

SEQ ID NO: 23573 - RNA, 1347 nt, synthetic construct
  misc_feature 1..1347: note = derived and/or modified sequence opt3 from Otelixizumab_HeavyChain1
  source 1..1347: mol_type = other RNA
gaggtgcagctgctcgaaagcggcgggggacttgtccaacccggtggctccctgagattgtcttgcgctgcttcagggttcacctttagtagcttccctatggcatgggttaggcaggccccaggaaagggcttagagtgggtgtccacaatctctacttcgggtgggcggacgtactatcgcgactcagtaaaaggacgatttaccattagccgtgataacagtaagaatacactgtacctacagatgaactccctcagagcggaagacactgctgtgtattactgtgccaaattcaggcagtattctggcggctttgattactgggggcaaggaaccctggtcacagtgagctccgcatcaaccaagggtccgagtgttttcccccttgcccctagctctaaatccacttcaggcgggacagctgcactgggatgcttggtgaaggactattttccagagcccgtcaccgtgagctggaatagtggcgccctcacgtctggtgtacacactttccctgctgttctgcagtccagcgggctgtactcgctctcttccgtggtcaccgtgccatcaagtagcttaggaacacagacttacatatgtaacgtgaatcataagccctccaacaccaaagtcgataagaaagttgaacctaagtcttgcgacaaaacacacacctgtccaccgtgccccgcccctgagctgcttggcggcccaagcgtgtttttgtttccccctaagccaaaggatacgctgatgatctcacggactcccgaggtaacatgtgtggtcgtggacgttagtcatgaagatccggaggtgaaattcaattggtatgtcgacggggtggaagtacacaacgcgaagaccaaacctcgcgaggagcagtacgcatccacttatagagttgtgagcgtcctaacagtgctccatcaagattggctgaatggaaaggaatacaaatgcaaggtctctaacaaagcccttcccgctccaattgagaagaccatctcaaaggccaaaggtcagcctagggaaccccaggtgtatacgctgccacccagtcgggacgagttgaccaagaatcaggttagcctcacatgtctggtgaaaggcttctacccttccgatattgcagtagaatgggagtctaacgggcaaccagagaataactataagactaccccgcccgtcttagactcggacggcagctttttcctgtactccaaactcacagtggataagtcacgctggcagcagggaaatgttttcagttgctctgtgatgcacgaagcccttcacaaccattacactcaaaagagcctgtccttgtcacctggtaaa

SEQ ID NO: 23574 - RNA, 648 nt, synthetic construct
  misc_feature 1..648: note = derived and/or modified sequence opt3 from Otelixizumab_LightChain1
  source 1..648: mol_type = other RNA
gacatccagctgacccaacccaacagcgtgtccacatctctcggctcaactgtcaaacttagttgcacgctgagctccgggaatattgagaacaattacgttcactggtatcagttgtacgaaggaagatctcctaccacaatgatatatgatgacgataagaggccagacggtgtgccggatcggttctcgggctcaatcgaccgcagcagtaactccgcctttttaactattcataatgtagctatcgaggatgaagcaatttacttctgtcactcttatgtgagctcctttaacgtcttcgggggaggcaccaagctgacagtgctacgacagcccaaagccgcgccttcagttaccctctttccacccagtagcgaggaactgcaggctaataaggccactcttgtgtgcctgatctctgacttctaccctggtgcagtcacagtggcctggaaagctgattcctcaccagtaaaggcaggggttgagaccacgactcccagcaagcaaagtaacaataaatatgccgcttcttcctacttgagcctcacccctgagcagtggaagtcgcatcgttcttactcctgtcaggtgacacacgaaggatcaactgtcgagaaaaccgtggccccaacagaatgcagt

SEQ ID NO: 23575 - RNA, 1449 nt, synthetic construct
  misc_feature 1..1449: note = derived and/or modified sequence opt3 from Otlertuzumab_HeavyChain1
  source 1..1449: mol_type = other RNA
gaggtgcagctggtccagagcggcgccgaagttaagaaacccggggagtccctcaagatctcttgcaaaggatcaggttacagtttcaccggctataacatgaattgggtgagacagatgcctgggaagggacttgaatggatgggcaacattgacccatactatggtgggacaacttacaataggaaatttaagggacaggtaacgataagcgctgataagtccatctctaccgcatatctgcagtggtcgtcattgaaagccagcgacacagcgatgtactattgtgctcggagtgtgggcccgttcgattcctggggccaagggactttagtcaccgtgtctagcggaggtggcgggtccggaggcggtgggtcaggaggcggcgggagtggaggtggcgggagcggaggcggtgggtctgagattgttctgacacagtcccccgccaccctatcactcagccctggcgaacgcgcaactctgagttgccgagcctctgagaacgtgtactcctaccttgcttggtatcagcagaagccaggacaagcaccccgtctgttgatctactttgccaaaacactcgctgagggcattcctgccagattcagcgggtcgggatctggtaccgactttacgctgactatctcctcactggaaccagaggatttcgcggtctattactgtcagcaccatagtgacaatccctggacctttggccaggggacaaaggtggaaataaaaggagatcaggagcctaagagctccgacaagactcacacctctccaccgtgccccgcacctgagctcttaggcggtccaagcgtattcctgtttccccctaaaccaaaggatacacttatgatctcaaggacccccgaagttacgtgtgtggtcgtggacgtgagtcatgaggatccggaagtcaaattcaactggtatgttgacggggtggaggtacacaatgccaagactaaacctcgggaagaacaatacaactccacatatcgcgtggtcagcgtgttgaccgttctgcatcaggattggctaaatggcaaggagtacaaatgcaaggtgtctaacaaggctctccccgccccaattgagaaaactatctcaaaggcaaaaggacagcctagagagccccaagtctacacactgccacccagtagggacgaacttaccaagaatcaggtgagcctgacgtgtttggtaaaaggcttttatccttccgacattgctgttgagtgggaatctaacgggcagccagagaataactacaagaccacaccgcccgtgctcgattcggacggtagcttctttctgtattccaagttaactgtcgataaatcacggtggcagcaaggaaatgtgttcagttgctctgtcatgcacgaggccctgcacaaccattacacccaaaagagcctctccctttcacctggcaaa

SEQ ID NO: 23576 - RNA, 1347 nt, synthetic construct
  misc_feature 1..1347: note = derived and/or modified sequence opt3 from Oxelumab_HeavyChain1
  source 1..1347: mol_type = other RNA
gaggtgcagctgctcgaaagcggcgggggacttgtccaacccggtggctccctgagattgtcttgcgccgcttcagggttcacctttaacagttacgcaatgagctgggttaggcaggcccctggaaagggcttagagtgggtgtccatcatttctggttcagggggattcacatattacgcggactcggtaaaaggccggtttactataagccgcgataatagtcgaacgaccctgtatctacagatgaactccctccgtgctgaagacacagccgtgtactattgtgcaaaggatagactggtcgccccaggcactttcgactactgggggcagggagctcttgtgaccgtttctagcgcatccacaaaaggtccgtcagtgtttcccctggcccctagtagcaagtctacctccggcgggactgctgccttgggatgcctcgtcaaagattatttcccagagcccgtgacagtatcatggaatagcggcgcgctgaccagtggtgttcacacgtttcctgcagtgctgcaatcttccgggctctacagcttatcgtctgtcgtgactgtgccatcctcaagtctgggaacccagacatacatctgtaacgtcaatcataagcccagcaacactaaggttgacaaaaaggtggaacctaaatcctgcgataagacccacacatgtccaccgtgccccgcccctgagcttttgggcggcccatctgtattcctgtttccccctaaaccaaaggacaccctaatgattagcaggacgcccgaggtgacttgtgtcgtggttgatgtgtcacatgaagacccggaggtcaagttcaattggtatgtggatggggtagaagttcacaacgctaaaacaaagcctcgggaggagcagtacaatagtacctatcgcgtggtctccgtgctcactgtcctgcatcaggactggcttaacggaaaagaatacaagtgcaaagtgagcaataaggccctgcccgcaccaatcgagaaaacaatttctaaggctaagggtcaacctagagaaccccaggtttataccttgccaccctcaagggatgagctcacgaaaaaccaggtgagtctgacctgtttagtaaagggcttttaccctagcgacatcgccgtcgaatgggagtccaatgggcagccagagaacaattataaaacaactccgcccgtgctggactctgatggatcgttctttctctacagcaaacttaccgttgacaagtcccggtggcaacagggcaacgtgttctcatgcagtgtcatgcacgaagcgctgcacaaccattacacacagaagtctttgagcctatcccctggt

SEQ ID NO: 23577 - RNA, 642 nt, synthetic construct
  misc_feature 1..642: note = derived and/or modified sequence opt3 from Oxelumab_LightChain1
  source 1..642: mol_type = other RNA
gacatccagatgacccaaagcccctcctctctgtcagccagtgtgggcgatagagtcacaattacttgcagggctagccaggggatatcctcttggctcgcatggtaccagcagaagcctgagaaagccccaaagtcgcttatctatgcggcttcaagcctgcaaagtggagttccgtcccggttctctggtagcggctccgggacggactttaccttgacaatttcaagtttacagcccgaagatttcgccacttactattgtcagcagtacaacagctatccttacacctttggacaaggcacaaaactggagatcaagcgcaccgtggcagccccatctgtattcatttttcccccttccgacgaacagctaaaatcaggtactgctagcgtggtctgcctcctgaataacttctatccacgagaggcaaaggtgcagtggaaggttgataatgcccttcagagtgggaactctcaagaatccgtgacagagcaggacagcaaagattcgacctactctctgtcctcaacgttgactctcagtaaggctgactacgagaaacacaaggtctatgcctgtgaagtgacccatcagggactgagctcccccgtaacaaaatcttttaatcgtggcgagtgc

SEQ ID NO: 23578 - RNA, 1329 nt, synthetic construct
  misc_feature 1..1329: note = derived and/or modified sequence opt3 from Ozanezumab_HeavyChain1
  source 1..1329: mol_type = other RNA
caggtgcaactggtccagagcggcgccgaggttaagaaacccggggcttccgtgaaggtatcttgcaaagcatcaggatacaccttcacaagttattggatgcactgggtgagacaggcccctggtcagggcctcgaatggatcgggaacattaatccaagcaacggaggcactaattacaacgagaagtttaaatccaaggcgacgatgaccagggacacatctacttcgaccgcttatatggaactttcaagcctgcggagtgaggatacagccgtctactattgtgaattgatgcaaggttactgggggcagggaaccttagtgactgtttcctctgcaagcacaaagggcccgtccgtgttccccctggccccttcaagtaaaagcacctctggcgggacggctgcactaggatgcctcgtcaaggactattttccagagcccgtgactgtatcctggaactcaggtgccctgaccagcggcgttcatacattccctgctgtgcttcagagttctgggctgtactccttgagctcggtcgtgactgtgccatcttcctcactcggaacccagacatacatatgtaatgtcaatcacaaacccagtaacaccaaggttgataaaaaggtggagcctaagagctgcgacaaaacgcatacttgtccaccgtgccccgcccctgaactggcgggcgcaccatccgtatttctgtttccccctaagccaaaagatacactcatgatctctcgcacccccgaggtgacttgtgtcgtggttgacgtgagccacgaagatccggaggtcaagtttaattggtatgtggacggtgtagaggttcataacgccaaaacaaagcctcgagaggaacaatacaattcaacctatcgtgtggtcagtgtgttaacggtcctgcaccaggattggcttaacgggaaagaatacaagtgcaaggtgtccaataaggctttgcccgccccaattgagaaaaccatcagcaaagcaaagggacagcctagagaaccccaggtttatacactgccaccctctagggacgagctaactaaaaaccaagtgtcactcacctgtctggtaaagggcttctaccctagtgatattgctgtcgagtgggaaagcaatggccagccagagaacaactataagacaactccgcccgtgcttgactccgatgggtctttcttcctgtactcgaaattgaccgttgacaagagccggtggcagcaaggaaatgtgttttcctgctcagtcatgcacgaagccctccataaccactacacacagaaaagtctgtctttaagccctggtaag

SEQ ID NO: 23579 - RNA, 657 nt, synthetic construct
  misc_feature 1..657: note = derived and/or modified sequence opt3 from Ozanezumab_LightChain1
  source 1..657: mol_type = other RNA
gacatcgtgatgacccagagccccctgtccaaccctgtcacactcggccaaccagtttctatttcatgcagaagtagcaagtcccttctgtacaaagatgggaagacttatttgaattggttcttacagaggccgggacagtctccccagctgctaatatacctcatgtcgacgcgggcctcaggtgtgcctgaccgctttagcggcgggggaagtggcaccgatttcacactgaaaatctcccgagtagaggctgaagacgtgggtgtctattactgtcaacagcttgtggagtatccactgacttttgggcagggaaccaagttggaaattaaacgtacagttgcagccccctctgtgttcatctttcctccaagcgatgagcagctcaagtccggcaccgcgtcagtcgtgtgcctgctgaacaatttctaccccagagaagctaaggtacaatggaaagttgacaacgccctccagagtggcaatagccaggagtctgtgactgagcaggattccaaggactcaacatatagcttaagttctaccctgacgctttccaaagcagattacgaaaagcacaaagtctacgcctgtgaggtgactcatcaagggttgagctcgcctgtgaccaagtcttttaacaggggagaatgc

SEQ ID NO: 23580 - RNA, 1089 nt, synthetic construct
  misc_feature 1..1089: note = derived and/or modified sequence opt3 from Ozoralizumab_HeavyChain1
  source 1..1089: mol_type = other RNA
gaggtgcagctggtcgaaagcggcgggggactcgttcaacccggtggctcccttagactgtcttgcgccgcttcagggttcacctttagtgactactggatgtattgggtgaggcaggcacctggaaagggcttggagtgggtaagcgaaatcaacacaaatggtttaattactaaatacccagattccgtgaaggggcggttcacgatatctcgcgacaacgccaaaaataccctgtatctacagatgaactcgctccgaccggaggatacagcggtctactattgtgctcgttcacccagcggatttaatagaggccagggcactctggtgaccgttagttccgggggaggtggctctgggggaggcagcgaagtgcaacttgtcgagtccggtgggggactggtgcagcctggcaactcattgaggctcagttgcgccgcaagcggcttcacattttcttccttcgggatgtcatgggtacggcaggccccaggaaagggtctggagtgggttagcagtatctctggctccgggagcgacaccctgtacgctgattcggtgaaaggacgctttactatttctagagacaatgcaaagacaaccctctatttacagatgaactccctgaggcccgaagatacggccgtctactactgtactatcggcggttcacttagtcggagctcccaagggaccttggtgacagtgtctagcggcggaggcgggtcaggaggtggcagtgaggtccagctggttgaatccgggggaggcctagtgcagcctggtgggagcctccgcctgtcttgcgctgcctcaggcttcacttttagtgactattggatgtactgggtacgacaggcgccaggaaagggccttgagtgggtgagcgagattaataccaacgggctgatcacaaaatatcccgattccgtcaagggaagattcaccatatctagggacaatgccaaaaacacgttgtacctccaaatgaactcgctgcggcctgaagatactgcagtgtattactgtgctcgtagcccatccggttttaatcgcggccaggggacattagttaccgtgtcaagt

SEQ ID NO: 23581 - RNA, 1350 nt, synthetic construct
  misc_feature 1..1350: note = derived and/or modified sequence opt3 from Palivizumab_HeavyChain
  source 1..1350: mol_type = other RNA
caggtgaccctgagagagagcggccccgccctcgtcaagcctacacaaactcttacgctgacctgcacattctccgggttttctttgtcaacaagtggaatgagcgttggttggatcaggcagccaccgggcaaagcattagaatggctggctgacatttggtgggatgacaagaaagattacaacccctccctaaagtctcggctcaccatatcgaaagacacatcaaagaatcaggtggtactgaaggtgaccaacatggatcctgccgacactgcgacatattactgtgctcgcagcatgatcaccaattggtatttcgatgtctggggagccgggacgactgtgaccgttagttccgcatctacaaaaggcccaagcgtgtttccccttgccccttcctcaaagagtactagcggtgggaccgctgcactgggatgcttggtcaaagactacttcccagagcccgtgacagtatcttggaactccggcgccctcacctcaggcgttcacacgtttcctgctgtgctgcagagcagtgggctgtattctctctccagcgtcgtgactgtgccatcgtcttccttaggaacacaaacctacatttgtaatgtcaaccataagccgtcaaatactaaagttgataagcgagtggaacccaagagttgcgacaaaacacacacctgtcctccatgccccgcccctgagctgcttggtggcccaagcgtattcttgtttcccccgaagcctaaagatacgctgatgatctcccgtacccccgaagtgacatgtgtcgtggttgacgtgtctcatgaggatccagaggtcaagttcaactggtatgtggacggggtagaagttcacaatgcgaaaactaagcctagagaggaacagtacaacagcacctacagggtggtctcagtgctaacagtcctccatcaggactggctgaatggaaaagagtataagtgcaaggtgagtaacaaagcacttcccgccccaattgagaagactatctccaaagctaagggccagccccgggaacctcaagtttacaccctgccaccgagccgcgaggaaatgactaaaaatcaggtgtctttgacctgtctcgtaaagggtttttatccctcagatatagccgtcgagtgggaaagtaacgggcagcctgagaataactacaagactacgccacccgtgctggacagcgatggatccttctttttatattctaaactgacagttgacaagtcgagatggcagcaaggcaacgtgttcagctgctccgtcatgcacgaggcactccacaatcattacacccagaaatcacttagtctgtctcctggcaag

SEQ ID NO: 23582 - RNA, 639 nt, synthetic construct
  misc_feature 1..639: note = derived and/or modified sequence opt3 from Palivizumab_LightChain
  source 1..639: mol_type = other RNA
gacatccagatgacccaaagcccctccacactgtctgcctcagtgggcgatagagtcactattacgtgcaagtgtcagctcagtgttgggtacatgcactggtatcagcagaaacctggaaaggctccaaaacttctgatatacgacaccagcaagttggcatccggtgtgccgtctaggttctcgggctcagggagcggaacagagtttactttaaccatcagttccctgcaacccgatgacttcgccacatattactgctttcagggctctggttatcctttcacctttgggggaggcactaaactagaaattaagcggacagtagcggctccaagcgtgttcatctttcccccttccgatgagcagctcaagtcaggcaccgccagtgtcgtgtgtctgcttaacaatttctacccacgcgaagcaaaagttcagtggaaggtggacaacgccctgcaaagcggaaattctcaggagtccgtcacggaacaggattcaaaagacagcacttatagtttgtcttccaccctcacactgagcaaggctgattacgagaaacataaggtgtacgcatgcgaggtaactcaccaggggctgtcgtctcccgttaccaagtcctttaaccgaggtgaatgt

SEQ ID NO: 23583 - RNA, 360 nt, synthetic construct
  misc_feature 1..360: note = derived and/or modified sequence opt3 from Palivizumab_VH-Region
  source 1..360: mol_type = other RNA
caggtgaccctgagagagagcggccccgccctcgtcaagcctacacaaactcttacgctgacctgcacattctccgggttttctttgtcaaccagtggaatgagcgttggttggatcaggcagccaccgggcaaagcattagaatggctggctgacatttggtgggatgacaagaaagattacaacccctccctaaagtctcggctcactatatcgaaagacacatcaaagaatcaggtggtactgaaggtgaccaacatggatcctgccgacactgcgacatattactgtgctcgcagcatgatcaccaattggtatttcgatgtctggggagccgggacgactgtgaccgttagttcc

SEQ ID NO: 23584 - RNA, 1347 nt, synthetic construct; identical to SEQ ID NO: 23220
  misc_feature 1..1347: note = derived and/or modified sequence opt3 from Pamrevlumab_HeavyChain1
  source 1..1347: mol_type = other RNA

SEQ ID NO: 23585 - RNA, 642 nt, synthetic construct; identical to SEQ ID NO: 23221
  misc_feature 1..642: note = derived and/or modified sequence opt3 from Pamrevlumab_LightChain1
  source 1..642: mol_type = other RNA

SEQ ID NO: 23586 - RNA, 1305 nt, synthetic construct
  misc_feature 1..1305: note = derived and/or modified sequence opt3 from Panitumumab_HeavyChain1
  source 1..1305: mol_type = other RNA
caggtgcaactgcaggagagcggccccgggctcgtcaagccttccgaaaccctttctctgacatgcactgtttcaggaggtagtgtgagctccggcgactactattggacgtggatcagacagtctccagggaaaggattggagtggattggccacatatactattcgggtaacaccaattacaacccgtcattaaagagcaggctgacaatcagtattgatacttccaaaacccagttctctctaaagctcagctccgtaacagccgctgacaccgcaatctattactgtgtgcgggatcgcgtcactggggcctttgacatttggggacaaggcacaatggtgaccgtttcaagtgcgagcacgaaaggcccctctgtgttccctctggctccatgctcccgatcaactagcgaaagtaccgccgcacttgggtgtctggtcaaggattattttcccgagcctgtgacagtatcttggaactccggagccttgactagcggtgttcataccttcccagctgtgctccagtcgtctggcctgtactccctgtcaagtgtcgtgacagtgcccagctccaattttgggacccagacgtacacttgcaatgtcgaccacaagccttctaacacaaaagttgatgaacgtaagtgttgcgtggagtgtccagcaggaccgagcgtattcctctttccccctaaaccaaaggacaccttaatgatctcaagaactcccgaggtgacatgcgtcgtggttgatgtgagtcatgaagaccctgaggtccagttcaattggtatgtggatggcgtagaagttcacaacgccaaaaccaagccaagggaggagcaatttaattccacgttccgggtggtcagcgtgctgaccgtcgtgcatcaggactggcttaacggtaaggaatacaaatgtaaggtttctaataaagggttgcccgctccgatagagaagacaatctcaaaaactaagggacagcctcgcgaaccccaggtgtataccctgccacctagtagagaggaaatgactaaaaaccaagtaagcctaacatgcctcgtcaagggcttttacccctccgatattgccgtggagtgggagtctaatggccagccagaaaacaattataagaccacaccccctatgctggactcggacgggagcttctttctttactccaaactgaccgttgataagtcaaggtggcagcaaggaaacgtgttcagttgttctgtcatgcacgaggcgttgcacaaccattatactcagaaaagcctctccctgtcaccaggtaag

SEQ ID NO: 23587 - RNA, 642 nt, synthetic construct
  misc_feature 1..642: note = derived and/or modified sequence opt3 from Panitumumab_LightChain1
  source 1..642: mol_type = other RNA
gacatccagatgacccaaagcccctcctctctgtcagccagtgtgggcgatagagtcacaattacttgccaggctagccaggacatatccaactacctcaattggtatcagcaaaagcctgggaaagcaccaaaacttctgatctacgatgcctctaacttggagacgggagttccgtcgaggttctcaggtagcggcagtgggaccgactttacattcactatttcctctttacagcccgaagatatcgcgacctatttttgtcagcacttcgaccatctgcctctagcttttggaggcggtacaaaggtggagattaagcggaccgtagccgcaccaagcgtgttcatctttcccccttccgatgaacagctcaaatcagggactgccagtgtcgtgtgcctgcttaataacttctacccacgcgaggctaaggttcaatggaaggtggacaatgcactgcagagcggaaactctcaggaatccgtcacagagcaggattcaaaagacagcacctatagtttgtcttccacgctcactctgagcaaggccgattacgagaaacacaaggtgtatgcttgtgaagtaacccatcaaggcctgtcgtctcccgttacaaaatcctttaatcgaggcgagtgc

SEQ ID NO: 23588 - RNA, 1326 nt, synthetic construct
  misc_feature 1..1326: note = derived and/or modified sequence opt3 from Pankoab_HeavyChain1
  source 1..1326: mol_type = other RNA
gaggtgcagctggtcgaaagcggcgggggactcgttcaacccggtggctccagactttcttgcgtggcctcagggttcccttttagtaactactggaattgggtaaggcaggctccaggaaagggcctggagtgggtgggtgaaatccggttgaaaagcaacaattataccacacactacgcagagtccgtcaaggggcgcttcactatttctcgagacgattcgaaaaactcattatatctgcagaatagcctaaagacggaagacaccgccgtgtactattgtacacgtcattactattttgattactggggacagggcactctcgttaccgtgagttccgcgtctacaaaaggcccgagcgtcttccccctggctccttcctcaaagagtaccagcgggggaactgccgcacttggttgcctggtgaaggactactttccagagcccgtaacagtttcttggaactccggcgccttgacctcaggggtgcacacgttccctgctgtcctccaaagcagtggactgtattctctgtccagcgtggtgactgtcccatcgtcttccctcggcacccagacatacatatgtaatgttaaccataaaccctcaaatactaaggtggataaaaaggtagagcctaaaagttgcgacaagacccacacatgtccaccgtgccccgcacctgaattactgggtgggccaagcgtgtttctttttccccctaagccaaaagataccttgatctccagaacgcccgaggtcacttgtgtggttgtggacgtctctcatgaagatccggaggtgaagttcaactggtatgtagacggagttgaggtgcacaatgccaaaacaaagcctagggaggaacagtacaacagcacctatcgggtcgtgtcagtcctgactgtgctacaccaggattggctcaatggcaaagaatacaagtgcaaagttagtaacaaggctctgcccgccccaattgagaagacaatctccaaagcgaagggccaacctcgcgaaccccaggtgtatacccttccacccagcagagacgagctgacgaaaaatcaggtatctttgacctgtctcgtcaaggggttctacccttcagatattgcagtggagtgggaaagtaacggacagccagagaacaattacaaaacaactccgcccgttctggacagcgacggttcctttttcttatattctaagctgaccgtggataagtcgaggtggcaacagggcaacgtctttagctgctccgtgcatgaagggctccacaatcattacacacagaaatcacttagtctgtctcctggaaag

SEQ ID NO: 23589 - RNA, 651 nt, synthetic construct
  misc_feature 1..651: note = derived and/or modified sequence opt3 from Pankoab_LightChain1
  source 1..651: mol_type = other RNA
gacatcgtgacccagagccccctgtccaaccctgtcacaccaggcgagccggcctctatttcatgcagaagtagcaagtccctccttcactctaatgggataacttacttcttttggtatctgcaaaaacccggacagtcgcctcagttgttaatctaccagtcaaacctggctagcggtgttccagataggttcagtggctccgggtctggaacggactttaccctacggattagccgcgtggaagcagaggatgtaggcgtgtattactgtgcccaaaatctcgaactgccccctacattcggtcaggggactaaggtcgagatcaaacgaaccgtggcggctccatccgtttttatttttcccccttcagacgaacagcttaagagtggaacagccagcgtggtctgcctgttgaacaatttctatccacgtgaggcaaaagtgcagtggaaggtagataacgccctccaatctggcaattcccaggagtcagttaccgaacaggacagcaaggatagtacttactctctgtccagcacactgaccctctcgaaagctgactatgagaagcataaagtgtacgcatgtgaagtcacgcaccagggcttatcttccccggtgactaagtcattcaacagaggggagtgc

SEQ ID NO: 23590 - RNA, 651 nt, synthetic construct
  misc_feature 1..651: note = derived and/or modified sequence opt3 from Pankoab_LightChain2
  source 1..651: mol_type = other RNA
gacatcgtgacccagagccccctgtccaaccctgtcacaccaggcgagccggcctctatttcatgcagaagtagcaagtccctccttcactctaatgggataacttacttcttttggtatctgcaaaaacccggacagtcgcctcagttgttaatctaccagtcaaacctggctagcggtgttccagataggttcagtggctccgggtctggaacggactttaccctacggattagccgcgtggaagcagaggatgtaggcgtgtattactgtgccggtaatctcgaactgccccctacattcgggcaaggaactaaggtcgagatcaaacgaaccgtggcggctccatccgtttttatttttcccccttcagacgaacagcttaagagtggcacagccagcgtggtctgcctgttgaacaatttctatccacgtgaggcaaaagtgcagtggaaggtagataacgccctccagtctggcaattcccaagagtcagttaccgaacaggacagcaaggatagtacttactctctgtccagcacactgaccctctcgaaagctgactatgagaagcataaagtgtacgcatgtgaagtcacgcaccaggggttatcttccccggtgactaagtcattcaacagaggagagtgc

SEQ ID NO: 23591 - RNA, 351 nt, synthetic construct
  misc_feature 1..351: note = derived and/or modified sequence opt3 from PankoMab_HeavyChain_VDJ-Region
  source 1..351: mol_type = other RNA
gaggtgaagctggtcgaaagcggcgggggactcgttcagcccggtggctccatgaaactttcttgcgtggcctcagggttcacctttagtaactactggatgaattgggtaagacaaagccctgagaagggactggaatgggtggctgagatcaggttgaaatccaacaattatacaactcactacgcagaatctgtcaagggccggttcacgatttcgcgcgacgattcaaaaagcagtgtgtccttacagatgaacaatctgcgagttgaggacaccggtatatattactgtacacgtcattattactttgattattgggggcagggaactaccctaacagtgtctagc

SEQ ID NO: 23592 - RNA, 339 nt, synthetic construct
  misc_feature 1..339: note = derived and/or modified sequence opt3 from PankoMab_LightChain_VJ-Region
  source 1..339: mol_type = other RNA
gacatcgtgatgacccaggccgctttcagcaaccccgtcacactgggcacttccgcatctatttcatgcagaagtagcaagtccctccttcactctaatgggataacgtactttttctggtatctgcaaaaacctggattgtcgccacagttactgatctaccagatgtcaaacctagccagcggtgttccggataggtttagttcctctggcagcgggaccgacttcacactccggatttcccgcgtggaggcggaagatgtaggagtgtattactgtgctcagaatctggagcttccccctacttttggcggtgggaccaagctggaaatcaaacga

SEQ ID NO: 23593 - RNA, 1707 nt, synthetic construct
  misc_feature 1..1707: note = derived and/or modified sequence opt3 from Panobacumab_HeavyChain1
  source 1..1707: mol_type = other RNA
gaggaacaggtggtcgagagcggcgggggattcgttcaacccggtggctccctgagactctcttgcgccgcttcagggtttaccttcagtccttactggatgcactgggtgaggcaggcaccaggaaagggccttgtatgggtgagccggatcaactccgacggttctacatattacgccgattcggtcaaagggcgctttactatttcacgagacaatgcgcgtaacacgctgtatttgcagatgaatagcttaagagctgaagataccgccgtgtactattgtgcaagggaccggtactatggaccggagatgtggggccagggcacaatggttactgtgagttccgggtctgccagcgctcccaccctgttccctctagtctcctgcgaaaactcaccaagtgatacaagctctgtggcagtaggatgtctcgcccaagactttctgcccgattccataaccttctcatggaagtacaaaaataacagcgacatcagttctactcgcggttttccttccgttcttagaggcgggaagtacgctgccacaagccaggtgctgttgccatcgaaagatgtcatgcagggaaccgacgagcatgtggtgtgcaaggtccagcaccccaatggcaacaaggagaaaaatgttcctctcccagtgattgcggaactgccgcccaaggtatctgtgttcgtccctccaagggatgggtttttcggtaacccccggaaatccaagctgatctgtcaagcaacgggattttcacctcgccagattcaggtgagttggctccgagagggcaaacaggttggcagcggggtgactaccgaccaagtccaggccgaagctaaggagtccggaccaacaacttataaggtgacctctacattaaccatcaaagagagcgattggctgtcacagagtatgttcacgtgcagagtagaccataggggtcttacttttcaacagaatgcctccagcatgtgtgttcccgaccaggatacagcaatacgggtgttcgctatcccgccttctttcgcctcaatttttctcaccaagagtactaaactgacatgcctagtcaccgacctcacgacctacgatagcgtgacaatctcctggactcgtcagaacggcgaagcggtcaagacccacacaaatatttctgagtcgcatcccaacgccactttcagcgcagtgggggaggcttccatctgtgaagacgattggaactcaggagaacgctttacctgcacagttacccacactgacctgccaagtcctcttaaacaaacgatatctagacccaagggcgtggccctgcacaggccagatgtatatttgttgccccctgctcgggagcagctgaatttacgagagagcgccacaattacctgtctggtcactggtttctccccagcagacgtgtttgttcagtggatgcagcgcgggcaaccgctctcacccgaaaaatacgtgaccagcgcccctatgccagagccccaggctcctggcagatatttcgcgcattctatccttacagtctccgaagaggaatggaacaccggagagacttacacatgcgtggtagcacacgaggccctgccaaatagggtgacggaacggaccgttgataagagtactggcaagcccacattgtataacgtcagcctagtgatgtctgacaccgctgggacatgctac

SEQ ID NO: 23594 - RNA, 657 nt, synthetic construct
  misc_feature 1..657: note = derived and/or modified sequence opt3 from Panobacumab_LightChain1
  source 1..657: mol_type = other RNA
gacgtggtcatgacccagagccccctgtccctccctgttacacttggccaaccagcctctatctcatgcagaagtagccagtccctggtgtactctgatgggaacacttatttgaattggttccagcagaggccgggacaatcgccccggcgcttaatttacaaggtatcaaaccgagacagcggtgtgcctgatcgttttagtggctccgggtctggaacggacttcaccctgaaaataagcagagtcgaggctgaagatgtgggcgtttattactgtatgcagggtacacactggccactaacttttgggggaggcaccaaggtggagatcaaaaggacagtcgcagccccctccgtgttcatttttcctccatcagacgaacagctcaagagtggcaccgcgagcgtagtttgcctgcttaataacttctatccccgggaggctaaagtgcagtggaaggtcgataatgccctgcaatctgggaactcccaggaatcagtgactgagcaggacagcaaggatagtacatactctttgtccagcaccctcacgctgtcgaaagcagactatgagaagcataaagtgtacgcctgtgaagtcactcaccagggactgtcttcccctgttaccaagtcatttaatcgcggtgagtgc

SEQ ID NO: 23595 - RNA, 414 nt, synthetic construct
  misc_feature 1..414: note = derived and/or modified sequence opt3 from Panobacumab_LightChain2
  source 1..414: mol_type = other RNA
ggcgacgatgaggccaccatcctggctgacaacaagtgcatgtgtacaagagtgactagcaggattataccctccacggaagatcctaatgaggacatcgtcgaacggaacattcgcatcgttgtgccactcaataaccgagagaatatttctgatccgacctcaccccttcgtagaaacttcgtataccacctgagtgacgtgtgcaaaaagtgtgatcctgtcgaagtggagttggaggaccaggttgtgacagcaactcaaagcaatatctgcaacgaagatgacggggtcccagagacctgttatatgtacgataggaataaatgctatacaaccatggtgcccttacggtaccatggagaaactaagatggtacaggccgcgctgacacctgactcctgttatccagat

SEQ ID NO: 23596 - RNA, 1359 nt, synthetic construct
  misc_feature 1..1359: note = derived and/or modified sequence opt3 from Parsatuzumab_HeavyChain1
  source 1..1359: mol_type = other RNA
gaggtgcagctggtcgaaagcggcgggggactcgttcaacccggtggctcccttagactgtcttgcgccgcttcagggtacaccttcatcgactattacatgaactgggtgaggcaggcacctggaaagggcttggagtgggtaggtgatattaatttagacaacagtgggacacactataatcagaaatttaagggacggttcactataagccgcgataaatccaagaacacggcctacctgcagatgaatagcctacgagcggaagacaccgctgtgtattactgtgcccgtgagggcgtctatcatgattacgacgattacgcaatggactattggggccaagggacactcgtgactgtttcgtcagccagcaccaaaggaccaagtgtgtttccgctggctccctcctctaagagcacatccggtggcaccgcagcccttgggtgcctggtcaaggattacttccctgaaccagtgactgtatcatggaacagtggagctttgacaagcggcgttcacacctttcccgccgtgctccagtcttccggtctgtattcactgagcagtgtcgtgacggtgccttcttccagcctcgggactcagacctacatctgtaatgtcaaccataaaccatcgaatacaaaggttgacaaaaaggtggagcccaaatcttgcgataagactcacacctgtcctccatgcccggcgcccgagttactgggaggcccttccgtattcctttttccacccaagcctaaagacacattgatgatttcaagaaccccagaagtgacgtgtgtcgtggttgatgtgagtcatgaggaccccgaagtcaagttcaactggtatgtggacggcgtagaggttcacaatgcaaaaactaagccgagggaggaacagtacaacagcacatatcgggtggtctccgtgctgaccgtcctacaccaagattggctcaatgggaaagagtacaagtgcaaagtgtctaacaaggccctgcctgctcccatcgaaaagactattagcaaagccaagggacagccacgcgagcctcaggtttacacacttcccccatcaagagaagagatgaccaaaaatcaggtgagtctgacgtgtttggtaaagggtttttatccctccgacatcgcagtcgagtgggaaagcaacggccaacctgagaacaattacaaaaccacaccaccggtgctcgattctgacgggtcattctttctgtatagtaagttaactgttgataagtctaggtggcagcagggaaacgtgttctcctgctctgtcatgcatgaagctctgcacaatcattacacccaaaaatcgctcagcctttcccccggcaag

SEQ ID NO: 23597 - RNA, 657 nt, synthetic construct
  misc_feature 1..657: note = derived and/or modified sequence opt3 from Parsatuzumab_LightChain1
  source 1..657: mol_type = other RNA
gacatccagatgacccaaagcccctcctctctgtcagccagtgtgggcgatagagtcacaattacttgcaggacgagccagtccctcgttcacataaacgctatcacctaccttcattggtatcagcagaagcctgggaaagcaccaaagctgttgatttaccgggtgtctaatcgcttctcgggagtaccgtcacgatttagcggtagtggctccgggacagacttcactttaaccatctctagcctgcaacccgaggattttgccacatattactgtggacagtccacccacgtgcctctaactttcggccagggtacaaaagtcgaaattaagcgtaccgtggcggctccatcagtttttatctttccccctagtgacgagcagctcaaaagcgggacggcctctgtggtctgcctgcttaacaatttctatccaagagaagcaaaggtgcaatggaaggtagataacgccctgcagtccggaaattcacaggagagcgttactgaacaggacagtaaagattctacctactccttgagctcgacactcactctgtctaaggctgactatgagaaacataaggtgtacgcatgtgaggtcacccaccaaggcctgtcctcacccgtgacaaaaagtttcaacaggggcgaatgc

SEQ ID NO: 23598 - RNA, 1353 nt, synthetic construct
  misc_feature 1..1353: note = derived and/or modified sequence opt3 from Pascolizumab_HeavyChain1
  source 1..1353: mol_type = other RNA
caggtgaccctgagagagagcggccccgccctcgtcaagcctacacaaactcttacgctgacctgcacattctccgggttttctttgtcaactagcggaatgggtgttagctggatcaggcagccaccgggcaaagggttagaatggctggctcacatttactgggacgatgacaagcggtataacccctccctaaaatctcgcctcaccatatcgaaggatacatcacgaaatcaggtggtactgaccatgactaacatggaccctgtggatacagcaacctactattgtgcccgtagagagacggtcttctactggtattttgacgtgtggggaaggggcactccagttaccgtgagcagtgcgtccacaaaaggtccctctgtcttccctcttgctccaagctccaagtcaacttctgggggaaccgccgcactgggctgcttggtgaaggattactttcccgaacctgtaacagttagctggaatagtggcgccctcacctccggggtgcatacgttcccagctgtcctgcagtcaagcggactgtatagtctctcttccgtggtgactgtcccgagctcgtctttaggtacacaaacctacatctgtaacgttaatcacaaaccctccaacactaaggtggacaaacgggtagagcctaagtcatgcgataaaacacatacctgtccaccctgccctgcaccagaactgcttggcgggcccagtgtgtttttgttcccgcctaagcccaaggacacgctgatgattagccgcaccccagaggtcacatgtgtggttgtggatgtctcccacgaggaccctgaagtgaaatttaattggtacgtagatggagttgaggtgcataacgccaagactaaacccagagaggaacagtataattctacctacagggtcgtgagcgtcctaacagtgctccaccaggactggctgaacggcaaggagtataaatgcaaggtttcaaataaagcccttccagctcccatcgaaaagactattagtaaggcgaaaggtcagcctcgggagccacaagtgtacaccctgccgccctcccgcgaagagatgacaaagaaccaggtaagtttgacctgtctcgtcaaagggttctatccttctgacatcgcagtggaatgggagtcaaatggacagccagagaacaattacaagactacgccccctgttctggatagtgacggcagctttttcttatattccaaactgacagtggataagtctcgatggcagcaaggcaacgtcttttcgtgcagcgtgatgcacgaagccctccataaccactacacccagaagtccctttcactgagtccagggaaa

SEQ ID NO: 23599 - RNA, 654 nt, synthetic construct
  misc_feature 1..654: note = derived and/or modified sequence opt3 from Pascolizumab_LightChain1
  source 1..654: mol_type = other RNA
gacatcgtgctgacccagagcccctcctctctctcagccagtgtcggcgatagagttacaattacttgcaaggctagccaatccgtggactacgatggggactcttatatgaactggtaccagcagaaacctggaaaggcaccaaaacttctgatatatgccgcgtcgaatttggagtcaggtatcccgagcaggttcagtggctccgggtctggaacggattttaccttcacaattagctccttacagcccgaagacatcgctacttactattgtcaacagtcaaacgaggatcctccaacctttggccagggtacaaaggtagaaattaaacggaccgtggccgcacccagtgtcttcatctttcctccaagcgacgagcagctgaagtctgggactgcctccgtggtttgcctactcaataacttctacccccgcgaagctaaggtgcaatggaaagtcgataatgcactgcagtcaggaaacagccaggagagtgtgacagagcaggactctaaggattccacctatagcctttcgtctacgctgactttgtccaaagccgactacgaaaagcacaaagtatacgcttgtgaggttacccatcaaggcctctcaagtcctgtgacaaagagctttaatcgaggcgaatgc

SEQ ID NO: 23600 - RNA, 1512 nt, synthetic construct
  misc_feature 1..1512: note = derived and/or modified sequence opt3 from Pasotuxizumab_HeavyChain1
  source 1..1512: mol_type = other RNA
caggtgcaactggtcgagagcggcgggggactcgttaagcccggtgaatcccttagactgtcttgcgccgcttcaggcttcacctttagtgactactatatgtactgggtgaggcaggcacctgggaaaggattggagtgggtagccatcattagcgatggcggttattacacatattactccgacataatcaaggggcggttcactatttctcgcgataacgcgaaaaattcgttatatctgcagatgaactcactaaaggctgaagacacggccgtgtactactgtgcacgaggatttccactcctgcgtcacggcgccatggattattggggccaggggacccttgtcacagtgagcagtggaggtggcgggtccggaggcggtgggtctggaggcggcgggagcgacatccaaatgactcagtccccgtcaagtctgagcgcttctgttggagatagagtgaccattacatgcaaagcatcccagaatgtcgacaccaacgtggcctggtaccagcaaaagcccggtcaggctcctaagtcattgatctatagcgccagttacaggtattctgatgtaccatcccggttcagcggctcggcgtctgggactgactttacactcaccatatcctcagttcagagtgaggatttcgcaacgtactattgtcagcaatacgacagctacccctatacttttggaggcggtaccaaactggaaatcaagtccgggggcggaggctctgaggtgcagctggtcgagagcgggggaggtctcgtgcagcctggcgggtcattaaaactgagttgcgccgcttccggattcacatttaataagtacgccatgaactgggtgcgccaagcaccaggcaaaggtcttgaatgggtcgctagaattaggagcaagtataataactacgccacttattacgcggattctgttaaggaccggttcaccatctcacgcgacgatagtaaaaatacagcctatttgcagatgaacaatctgaagaccgaggacacggcagtgtactactgtgtacgacatgggaactttggcaatagctatatttcctactgggcttattggggacagggcactctagtgacagtctcttcgggagggggtggcagcgggggaggcggttccgggggcggaggctcacagaccgtggttactcaagaacccagtctcacagtgtctcctgggggaaccgtcacgctgacctgcggcagctccacaggtgccgtgacttcagggaactacccaaattgggtacagcagaaaccgggacaggctcccagaggccttatcggtggcaccaagttcctggcccctgggacaccagcaaggtttagcggatctttgctcggcgggaaagccgctctgactttatccggagttcaacccgaggatgaggcggaatattactgtgtgctgtggtatagtaaccggtgggtcttcggcggtgggaccaagctcacagtgcttcaccatcaccatcaccac

SEQ ID NO: 23601 - RNA, 1512 nt, synthetic construct
  misc_feature 1..1512: note = derived and/or modified sequence opt3 from Pasotuxizumab_SingleChain
  source 1..1512: mol_type = other RNA
caggtgcaactggtccagagcggcgggggactcgttaagcccggtgagtcccttagactgtcttgcgccgcttcaggcttcacctttagtgactactatatgtactgggtgaggcaggcacctgggaaaggattggaatgggtagccatcattagcgatggcggttattacacatattactccgacataatcaaggggcggttcactatttctcgcgataacgcgaaaaattcgttatatctgcagatgaactcactaaaggctgaggacacggccgtgtactactgtgcacgaggatttccactcctgcgtcacggcgccatggattattggggccaagggacccttgtcacagtgagcagtggaggtggcgggtccggaggcggtgggtctggaggcggcgggagcgacatccagatgactcagtccccgtcaagtctgagcgcttctgttggagatagagtgaccattacatgcaaagcatcccagaatgtcgacaccaacgtggcctggtaccaacagaagcccggtcaggctcctaagtcattgatctatagcgccagttacaggtattctgatgtaccatcccggttcagcggctcggcgtctgggactgactttacactcaccatatcctcagttcagagtgaagatttcgcaacgtactattgtcaacagtacgacagctacccctatacttttggaggcggtaccaaactggagatcaagtccgggggcggaggctctgaagtgcagctggtcgagagcgggggaggtctcgtgcaacctggcgggtcattaaaactgagttgcgccgcttccggattcacatttaataagtacgccatgaactgggtgcgccaggcaccaggcaaaggtcttgagtgggtcgctagaattaggagcaagtataataactacgccacttattacgcggattctgttaaggaccggttcaccatctcacgcgacgatagtaaaaatacagcctatttgcagatgaacaatctgaagaccgaagacacggcagtgtactactgtgtacgacatgggaactttggcaatagctatatttcctactgggcttattggggacagggcactctagtgacagtctcttcgggagggggtggcagcgggggaggcggttccgggggcggaggctcacaaaccgtggttactcaggagcccagtctcacagtgtctcctgggggaaccgtcacgctgacctgcggcagctccacaggtgccgtgacttcagggaactacccaaattgggtacagcagaaaccgggacaagctcccagaggccttatcggtggcaccaagttcctggcccctgggacaccagcaaggtttagcggatctttgctcggcgggaaagccgctctgactttatccggagttcagcccgaagatgaggcggagtattactgtgtgctgtggtatagtaaccggtgggtcttcggcggtgggaccaagctcacagtgcttcaccatcaccatcaccac

SEQ ID NO: 23602 - RNA, 1341 nt, synthetic construct
  misc_feature 1..1341: note = derived and/or modified sequence opt3 from Pateclizumab_HeavyChain1
  source 1..1341: mol_type = other RNA
gaggtgcagctggtcgaaagcggcgggggactcgttcaacccggtggctcccttagactgtcttgcgccgcttcagggtacaccttcacaagttatgtgatccactgggtaaggcaggcacctggaaagggcttggagtgggtgggttacaacaatccatataacgccgggactaattacaacgaaaaatttaagggacggttcacgattagctccgacaaatctaagaataccgcgtatttacagatgaactcgctgcgcgctgaggatacagccgtctactattgttcacgaccgactatgctaccctggtttgcatactggggccagggcaccctcgtgacagttagcagtgcctccaccaaagggccttctgtgttcccactggctcccagctccaagtcaacttctggaggtacagcagcccttggctgcctggtcaaggactactttcctgaaccagtgaccgtaagctggaatagtggggctttgacgtccggagttcatactttccccgccgtgctccaatcaagcggcctgtatagtctgtcttccgtcgtgaccgtgcctagctcgtctctcggtacacagacttacatatgtaacgtcaatcacaaaccatccaacaccaaggttgataaaaaggtggagccgaaatcatgcgacaagacacatacctgtcccccttgcccagcgcccgagttacttgggggacctagtgtatttctgttcccacccaagccgaaagatacgttgatgatcagccgtactcctgaagtgacatgtgtcgtggttgacgtgtcccacgaggatcccgaagtcaagtttaattggtatgtggacggcgtagaggttcataacgcaaaaaccaagccaagagaggaacagtacaattctacttatagggtggtcagcgtgctgacagtcctacaccaggattggctcaacggcaaagagtacaagtgcaaagtgtcaaataaggccctgcctgctcccattgaaaagaccatcagtaaagccaaggggcaaccacgggagccccaggtttatacgcttcctccatcccgcgaagagatgaccaaaaaccaggtgagcctgacatgtttggtaaagggattctacccgtctgacattgcagtcgagtgggaatcaaacggtcagcccgagaataactacaaaactacccctccagtgctcgatagtgacggcagctttttcctgtattccaagttaacagttgataagtctagatggcaacaggggaatgtgttttcgtgcagcgtcatgcacgaagctctgcataaccactacactcagaaatccctctcacttagtcccgga

SEQ ID NO: 23603 - RNA, 642 nt, synthetic construct
  misc_feature 1..642: note = derived and/or modified sequence opt3 from Pateclizumab_LightChain1
  source 1..642: mol_type = other RNA
gacatccagatgacccaaagcccctcctctctgtcagccagtgtgggcgatagagtcacaattacttgcagggctagccaggcagtttcctctgccgtggcgtggtaccagcagaagcctgggaaagctccaaagctccttatatattcggcctcacaccggtacacgggagtaccgagccgcttcagtggttccggctctgggaccgactttacactgactatcagctccttgcaacccgaggatttcgcaacctattactgtcaggaatcatatagtacaccttggacctttggacagggcactaaagtggagattaagcgaacagtcgccgctccaagcgtgttcatctttcccccttctgacgaacagttaaaatccggtaccgcatcagttgtgtgcctgctaaacaatttctacccacgtgaggccaaggtccaatggaaggtggataacgctctccagagcgggaatagtcaggaatctgtaacggagcaggactccaaagatagcacttattcgctgtcttccacccttacactgtcaaaggccgactacgagaaacataaggtttacgcgtgtgaagtgactcaccaaggattgagtagccccgtcaccaaatcctttaacagaggcgagtgc

SEQ ID NO: 23604 - RNA, 1341 nt, synthetic construct
  misc_feature 1..1341: note = derived and/or modified sequence opt3 from Patritumab_HeavyChain1
  source 1..1341: mol_type = other RNA
caagtgcaactgcagcagtggggcgccgggctccttaagcccagcgagaccctgtccttgacatgcgctgtctacggaggttctttctcaggctattactggagttggatcagacagcctccagggaaaggattagaatggattggcgagataaaccacagcggttccactaattataacccgtctctgaagtcgagggttacgatctcagtggaaaccagcaaaaatcaatttagtctaaagctctcctctgtaacagcagccgacactgcggtgtactattgtgctcgggataaatggacctggtacttcgacctgtgggggcgcggaacacttgtcaccgtgagctccgcctcaactaagggccccagtgtttttcctctggcaccaagctctaagtccacatcaggcgggaccgccgctttgggatgcctcgtgaaagattatttccccgagcctgtcacggtgagctggaacagtggtgcactgacttctggcgtacatacctttccagccgttctgcagtccagcgggctctactcgttatcttccgtggtcacagtgccctcaagtagcctgggaactcagacctacatttgtaatgtgaaccacaagccttccaatacaaaagtcgacaagcgagttgaaccaaaatcttgcgataagacccatacgtgtccgccctgccctgctccagagcttttgggcggtcccagcgtgttcctgtttcctccaaagcccaaagacactctaatgatctcacgtacaccggaggtaacctgtgtggtcgtggatgttagtcacgaagaccctgaggtgaagttcaactggtatgtcgatggggtggaagtacataatgccaaaactaagcccagagaggagcagtacaactccacatatagggttgtgagcgtcctcaccgtgctgcaccaagactggcttaatggaaaagaatacaagtgcaaagtctctaacaaggcgctgccagcacctattgagaagacgatctcaaaagccaagggccagccccgggaaccacaggtgtataccttgccccctagtcgcgaggaaatgactaaaaatcaggttagcctcacatgtctggtgaagggcttttacccatccgatatagctgtagagtgggagtctaacgggcaaccggaaaataactataaaaccacaccccctgtcttagactcggatggtagcttctttctgtactccaagctcactgtggacaagtcaagatggcagcagggaaacgttttcagttgctctgtgatgcacgaggcccttcataatcactacacccagaaaagcctgtccttgtcaccaggcaag

SEQ ID NO: 23605 - RNA, 681 nt, synthetic construct; identical to SEQ ID NO: 23561
  misc_feature 1..681: note = derived and/or modified sequence opt3 from Patritumab_hinge-CH2-CH3
  source 1..681: mol_type = other RNA

SEQ ID NO: 23606 - RNA, 660 nt, synthetic construct
  misc_feature 1..660: note = derived and/or modified sequence opt3 from Patritumab_LightChain1
  source 1..660: mol_type = other RNA
gacatcgagatgacccagagccccgattccctggccgtgtctctcggcgaaagagctacaattaactgcaggtcaagtcaaagcgtcctttactcctcttcgaatcggaactatctggcatggtaccagcagaatcctgggcagccaccgaaattgttaatatattgggcctcaactcgcgagagcggagttcccgaccgattcagtggttccggctctgggacggattttaccctgacaatcagctccctacaagcggaagacgtggctgtatactattgtcagcagtactattcaactcctcgtaccttcggacagggcacaaaagtggagattaagagaaccgtcgccgcaccaagtgtgtttatctttccccctagcgatgaacaactcaaatctggtactgcctccgttgtgtgcctgcttaacaatttctacccaagggaggctaaggtccagtggaaagtggacaacgcactgcagtcagggaatagccaggagagtgtaacagaacaagattctaaggactccacctacagcttgtcgtctacgctcactctgtccaaggccgattatgagaaacacaaggtttacgcttgtgaagtgacccatcagggactgtcaagtcccgtcacaaagagcttcaaccggggcgagtgc

SEQ ID NO: 23607 - RNA, 1341 nt, synthetic construct; identical to SEQ ID NO: 23422
  misc_feature 1..1341: note = derived and/or modified sequence opt3 from Pembrolizumab_HeavyChain1
  source 1..1341: mol_type = other RNA

SEQ ID NO: 23608 - RNA, 654 nt, synthetic construct; identical to SEQ ID NO: 23423
  misc_feature 1..654: note = derived and/or modified sequence opt3 from Pembrolizumab_LightChain1
  source 1..654: mol_type = other RNA

SEQ ID NO: 23609 - RNA, 1356 nt, synthetic construct
  misc_feature 1..1356: note = derived and/or modified sequence opt3 from Perakizumab_HeavyChain1
  source 1..1356: mol_type = other RNA
gaggtgcagctggtcgaaagcggcgggggactcgttcagcccggtggctcccttagactgtcttgcgccgcttcagggttcacctttagtgactacacaatgttgtgggtgaggcaggcacctggaaagggcttagagtgggtagccatcattaaaagcggtgggtcctattcttactatccagattcggtgaagggacggttcactatatcacgcgacaacgcgaaaaatagcctgtacctacagatgaacagtctccgagctgaagatacggccgtctattactgtgcacgtgacggcgattatggctcctcttacggggccatggactactggggacagggtaccctggtgacagttagctccgcttcaactaagggcccgagtgtgtttccccttgcacctagctctaaatccacctcagggggaacagccgctctgggctgcttggtcaaggattatttcccagagcccgtgaccgtaagctggaatagtggtgccctcacttctggggttcacacatttcctgcggtgctgcaatccagcggactgtactcgctctcttccgtcgtgaccgtgccatcaagtagcttaggcacgcagacttatatctgtaacgtcaatcataagccctccaacaccaaagttgacaagaaagtggaacctaagtcttgcgataaaacacacacttgtccaccgtgccccgcacctgaggccgctggcgggccaagcgtattcctgtttccccctaagccaaaggacacccttatgatttcaagaacacccgaggtgacctgtgtcgtggttgatgtgagtcatgaagacccggaggtcaaattcaattggtacgtggatggagtagaagttcacaacgccaagacgaaacctagggaggagcagtataattccacttaccgggtggtcagcgtgttgacagtcctgcatcaggactggctaaacggtaaggaatataaatgcaaggtgtctaataaagcactccccgctccaatcgagaagaccatttcaaaggccaaaggccaacctcgcgaaccccaggtttacactctgccacccagtagagacgagcttacaaagaaccaggtgagcctgacctgtttggtaaaagggttttacccttccgatatcgcggtcgaatgggagtctaatggacagccagagaacaattataagacgaccccgcccgtgctcgactcggatggcagcttctttctgtactccaaattaacagttgacaagtcaaggtggcaacagggtaacgtgttcagttgctctgtcatgcacgaagccctgcacaaccattatactcaaaagagcctctccctttcacctgggaaa

SEQ ID NO: 23610 - RNA, 645 nt, synthetic construct
  misc_feature 1..645: note = derived and/or modified sequence opt3 from Perakizumab_LightChain1
  source 1..645: mol_type = other RNA
gacatccagatgacccaaagcccctcctctctgtcagccagtgtgggcgatagagtcacaattacttgcagggctagccaggacataaactcctacctctcttggttccagcagaagcctgggaaagcaccaaagtcgcttatcgttcgggccaatcgcctggtggatggagtaccgtcacgatttagcggtagtggctccgggcaagactattctttgacgattagctccttacagcccgaggatttcgcgacctactattgtctgcagtacgacgcttttcctccatatacattcggacagggcactaaactagaaatcaagcgtaccgtggccgcaccctcagtctttattttccctccaagtgatgagcaactcaaaagcggtacagcctctgtggtttgcctgcttaacaatttttaccccagagaagctaaggtgcagtggaaggtcgacaacgcactgcagtccggaaattcacaggagagcgtgaccgaacaagatagtaaagactctacttattccttgagctcgacactcaccctgtctaaggccgattacgagaaacacaaggtatacgcttgtgaggttacgcatcaggggctgtcctcacctgtgactaaaagtttcaacaggggcgaatgc

SEQ ID NO: 23611 - RNA, 1332 nt, synthetic construct
  misc_feature 1..1332: note = derived and/or modified sequence opt3 from Pertuzuab_HeavyChain1
  source 1..1332: mol_type = other RNA
gaggtgcagctggtcgaaagcggcgggggactcgttcaacccggtggctcccttagactgtcttgcgccgcttcagggttcacctttacagactacactgattgggtgaggcaggcacctggaaagggcttggagtgggtagccgacgtgaacccaaatagtggtgggagcatctataaccagcggttcaaaggacgctttacgttatccgtcgatcgatctaagaataccctgtacctacagaactcgctccgtgcggaagacacagctgtgtattactgtgccagaaatctgggcccgtcattctattttgattactggggccaagggactcttgttaccgtgagcagtgcatccacaaaaggaccctctgtcttccctctggccccaagctccaagtcaaccagtggtggcactgctgcattggggtgcctcgtgaaagactattttcccgagcctgtaacagttagctggaactctggagccctgacctccggcgtgcacacgttcccagctgtcctgcagtcaagcggtctctacagtttatcttccgtggtgactgtccccagctcgtctctggggacccagacatacatttgtaatgttaaccataagccttccaatactaaggtggataaaaaggtagaaccaaaatcatgcgacaagacccacacatgtccgccctgccctgccccagagcttttgggaggccccagtgtgtttctgttccctccaaaacccaaggataccctaataagcaggacgccggaggtcacttgtgtggttgtggacgtctcccatgaagatcctgaggtgaagtttaactggtatgtagacggcgttgaagtgcacaatgcgaaaacaaagccccgggaggagcagtacaactctacctatcgcgtcgtgagcgtcctcactgtgctgcatcaagattggcttaatgggaaagaatacaagtgcaaagtttcaaacaaggcactgccagcccctatcgagaaaacaattagtaaggctaagggacagcccagagaaccacaggtgtataccttgcccccttccagggaggaaacgaaaaatcaggtaagcctcacctgtctggtcaagggtttctacccatctgacatcgccgtggagtgggagtcaaacggccaaccggaaaacaattataaaacaactccccctgttttagacagtgatgggagctttttcctgtactccaagctcaccgtggacaaatctcggtggcagcagggaaacgtcttctcgtgcagcgtgcacgaggcacttcacaatcattacacacaaaagtccctgtcattgagtccaggcaag

SEQ ID NO: 23612 - RNA, 639 nt, synthetic construct
  misc_feature 1..639: note = derived and/or modified sequence opt3 from Pertuzuab_LightChain1
  source 1..639: mol_type = other RNA
gacatccagacccaaagcccctcctctctgtcagccagtgtgggcgatagagtcacaattacttgcaaggctagccaggacgtttccataggggtggcatggtaccagcagaaacctggaaaggccccaaaactccttatctattctgcgtcgtacaggtatacgggtgtaccgtcacggttcagcggcagtgggtccggaaccgattttacactgactatttctagcttgcaacccgaggacttcgctacctactattgtcagcagtactatatctacccttacacatttggccagggtaccaaggtggaaattaaacgcactgtcgccgcaccatccgtgttcatctttcccccttcagatgagcaattaaagagtgggacagccagcgttgtgtgcctgctaaacaatttctatccacgagaagctaaggtccagtggaaagtggacaacgcactccagtctggaaattcccaggagtcagtaaccgaacaagatagcaaggacagtacgtactctctgtccagcactcttaccctgtcgaaagccgattatgagaagcacaaagtttacgcttgtgaggtgacacatcagggcttgtcttcccccgtcactaagtcatttaaccgtggcgaatgc

SEQ ID NO: 23613 - RNA, 642 nt, synthetic construct
  misc_feature 1..642: note = derived and/or modified sequence opt3 from Pertuzumab_HeavyChain
  source 1..642: mol_type = other RNA
gacatccagatgacccaaagcccctcctctctgtcagccagtgtgggcgatagagtcacaattacttgcaaggctagccaggacgtttccataggggtggcatggtaccagcagaaacctggaaaggccccaaaactccttatctattctgcgtcgtacaggtatacgggtgtaccgtcacggttcagcggcagtgggtccggaaccgattttacactgactatttctagcttgcaacccgaggacttcgctacctactattgtcagcagtactatatctacccttacacatttggccagggtaccaaggtggaaattaaacgcactgtcgccgcaccatccgtgttcatctttcccccttcagatgagcaattaaagagtgggacagccagcgttgtgtgcctgctaaacaatttctatccacgagaagctaaggtccagtggaaagtggacaacgcactccagtctggaaattcccaggagtcagtaaccgaacaagatagcaaggacagtacgtactctctgtccagcactcttaccctgtcgaaagccgattatgagaagcacaaagtttacgcttgtgaggtgacacatcagggcttgtcttcccccgtcactaagtcatttaaccgtggcgaatgc

SEQ ID NO: 23614 - RNA, 1344 nt, synthetic construct
  misc_feature 1..1344: note = derived and/or modified sequence opt3 from Pertuzumab_LightChain
  source 1..1344: mol_type = other RNA
gaggtgcagctggtcgaaagcggcgggggactcgttcaacccggtggctcccttagactgtcttgcgccgcttcagggttcacctttacagactacactatggattgggtgaggcaggcacctggaaagggcttggagtgggtagccgacgtgaacccaaatagtggtgggagcatctataaccagcggttcaaaggacgctttacgttatccgtcgatcgatctaagaataccctgtacctacagatgaactcgctccgtgcggaagacacagctgtgtattactgtgccagaaatctgggcccgtcattctattttgattactggggccaagggactcttgttaccgtgagcagtgcatccacaaaaggaccctctgtcttccctctggccccaagctccaagtcaaccagtggtggcactgctgcattggggtgcctcgtgaaagactattttcccgagcctgtaacagttagctggaactctggagccctgacctccggcgtgcacacgttcccagctgtcctgcagtcaagcggtctctacagtttatcttccgtggtgactgtccccagctcgtctctggggacccagacatacatttgtaatgttaaccataagccttccaatactaaggtggataaaaaggtagaaccaaaatcatgcgacaagacccacacatgtccgccctgccctgccccagagcttttgggaggccccagtgtgtttctgttccctccaaaacccaaggataccctaatgataagcaggacgccggaggtcacttgtgtggttgtggacgtctcccatgaagatcctgaggtgaagtttaactggtatgtagacggcgttgaagtgcacaatgcgaaaacaaagccccgggaggagcagtacaactctacctatcgcgtcgtgagcgtcctcactgtgctgcatcaagattggcttaatgggaaagaatacaagtgcaaagtttcaaacaaggcactgccagcccctatcgagaaaacaattagtaaggctaagggacagcccagagaaccacaggtgtataccttgcccccttccagggaggaaatgacgaaaaatcaggtaagcctcacctgtctggtcaagggtttctacccatctgacatcgccgtggagtgggagtcaaacggccaaccggaaaacaattataaaacaactccccctgttttagacagtgatgggagctttttcctgtactccaagctcaccgtggacaaatctcggtggcagcagggaaacgtcttctcgtgcagcgtgatgcacgaggcacttcacaatcattacacacaaaagtccctgtcattgagtccaggc

SEQ ID NO: 23615 - RNA, 750 nt, synthetic construct
  misc_feature 1..750: note = derived and/or modified sequence opt3 from Pexelizumab_h5g1.1-scFv
  source 1..750: mol_type = other RNA
atggccgacatccagatgacccaaagcccctcctctctgtcagctagtgtgggcgatagagtcacaattacttgcggggcaagcgagaacatatacggagccctcaattggtatcagaggaagcctggtaaagcgccaaaacttctgatctacggcgctacgaacttggccgacggggttccgtcccggttctctggatcgggctcaggtaccgattatacattaactattagcagtctgcagcccgaagactttgcaacctactattgtcagaatgtgctaaacacacctctcaccttcgggcaaggaactaaggtagagatcaagcgcacaggcggcgggggatccggtggcgggggatctggcggtgggggaagccaggtgcagctggtccagtccggcgccgaagtggagaaaccaggcgcttcagttaagaaggtgagttgcaaagcaagcgggtacatcttttctaattattggattcaatgggtccgacaggcccccggacagggtcttgaatggatgggcgagatactgcctgggtccggatcaaccgagtacgctcagaagttccaaggccgtgtgacgatgactgccgataccagcacaagtactgcgtacatggaattgtcttccctcagaagcgaggacaccgcagtatattactgtgccaggtactttttcggttcgtctccaaactattggtattttgatgtttgggggcagggcacactggtgaccgtctcctca

SEQ ID NO: 23616 - RNA, 345 nt, synthetic construct
  misc_feature 1..345: note = derived and/or modified sequence opt3 from Pexelizumab_h5g1.1VHC_+_F_Heavy_Chain_V-Region
  source 1..345: mol_type = other RNA
caggtgcaactggtccagagcggcgccgaggttaagaaacccggggcttccgtgaaggtatcttgcaaagcatcaggatacatcttcagtaactattggattcagtgggtgagacaggcccctggtcaaggcctcgaatggatgggggagatacttccaggaagcggctccaccgaatacgcgcagaagtttcagggtagggtcacaatgactgctgacacgtctacctcgacagcctatatggagctgagctcattgcggagtgaagatactgcagtgtactattgtgcccgctacttctttgggtcctctccgaattggtatttcgtttggggacagggcacc

SEQ ID NO: 23617 - RNA, 318 nt, synthetic construct
  misc_feature 1..318: note = derived and/or modified sequence opt3 from Pexelizumab_h5g1.1VHC_+_F_Light_Chain_V-Region
  source 1..318: mol_type = other RNA
gacatccagatgacccaaagcccctccctgtctgcctcagtgggcgatagagtcacaattacttgcggggctagtgagaacatatacggagcactcaattggtatcagaggaagcctggtaaagccccaaaacttctgatctacggcgcgacgaacttggctgacggggttccgagccggttctccggatctggctcgggtaccgattatacattaactatttcaagcctgcagcccgaagactttgccacctactattgtcagaatgtgctaaacacacctctcaccttcgggcaaggaactaaggtagagatcaag

SEQ ID NO: 23618 - RNA, 1326 nt, synthetic construct
  misc_feature 1..1326: note = derived and/or modified sequence opt3 from PF-05082566_HeavyChain1
  source 1..1326: mol_type = other RNA
gaggtgcagctggtccaaagcggcgccgaagttaagaaacccggggagtccctcagaatctcttgcaagggatcaggttacagtttcagcacctattggatttcctgggtgaggcagatgcctggcaaagggcttgaatggatgggaaagatatacccaggcgactcttatacaaactactcgccgtcatttcagggtcaggtaactatcagcgctgataaaagtatttccacggcatatctgcaatggtctagcttgaaggcctccgacaccgcgatgtactattgtgctcgggggtacggaatcttcgattactggggccagggcacattagtgactgtctcaagtgccagcaccaaggggccctctgtgtttcctctggcaccatgctcccgctcaacaagcgagagtaccgccgctctaggatgtctcgttaaagactatttccccgaacctgtgactgtctcttggaatagcggtgcactgacaagcggcgtgcacacctttccagccgtacttcagtcgtctgggctgtactccttgtcaagtgttgtgacggtccccagctccaacttcggaactcagacctatacatgcaatgtggatcataagccttctaacactaaagtggacaagaccgtcgagcgaaaatgttgcgttgagtgtccaccgtgccccgctcctccagtggccggccccagcgtatttctcttccctccaaagcccaaggatacactgatgatttcacgtaccccggaagtgacgtgtgtcgtggttgacgtgagtcacgaggatcctgaagtccaatttaattggtacgtggacggtgtagaggttcataacgcgaaaactaagcccagagaggaacagttcaattccacatttagggtggtcagcgtgctgaccgtcgtgcaccaggattggctcaacgggaaagagtataagtgcaaagtttctaataagggattaccagcacctatcgaaaagactatatcaaagacaaagggccagccccgggagccacaagtgtacaccctgccccctagtcgcgaagagatgacgaaaaaccaggtaagccttacctgtttggtcaagggcttctatccatccgacatcgccgtggagtgggaatctaatgggcagccggagaacaattacaaaacaactccccctatgctggattcggacggatcctttttcctatactccaagctcaccgttgacaaatcaagatggcaacagggtaacgtgttcagttgctctgtcatgcatgaagctctgcacaatcactatacacagaaaagcctttccctgtcaccaggcaag

SEQ ID NO: 23619 - RNA, 642 nt, synthetic construct
  misc_feature 1..642: note = derived and/or modified sequence opt3 from PF-05082568_LightChain1
  source 1..642: mol_type = other RNA
agctacgagctgacccagcccccttccgtgtctgtctcaccaggccaaacagccagtatcacttgcagcggggacaacattggagatcagtatgctcactggtaccagcagaagccgggtcaatcccccgttctcgtgatatatcaggacaaaaatagaccttctggcatcccagaaaggttctcggggtcaaacagcggaaatacggcaacccttacaattagtggcactcaggccatggatgaggcggactactattgtgctacctacacaggttttgggtccctggccgtattcggaggcggcaccaagttgactgtgttagggcagcccaaagcagccccttctgtcacactgtttccacccagctccgaagaactacaagctaacaaggcaaccctcgtgtgcctgatctcagatttctatcctggagccgttacggtggcttggaaagccgacagtagcccagtcaaggcgggtgtggaaactaccacaccgtctaagcagtccaataacaaatacgcagcctcaagctaccttagtctgactcccgagcagtggaagtctcatcggtcctatagctgtcaggtaacccacgagggctcgacagttgagaaaaccgtggctcctacggagtgctct

SEQ ID NO: 23620 - RNA, 1341 nt, synthetic construct
  misc_feature 1..1341: note = derived and/or modified sequence opt3 from Pidilizumab_HeavyChain1
  source 1..1341: mol_type = other RNA
caggtgcaactggtccagagcggctccgagctcaagaaacccggggcctctgttaagatctcatgcaaagctagtggatacaccttcacaaactatggtatgaattgggtgagacaggcacctggccaggggcttcaatggatgggatggattaacactgacagcggcgaatccacgtacgccgaggaatttaagggtaggttcgtattttctctggatacctcggtgaatacagcgtatttgcagataacttcattaaccgctgaggacacagggatgtacttctgtgtccgggtgggatatgatgccctggactactggggccagggcaccctagttactgtgagcagtgcatccacaaaagggccatctgtctttccgctcgcccccagctccaagtcaaccagtggaggtacggctgcactgggctgccttgtgaaggattatttccctgaaccagtaactgttagctggaactctggggccctgacctccggagtgcacacatttcccgctgtcttgcagtcaagcggcctctacagtctgtcttccgtggtgactgtccctagctcgtctctgggtacccaaacatacatctgtaatgttaaccataaaccatccaataccaaggtggacaaacgcgtagagcccaagtcatgcgataaaacgcacacttgtcctccatgcccggcccccgagctcttagggggacctagtgtgttcctgtttccacccaagcctaaggacacacttatgattagccgaaccccagaagtcacttgtgtggttgtggatgtctcccatgaggaccccgaagtgaaattcaactggtatgtagatggcgttgaggtgcacaatgcgaagacaaaaccgcgtgaggaacagtacaactctacctatagagtcgtgagcgtcttgacggtgctgcatcaggactggctaaatggcaaggagtacaaatgcaaggtttcaaacaaagcactccctgcccccatcgaaaagaccattagtaaggctaaagggcagccaagggagcctcaagtgtatacactgcccccatcccgggaagagatgactaagaatcaggtaagccttacctgtctggtcaaaggattttacccctctgatatcgccgtggagtgggaatcaaacggtcagcctgagaataactataagacaactccaccggttttggacagtgacggcagcttctttctctactccaaactgaccgtggataagtctcgctggcaacaggggaacgtcttctcgtgcagcgtgatgcacgaagcattacacaatcattacacacagaagtccctgtcactcagtcccggaaaa

SEQ ID NO: 23621 - RNA, 639 nt, synthetic construct
  misc_feature 1..639: note = derived and/or modified sequence opt3 from Pidilizumab_LightChain1
  source 1..639: mol_type = other RNA
gagatcgtgctgacccagagcccctcctctctctcagccagtgtcggcgacagagttacaattacttgcagcgctaggtcctctgtgtcgtacatgcactggttccaacagaagcctgggaaagcaccaaaactttggatatatcggacgtcaaacctggccagcggagtaccgagtcgcttttccggttctggcagcgggacctcctactgtttgacaatcaattcattacagcccgaagatttcgcgacttattactgccagcaacgaagtagctttcctctgaccttcggaggcggtacaaagctagagattaagcgtaccgtggctgccccatctgtctttatctttcccccttccgacgaacagctcaaatcagggactgcaagcgtggtttgtctgcttaacaatttctatccaagagaggccaaggtgcagtggaaggtcgataacgctctgcagagtggaaattctcaagaatccgtgacagagcaggacagcaaagattcgacctactctttgtcctcaacgctcactctgagtaaggcagactatgagaaacataaggtatacgcctgcgaagttacccaccagggcctgagctcccccgtgacaaaatctttcaacaggggcgagtgt

SEQ ID NO: 23622 - RNA, 1350 nt, synthetic construct
  misc_feature 1..1350: note = derived and/or modified sequence opt3 from Pinatuzumab_vedotin_HeavyChain1
  source 1..1350: mol_type = other RNA
gaggtgcagctggtcgaaagcggcgggggactcgttcaacccggtggctcccttagactgtcttgcgccgcttcagggtacgagttcagtaggagctggatgaactgggtgcggcaggcacctggaaagggcttggaatgggtaggtcgcatctatccaggggacggagataccaattactccggcaaatttaagggccgattcacaatttctgccgacacttcgaaaaacacggcgtatttacagatgaatagcctgcgtgctgaggataccgccgtgtactattgtgcaagagacgggtcaagttgggattggtactttgacgtctggggacagggtacattagtgactgtttcctctgccagcaccaagggcccgtccgtgttccccctcgctccttcaagtaaaagcacatctgggggaaccgcagccctgggctgccttgtcaaggattattttccagaacccgtgactgtatcctggaactcaggtgctctgacaagcggggttcacaccttccctgccgtgttgcaaagttctggactctactccctgagctcggtcgtgacggtgccatcttcctcactgggcactcagacctacatatgtaatgtcaaccataagcccagtaatacaaaagttgacaagaaagtggagcctaagagctgcgataaaactcacacctgtccaccgtgccccgcgcctgagctcttaggcgggccatccgtatttctgtttccccctaagccaaaggacacacttatgatctctaggacccccgaagtgacgtgtgtcgtggttgatgtgagccatgaggacccggaagtcaaatttaactggtatgtggatggagtagaggttcacaatgcaaagactaaacctcgggaggaacagtacaactcaacatatcgcgtggtcagtgtgttgaccgtcctgcatcaggactggctaaatggtaaggagtacaaatgcaaggtgtccaacaaagccctccccgctccaattgaaaagactatcagcaaggccaaaggccaacctagagagccccaggtttatacactgccaccctctagggaagagatgaccaagaatcaggtgtcacttacgtgtctggtaaaagggttctaccctagtgacattgcagtcgagtgggaaagcaacggacagccagagaataactataagaccacaccgcccgtgttggattccgacggctctttcttcctctactcgaaactgactgttgataagagccggtggcaacagggtaacgtgttttcctgctcagtcatgcacgaagctctacacaatcattacacccagaagagtctgtctctcagccctgggaaa

SEQ ID NO: 23623 - RNA, 657 nt, synthetic construct
  misc_feature 1..657: note = derived and/or modified sequence opt3 from Pinatuzumab_vedotin_LightChain1
  source 1..657: mol_type = other RNA
gacatccagatgacccaaagcccctcctctctgtcagccagtgtgggcgatagagtcacaattacttgcaggagctcccagtctatagttcactcggtggggaacacgttcctcgagtggtaccagcagaagcctggaaaagctccaaaacttctgatctataaggtatcaaatcggtttagcggtgtgccgagtcgcttctccggctctgggagcggaaccgactttacattgactatttcctcattacaacccgaagatttcgcaacctactattgttttcagggcagtcagttcccttacacatttggtcaggggaccaaggtcgagatcaaacgaactgtggccgcgccaagcgttttcatttttcccccttctgacgaacaactgaagtccggaacagcttcagtggtctgcctactcaacaatttctatccacgtgaggccaaggtgcagtggaaagtagataacgcactgcagagcggcaatagtcaggaatctgttaccgagcaagactccaaggatagcacgtactcgctttcttccactctgaccttgtcaaaagccgactatgagaagcataaagtgtacgcttgtgaagtcacacaccagggcctcagtagccccgtgactaagtcctttaacagaggggagtgc

SEQ ID NO: 23624 - RNA, 1023 nt, synthetic construct
  misc_feature 1..1023: note = derived and/or modified sequence opt3 from Placulumab_chain1
  source 1..1023: mol_type = other RNA
gacatccagatgacccaaagcccctcctctctgtcagccagtgtgggcgatagagtcacaattacttgcagggctagccaggcaatagactcctacctccactggtatcagcagaagcctgggaaagccccaaaacttctgatctactctgcgtcgaacttggagacgggagttccgtcacggttcagcggtagtggctccgggaccgattttacattaactatttctagcctgctacccgaagacttcgctacctattactgtcaacaggtggtatggcgcccttttacattcggacagggcaccaaggtggagatcaagcgagtcgaaccaaaatcctcagataagactcatacatgcccgccttgtccagcccccgagctcctgggtgggcctagtgtgtttcttttcccaccgaagcccaaagacaccctgatgattagccgtacgcctgaagttacttgcgtggtcgtggatgtatctcacgaggacccagaggttaagtttaattggtatgtggatggagtcgaagtgcataacgcaaaaaccaagcccagagaggaacagtacaattccacatatagggtggtctcagttttgactgtgctccaccaagactggctgaacggcaaagagtacaagtgtaaggtaagcaataaagccctgcctgctccaatcgagaagaccataagtaaagcaaagggccagccccgggaaccccaggtgtacacactccctccctctcgcgatgagttaaccaaaaaccaggtctccctgacgtgccttgtgaaggggttctatccaagcgacatcgccgttgaatgggagtcgaatggacaacctgaaaacaattacaaaactacacccccagtgttggattctgacggttcctttttcctgtattcaaagctaaccgtcgacaagagtagatggcagcagggcaacgtgtttagctgttccgtaatgcatgaggctctccacaatcactacactcaaaaatctctgagcctttcacccgggaag

SEQ ID NO: 23625 - RNA, 1023 nt, synthetic construct; identical to SEQ ID NO: 23624
  misc_feature 1..1023: note = derived and/or modified sequence opt3 from Placulumab_HeavyChain1
  source 1..1023: mol_type = other RNA

SEQ ID NO: 23626 - RNA, 1341 nt, synthetic construct
  misc_feature 1..1341: note = derived and/or modified sequence opt3 from Plozalizumab_HeavyChain1
  source 1..1341: mol_type = other RNA
gaggtgcagctggtcgaaagcggcgggggactcgttaagcccggtggctcccttagactgtcttgcgccgcttcagggttcacctttagtgcatacgccatgaactgggtgaggcaggcgcctggaaaaggcttggagtgggtaggtcggatccgcacaaagaataacaattatgctacttactatgccgacagcgtgaaagatcgattcacgatttcccgtgacgattctaagaacaccttatacctgcagatgaatagtctaaaaacagaagacactgcagtctattactgtaccacattttatgggaacggagtgtggggccagggcaccctcgttactgtgtcaagcgccagtacaaaggggccatccgtcttcccgctggctccctctagcaagtccacctcaggaggtacggcagcccttggctgcctggtgaaagattactttcctgagccagtaactgttagttggaatagcggggctttgacctctggagtgcacacattccccgccgtcctccagtcctcaggcctgtacagcctgagttctgtggtgactgtcccttccagctcgctcggtacccaaacatatatatgtaacgttaatcataagccatctaacaccaaagtggacaagaaagtagaacccaagtcctgcgataagacgcacacttgtcctccatgcccggcgcccgagttagcaggggccccttcagtgtttctgttcccacccaaacctaaggacacacttatgatcagtagaaccccagaggtcacttgtgtggttgtggatgtcagccatgaagaccccgaggtgaaatttaattggtacgtagatggagttgaagtgcacaacgctaagacaaaaccgagggaggagcagtataattccacctaccgggtcgtgtctgtcttgacggtgctgcatcaggactggctaaacggcaaggaatataaatgcaaggttagcaataaggccctccctgcacccattgagaaaaccatctcaaaggctaaaggccagccacgcgaacctcaagtgtacacactgcccccaagtagagatgagcttactaagaaccaggtatccctgacctgtttggtcaaagggttctatcccagcgacattgccgtggaatgggagtctaacggacagcctgagaataactacaagacaactccaccggttctcgactcagatggttcgtttttcctgtacagcaagttaaccgtggacaaatccaggtggcagcaaggcaatgtcttttcttgctcggtgatgcacgaagcgctgcacaaccattatacacaaaagagcctctccctttcacccgggaaa

SEQ ID NO: 23627 - RNA, 657 nt, synthetic construct
  misc_feature 1..657: note = derived and/or modified sequence opt3 from Plozalizumab_LightChain1
  source 1..657: mol_type = other RNA
gacgtggtcatgacccagagccccctgtccctccctgttacacttggccaaccagcctctatctcatgcaagagtagccagtccctgttggattctgacgggaaaactttcttaaactggtttcagcagagaccgggacaatcgcccaggcggctgatttacctagtgtcaaagctcgatagcggtgtacctgaccgcttcagtggctccgggtctggaacggattttaccctgaaaataagccgagtggaggctgaagacgtcggcgtgtattactgttggcagggtacacacttcccatatacttttgggcagggaacccgtcttgagatcaagagaacagttgcagccccctccgtgttcatttttcctccatcagatgaacagctgaaaagtggcaccgcgagcgtcgtgtgcttgctcaataacttctaccccagggaggctaaggtacaatggaaggttgacaatgccctgcagtctggcaactcccaggaatcagtgactgagcaggatagcaaagacagtacatattctctgtccagcaccctcacgttatcgaaggcagattacgagaaacataaggtctatgcctgtgaagtgactcaccaagggctgtcttcccctgtgaccaaatcatttaatcggggagagtgc

SEQ ID NO: 23628 - RNA, 1341 nt, synthetic construct
  misc_feature 1..1341: note = derived and/or modified sequence opt3 from Pogalizumab_HeavyChain1
  source 1..1341: mol_type = other RNA
gaggtgcagctggtccaaagcggcgccgaagttaagaaacccggggcttccgtgaaggtatcttgcaaagcatcaggatacaccttcacagacagttatatgagctgggtgagacaggcccctggtcagggcctcgagtggatcggggatatgtacccagacaacggagattcctcttataatcagaagtttagggaacgggtcactattacgcgcgacacctcgacatcaactgcgtaccttgagctgagcagtttgcgatccgaagataccgctgtgtattactgtgttttagccccgcgttggtatttctctgtgtggggccaaggtacactggtcaccgtgagctccgcatcaactaaagggcccagtgtatttcctctagccccaagctctaagtccacatcaggaggcaccgctgcactcggctgcctggttaaggactacttccccgagcctgtgacggtcagctggaacagtggggcccttacttctggagtgcacacctttccagctgtgctgcagtccagcggtttgtactcgctctcttccgtcgttacagtgccctcaagtagcctgggcactcagacctatatatgtaatgtaaaccataaaccttccaatacaaaggtggataaaaaggtcgagccaaaatcttgcgacaagacccacacgtgtccgccctgccctgccccagaactgctcgggggacccagcgtgttcttatttcctccaaagcccaaagatactctgatgatctcaagaacaccggaggttacctgtgtggtcgtggacgtaagtcatgaagatcctgaggttaagttcaactggtacgtggacggcgtcgaggtgcacaatgcgaaaactaagcccagggaggaacagtataactccacataccgggtcgtgagcgttcttaccgtgttgcatcaagattggctgaatggtaaagaatataagtgcaaagtatctaacaaggcactaccagcccctattgagaagacgatctcaaaagctaaggggcagccccgcgaaccacaggtctacaccctgccccctagtagagaggagatgactaaaaatcaggtgagcctcacatgtcttgttaagggattttatccatccgacattgccgtggaatgggagtctaacggccaaccggaaaataactacaaaaccacaccccctgtcctggactcggatggcagcttctttttgtactccaagctcactgtggacaagtcaaggtggcagcaggggaatgtattcagttgctctgtgatgcacgaggcactgcacaaccattatacccaaaagagcttatccctgtcaccaggaaaa

SEQ ID NO: 23629 - RNA, 642 nt, synthetic construct
  misc_feature 1..642: note = derived and/or modified sequence opt3 from Pogalizumab_LightChain1
  source 1..642: mol_type = other RNA
gacatccagatgacccaaagcccctcctctctgtcagccagtgtgggcgatagagtcacaattacttgcagggctagccaggacatatccaactacctcaattggtatcagcagaagcctgggaaagcaccaaaacttctgatctactatacgtctcggttgcgctcgggagttccgtcacgattcagcggtagtggctccgggaccgattttacattaactatttctagcctgcaacccgaggacttcgccacctactattgtcagcagggacacacactacctccaacctttggccagggtactaaggtggaaatcaagcgtacagtagcggctccctccgtgttcatttttcctccatcagatgagcaactcaaaagtgggaccgccagcgtcgtgtgcctgcttaacaatttctaccccagagaagcaaaggttcagtggaaggtggacaacgccctgcagtctggaaattcccaggagtcagtcacggaacaagatagcaaagacagtacttattctttgtccagcaccctcacactgtcgaaggctgattacgagaaacataaggtgtacgcatgtgaggtaactcaccagggcctgtcttcccctgttaccaaatcatttaacaggggcgaatgc

SEQ ID NO: 23630 - RNA, 1341 nt, synthetic construct
  misc_feature 1..1341: note = derived and/or modified sequence opt3 from Polatuzumab_vedotin_HeavyChain1
  source 1..1341: mol_type = other RNA
gaggtgcagctggtcgaaagcggcgggggactcgttcaacccggtggctcccttagactgtcttgcgccgcttcagggtacaccttcagtagctattggatcgagtgggtgaggcaggcacctggaaagggcttggaatggattggtgagatattaccagggggaggcgacacaaactacaatgaaatctttaaaggccgggccactttctccgcggatacgtctaagaacaccgcttatctgcagatgaactcgctacgcgccgaggacacagcagtatactattgtactcgacgtgtgccgattagactcgattactgggggcagggaaccctggtcacagtgtcaagcgccagtaccaaaggtccctccgtttttcctcttgctccatctagcaagtccacttcaggcgggacagcagccctgggatgcttggtgaaagactatttccccgagcctgtcaccgtgagttggaatagcggcgctctcacgtctggtgtacacacttttccagccgttctgcaatcctcagggctgtacagcctcagttctgtggtcaccgtgccctccagctcgttaggaacacagacttacatctgtaatgtgaaccataagccttctaataccaaggtcgataaaaaggttgaaccaaaatcctgcgacaagacacacacctgtccgccctgccctgcgccagagctgcttggcggcccctcagtgttcttgtttcctccaaaacccaaggatacgctgatgattagtaggactccggaagtaacatgtgtggtcgtggacgttagccatgaggatcctgaggtgaagttcaactggtatgtcgacggggtggaagtacacaatgcaaaaaccaagccccgggaggaacagtacaactccacttatcgcgttgtgtctgtcctaacagtgctccatcaggattggctgaatggaaaagagtacaagtgcaaagtcagcaacaaggcccttccagctcctatcgaaaagaccatatcaaaggccaagggtcaacccagagagccacaggtgtatacgctgccccctagtagggaggaaatgaccaaaaatcaggtttccttgacatgtctcgtgaagggcttttacccaagcgacatcgcagtagagtgggaatctaacgggcagccggagaataactataaaactacaccccctgtcctggattcagacggaagtttctttttatacagcaagctgaccgtggacaaatcccggtggcaacagggcaacgttttctcttgctcggtgatgcacgaagctctccacaatcattacactcagaaaagcctttccctgtcaccaggtaag

SEQ ID NO: 23631 - RNA, 654 nt, synthetic construct
  misc_feature 1..654: note = derived and/or modified sequence opt3 from Polatuzumab_vedotin_LightChain1
  source 1..654: mol_type = other RNA
gacatccagctgacccaaagcccctcctctctctcagccagtgtgggcgatagagtcacaattacttgcaaggctagccagtccgttgactacgagggggattctttccttaactggtatcagcagaaacctggaaaggcaccaaaactgttgatatacgccgcgtcgaatttagaatcaggtgtgccgagcaggtttagtggctccgggtctggaacggacttcaccctgacaatcagctccctacaacccgaggattttgctacttattactgtcagcagtcaaacgaagaccctctcaccttcggccagggtacaaaggtagagattaaacggaccgtggccgcaccaagtgtctttatctttccccctagcgatgaacaactgaagtctgggactgcctccgtggtttgccttctgaataacttctatccacgcgaggctaaggtgcagtggaaagtcgacaatgcattgcagtcaggaaacagccaggagagtgtgacagaacaagattctaaggactccacctacagcctctcgtctacgctgactctgtccaaagccgattatgagaagcacaaagtatacgcttgtgaagttacccatcagggcctctcaagtcccgtgacaaagagcttcaatcgaggcgagtgc

SEQ ID NO: 23632 - RNA, 1326 nt, synthetic construct
  misc_feature 1..1326: note = derived and/or modified sequence opt3 from Ponezumab_HeavyChain1
  source 1..1326: mol_type = other RNA
caggtgcaactggtccagagcggcgccgaggttaagaaacccggggcttccgtgaaggtatcttgcaaagcatcaggatactataccgaagcctactatatccactgggtgagacaggcgcctggtcagggcctcgagtggatggggaggattgacccagctacaggaaacactaagtacgccccgcggcttcaagatcgcgtcacgatgacccgagacacaagtactagcaccgtgtatatggaactgtcctctttgcgttcggaggatacagcagtttactattgtgcctcattatacagcctgcccgtgtactggggccagggtaccactgtcacagtgagttccgcttctaccaaagggcctagcgtattcccactagcaccctgctccagatcaacgagtgaaagcactgccgctctcggatgtctggttaaggactattttcctgagccagtgaccgtctcttggaactccggcgcccttacatcaggcgtgcatactttccccgcggtgctgcagagcagtgggttgtactctctctccagcgtcgttaccgtgccttcgtctaattttggaacacagacctatacgtgcaatgtagatcacaagccatccaacactaaagtggacaagacagtcgagaggaaatgttgcgtggaatgtccgccctgccctgcaccacccgttgccggtccttcagtgttcctgtttccacccaagccgaaagataccctgatgataagtcggactcctgaggtcacatgtgtggtagttgacgtgagccatgaagatcccgaggtccaattcaattggtacgtggacggcgtcgaggtgcacaacgctaagaccaagccacgcgaggaacagtttaattccacgttcagagttgtgtctgtactcaccgtcgtgcatcaggattggttaaacgggaaagaatataagtgcaaagttagcaataagggactgccttcaagtatcgagaaaacaatttccaagactaaaggccagcccagggaaccacaagtgtacacccttccccctagccgggaggagatgacaaagaaccaggtctctttgacttgtctggtgaagggtttttatccatcagacatcgccgtagaatgggagagtaatgggcagccggaaaacaattacaaaaccacaccccctatgctagatagcgacggatccttctttctctactctaagctgaccgtggacaaatcgcgctggcaacagggcaacgttttcagctgctccgtcatgcacgaggcacttcacaatcattatactcagaagtcactgagtttgtctccaggcaaa

SEQ ID NO: 23633 - RNA, 657 nt, synthetic construct
  misc_feature 1..657: note = derived and/or modified sequence opt3 from Ponezumab_LightChain1
  source 1..657: mol_type = other RNA
gacgtggtcatgacccagagccccctgtccctccctgttacacttggccaaccagcctctatctcatgcaagagtagccagtccctgttgtactctgatgctaaaacttatttaaactggttccagcagagaccggggcaatcgcccaggcggctgatttaccagatatcacgcctagaccctggagtgccagatcgatttagcggtagtggctccgggacggacttcaccctcaagatctctcgtgtagaggcagaagatgtgggagtctattactgtctgcagggcacacactatcccgtgctttttggtcaggggactagactggagattaaaaggaccgttgccgcgcctagcgtgttcatctttccaccctccgacgaacaattgaagtcaggaacagctagtgtcgtgtgcctcctgaataacttctaccctcgggaggccaaagtacagtggaaggttgataatgcactgcagagcggcaactctcaggaatccgtgaccgagcaagactcaaaggatagcacttatagtctctcttccacattaaccctgagcaaagccgactacgagaagcataaagtctacgcttgtgaagtgacgcaccagggcctttcgtctccagtgactaagtcctttaatcgcggggagtgc

SEQ ID NO: 23634 - RNA, 1362 nt, synthetic construct
  misc_feature 1..1362: note = derived and/or modified sequence opt3 from Pritoxaximab_HeavyChain1
  source 1..1362: mol_type = other RNA
caggtgcaactgcaggagagcggcgccgaactcgtcagatccggggcttctgttaggatgtcatgcaaggcaagtggatacaccttcacaagctataacatgcactgggtgaaacagactcccggtcagggccttgagtggatcgggtacatttatcctggaaatggcggtacgaactacatacaaaagtttaaagggaaggccatcctgaccgcggacacatcctcttcgactgcttatatgcagattagcagcttgaccagtgaagattccgccgtatacttctgtacacggtctccaagccattattcctcagacccgtactttgattactggggacagggcaccactttaacagtgagtagcgagttcgcatctaccaaaggcccctccgtctttcctctggccccatcaagcaagagtacgtctgggggaactgctgcactaggttgcctcgtgaaggactatttccccgaacctgttaccgtgtcctggaatagcggcgccctgacatcgggggtccacacttttccagctgtgcttcagtcttccggactgtactcattgagtagcgtagttaccgtgccctcctctagcctcggcacacaaacctatatctgtaacgtcaatcataaaccttcaaacacgaaggtggataaaaaggtggagccaaaaagttgcgacaagactcacacatgtccgccctgccctgccccagagctgctgggtgggccctccgtcttcctctttcctccaaagcccaaagataccttaatgattagccgcactccggaagttacatgtgtggtagtggacgtctctcatgaggatcctgaagtgaagttcaattggtacgttgacggagtggaggtccacaacgcgaaaaccaagccccgagaggaacagtataattcaacgtaccgtgtggtaagtgttctgaccgtgcttcaccaggattggttgaacggcaaagagtataagtgcaaagtcagcaataaggcactgccagcccctatcgaaaagacaatatccaaagctaagggccagcccagagagccacaagtgtacactctacccccttctagggacgaactcaccaaaaaccaggtctcgctgacatgtcttgtgaaggggttttacccaagcgatatcgccgttgagtgggagtccaatggacagccggaaaacaattataaaactacaccccctgtgctggactcagacggtagtttctttttgtactctaagctcaccgtagataagagccggtggcaacagggcaacgtcttctcctgctcagtgatgcatgaggcactgcacaaccattatacccagaaatcattatctctgtccccagggaag

SEQ ID NO: 23635 - RNA, 642 nt, synthetic construct
  misc_feature 1..642: note = derived and/or modified sequence opt3 from Pritoxaximab_LightChain1
  source 1..642: mol_type = other RNA
gacatcgtgatgagccagtcccacaagttcatgtctacctcagtcggcgatagagttagtattacatgcaaagccagccaagacgtggggactgctgtagcatggtaccagcagaaccccggacagtcccctaagtttctgatatattgggcctctacgaggcataccggtgtgccagatcggttcacaggctcggggtcaggaactgactttaccctcacaatcaccaatgtccaaagcgaggatcttgcggactacttctgtcagcagtatagttcctacccgctgacttttggcgctggtacatctttggaattaaaacgcaccgtggccgcacccagcgttttcatttttcctccatccgatgagcagctgaagtcagggacggccagtgtggtctgcctactcaacaatttctatccccgagaagctaaagtgcaatggaaggtagacaacgcactgcagagcggaaattctcaggagtccgttactgaacaggattcaaaggacagcacctacagtctttcttccacactgactttgagcaaagccgattatgagaagcacaaagtgtacgcttgtgaggtcacccatcaaggcctctcgtctcctgtgacaaagtcctttaaccgtggcgaatgc

SEQ ID NO: 23636 - RNA, 1350 nt, synthetic construct
  misc_feature 1..1350: note = derived and/or modified sequence opt3 from Pritumumab_HeavyChain1
  source 1..1350: mol_type = other RNA
gaggtgcagctgctcgaaagcggcggggaccttgtccaacccggaggttccctgagattgtcttgcgccgcttcaggcttcacctttagtaactacgcaatgagctgggttaggcaggcccctgggaagggattagagtgggtgtccgcgatcacaccatctggcggttcgactaattatgctgattcagtaaaagggcggttcacgattagccgcgacaacagtcagaataccctgtacctacagatgaactccctccgagtggaagatacagccgtctatatatgtggacgtgtgccgtacagatctacttggtatcccctgtactggggccaaggcacccttgttacagtgagctccgcatcaaccaaggggcctagtgtctttccactggcccccagctctaaatccacttcaggaggtacagctgcattgggctgcctcgtgaaggactatttccctgagccagtaaccgttagctggaatagtggggccctgacgtctggagtgcacacttttcccgctgtcctgcagtccagcggcctctactcgttatcttccgtggtgaccgtcccttcaagtagcctgggtacacagacttacatctgtaacgttaatcataaaccatccaacaccaaggtggataagaaagtagaaccgaagtcttgcgacaaaacacacacctgtcccccttgcccagcccccgagcttttgggagggcctagcgtgttcctgtttccacccaagccgaaagatacgctaatgatttcaaggactcctgaggtcacatgtgtggttgtggacgtcagtcatgaagatcccgaggtgaagttcaattggtatgtagacggcgttgaagtgcacaacgcgaagaccaaaccacgggaggagcagtacaattccacttatcgcgtcgtgagcgtcctcacagtgctgcatcaagattggcttaacggcaaggaatacaaatgcaaggtttctaataaagcactgcctgcccccatcgagaagaccatttcaaaagctaaggggcagccaagagaaccccaggtgtatacgttgcctccaagtagggacgagctcaccaagaaccaggtaagcctgacatgtttagtcaaaggattttacccgtccgatatcgccgtggaatgggagtctaatggtcaacccgagaacaactataagactacccctccagttctggactcggacggcagcttctttctctactccaaacttacagtggataagtcacggtggcagcaggggaatgtcttcagttgctctgtgatgcacgaagcactgcacaaccattacactcaaaagagcttgtccctatcacccggaaaa

SEQ ID NO: 23637 - RNA, 642 nt, synthetic construct
  misc_feature 1..642: note = derived and/or modified sequence opt3 from Pritumumab_LightChain1
  source 1..642: mol_type = other RNA
gacatccagatgacccaaagcccctcctctctgtcagccagtgtgggcgatagagtcacaattacttgcagggctagccaggacatatccaactacctcgcatggttccagcagaagcctgggaaagccccaaagtctcttatctatgcggcttcgtcactgcacagcaaagttccgacgcaatttagtggatccggttctggcaccgatttcacattgactattagctccttacagcccgaggactttgccacctactattgtctgcagtactcaacatatcctatcaccttcgggggaggcactaaggtggaaattaaacggacagtagcagccccaagtgtgtttatctttccccctagcgatgagcagctaaagtctggtaccgcttccgtcgtgtgcctcctgaataacttctacccacgcgaagcaaaggttcaatggaaagtggacaatgcccttcagtcagggaacagccaggagagtgtcacggaacaggattctaaggactccacttatagcctgtcgtctaccttgacactctccaaagctgattacgagaagcataaagtgtacgcctgtgaggtaactcaccaaggactgtcaagtcccgttaccaagagcttcaatcgaggcgaatgc

SEQ ID NO: 23638 - RNA, 1341 nt, synthetic construct
  misc_feature 1..1341: note = derived and/or modified sequence opt3 from Quilizumab_HeavyChain1
  source 1..1341: mol_type = other RNA
gaggtgcagctggtcgaaagcggcgggggactcgttcaacccggtggctcccttagactgtcttgcgccgcttcagggttcacctttagtgactacggaatcgcatgggtgaggcaggcccctggcaagggtttggagtgggtagcgttcattagcgatttagcttatacaatatactatgccgacactgtgacggggcggtttaccatctcccgcgataactctaaaaatacactgtacctacagatgaactcgctccgagcagaagacactgccgtctattactgtgctcgtgataattgggacgcaatggattattggggacagggcaccctggtgacagtttcaagcgccagtaccaagggcccatccgtgttcccgcttgctccctctagcaaatccacttcagggggaacagccgcgctgggttgcttggtcaaggactactttcctgagccagtgaccgtaagttggaacagcggcgcactcacgtctggggttcacactttccccgccgtgctgcaatcctcaggactgtacagcctcagttctgtcgtgaccgtgccttccagctcgttaggcacacagacttatatttgtaatgtcaaccataaaccatctaataccaaggttgataagaaagtggaacccaagtcctgcgacaaaacacacacctgtcctccatgcccggctcccgagctgcttggtgggccttcagtatttttgttcccacccaagcctaaagatacgctgatgatcagtagaactccagaggtgacatgtgtcgtggttgacgtgagccatgaagatcccgaggtcaagtttaactggtacgtggacggagtagaagttcacaatgccaagaccaaaccgagggaggagcagtataactccacttaccgggtggtctctgtgctaacagtcctccatcaggactggctgaatggcaaggaatataaatgcaaggtgagcaacaaagcacttcctgctcccattgagaagaccatctcaaaagccaagggccaaccacgcgaacctcaggtttacacgctgcccccaagtagagaggaaatgaccaagaatcaggtgtccttgacatgtctcgtaaaagggttctatcccagcgatatagcggtcgagtgggagtctaacggacagcctgaaaataactacaagactaccccaccggtgctggactcagatggtagctttttcttatacagtaaactgacagttgacaagtccaggtggcaacagggcaacgtgttttcttgctcggtcatgcacgaggccctccacaatcattatactcagaaaagcctttccctgtcacccgggaag

SEQ ID NO: 23639 - RNA, 657 nt, synthetic construct
  misc_feature 1..657: note = derived and/or modified sequence opt3 from Quilizumab_LightChain1
  source 1..657: mol_type = other RNA
gacatccagatgacccaaagcccctcctctctgtcagccagtgtgggcgatagagtcacaattacttgcaggagctcccagtctctcgttcacaacaatgctaacacgtaccttcattggtatcagcagaagcctgggaaagcaccaaagctgttgatatacaaagtgtcgaatcggttctcaggagtaccgagccgctttagtggttccggctctgggaccgacttcacattaactatcagctccctgcaacccgaggattttgccacctattactgttcacagaacaccctagtgccttggacattcggacagggcactaaggtcgaaattaaacgaacagtggcggctccaagtgtttttatctttccccctagcgacgagcagctcaagtctggtaccgcctccgtggtctgcctgcttaataacttctatccacgtgaagcaaaggtgcaatggaaagtagataatgccctgcagtcagggaacagccaggagagtgttacggaacaggactctaaggattccacttacagcttgtcgtctaccctcacactgtccaaagctgactatgagaagcacaaagtgtacgcatgtgaggtcactcatcaaggactgtcaagtcccgtgaccaagagcttcaatagaggcgaatgc

SEQ ID NO: 23640 - RNA, 1335 nt, synthetic construct
  misc_feature 1..1335: note = derived and/or modified sequence opt3 from Racotumomab_HeavyChain1
  source 1..1335: mol_type = other RNA
caggtgcaactgcagcagagcggcgccgagctcgtcaagcccggggcttccgttaaactttcttgcaaggcatcaggatacaccttcacaagttatgacatcaactgggtgagacagaggcctgaacaaggtctggagtggattggctggatatttccaggggatggaagcactaaatacaatgaaaagttcaaaggcaaggccacgttgaccacagacaagtcctcttcgactgcgtatatgcagttatcacggctgaccagcgaggatagtgctgtatacttttgtgcccgcgaagactattacgataactcctattacttcgactactggggtcaggggacaaccctaactgtgtctagcgcaaaaacaaccccgccctccgtctatcctctcgccccaggatcagctgcacagacgaatagtatggtgactctgggctgccttgttaagggctactttcccgagcctgtgaccgtcacatggaacagcgggtctctgtcctcaggagtgcacactttcccagccgtattgcaaagcgatctctataccctgagttcttccgttacagtgcccagctcgcctcgaccatctgagaccgtcacgtgtaatgtggctcatccggcctcctcaactaaagtggacaagaaaatcgtcccccgtgattgcggttgtaagccttgcatttgtacagttccagaagtgagtagcgtatttatctttccccctaagccaaaagacgtgctgaccattactctcacacccaaggtgacctgcgtcgttgtggatatctccaaagacgatccggaggtccagttctcttggttcgtggacgacgtagaagttcacacggcgcagacccagcctagagaggagcaatttaacagcacattcaggtcagtgagtgaattacccataatgcatcaggattggctgaatggcaaggagtttaaatgtcgggtcaactccgcagccttcccagctcctatcgaaaagactattagcaaaaccaaggggcgccccaaggccccacaggtgtacacaattccccctccaaaagagcaaatggcaaaggacaaagtctctcttacttgcatgatcaccgatttctttccggaagacatcacagtggagtggcagtggaatggacagcccgctgagaactataagaatacccagcctataatgaacactaatggctcatacttcgtttatagtaaattgaacgtgcaaaagagcaattgggaagccggtaacacgtttacatgttccgtactgcacgaggggctacataaccaccacaccgaaaagtctctctcgcatagcccaggaaaa

SEQ ID NO: 23641 - RNA, 642 nt, synthetic construct
  misc_feature 1..642: note = derived and/or modified sequence opt3 from Racotumomab_LightChain1
  source 1..642: mol_type = other RNA
gacatccagatgacccaaacaactagctccctgtctgcctcactcggcgatagagtgacgattagttgcagggctagccaggacatatccaactaccttaattggtatcagcagaagcccgatgggaccgtcaaactgttgatctactatacatctcggttacactcgggagttccttcacgcttcagcggtagtggctccgggactgactactctctgaccattagcaacctagagcaagaagatatcgcaacatatttttgtcagcagggaaataccctcccatggactttcggcggtgggacaaagctggagattaaacgagccgacgcggctccgaccgtgtccatctttcccccttcaagtgaacagcttacgagcggaggcgcctctgtagtgtgcttcctgaacaatttttacccaaaggatataaacgtcaaatggaagatcgacggctccgagcgtcaaaatggggtgttgaactcatggactgatcaggacagcaaggatagtacctattctatgtccagcacactcactctgaccaaagacgaatacgagagacataattcgtacacatgtgaggcaacccacaagacgtctacttcccccattgttaaatcattcaacaggaatgaatgc

SEQ ID NO: 23642 - RNA, 1089 nt, synthetic construct; identical to SEQ ID NO: 23580
  misc_feature 1..1089: note = derived and/or modified sequence opt3 from Racotumomab_scVH-VH'-VH_chain
  source 1..1089: mol_type = other RNA

SEQ ID NO: 23643 - RNA, 1071 nt, synthetic construct
  misc_feature 1..1071: note = derived and/or modified sequence opt3 from Radretumab_HeavyChain1
  source 1..1071: mol_type = other RNA
gaggtgcagctgctcgaaagcggcgggggacttgtccaacccggtggctccctgagattgtcttgcgccgcttcagggttcacctttagtagcttctccatgtcttgggttaggcaggcacctggaaagggcttagagtgggtgtcgtcaatcagcggtagttccgggacaacttactatgccgactctgtaaaaggacggtttacgattagccgcgataactccaagaataccctgtacctacagatgaactcactccgagcggaagacacagctgtgtattactgtgccaaaccattcccgtattttgattactggggccagggcactctggtcaccgtgagtagcggggacggatcttccggtggctcagggggagcaagcgagatagttcttacacaaagtcccggcaccctgtctttgtcccctggtgaacgtgccactctcagctgcagagcttcgcagtctgtgtcctcaagtttcctggcatggtatcagcagaagccagggcaagcccccaggctgctcatctactacgctagctcccgggccacaggcattcctgatcgcttttctggaagcggctcagggaccgacttcacgttaactatcagtagactggagccagaggattttgcggtctattactgtcagcagaccggaaggattccccctacattcggtcagggcactaaagtggaaatcaagtccgggggaagcggcggtccacgggcagccccggaggtatatgcttttgccacccccgaatggcctgggtctcgcgacaagcgaacacttgcatgcttgatacaaaatttcatgccagaggatatctcagttcagtggctgcacaacgaggtgcagctacccgacgctagacatagtaccacgcaacctaggaaaactaagggcagcggatttttcgtcttctcccggctcgaagtgacacgtgccgagtgggaacagaaagatgagtttatttgtcgcgcggtgcacgaagccgcatctccatcgcagaccgtccagagagctgttagcgtgaatcccgagtcctcaaggcggggcgggtgc

SEQ ID NO: 23644 - RNA, 414 nt, synthetic construct; identical to SEQ ID NO: 23595
  misc_feature 1..414: note = derived and/or modified sequence opt3 from Radretumab_j_chain
  source 1..414: mol_type = other RNA

SEQ ID NO: 23645 - RNA, 1368 nt, synthetic construct
  misc_feature 1..1368: note = derived and/or modified sequence opt3 from Rafivirumab_HeavyChain1
  source 1..1368: mol_type = other RNA
caggtgcaactggtccagagcggcgccgaggttaagaaacccgggtcctctgtgaaggtatcatgcaaagctagtggaggtaccttcaacagatacacagtgaattgggtcaggcaggcacctggccaggggctcgaatggatgggaggcatcattccaatatttggtactgccaactatgcgcaacggttccaggggcgccttacgatcaccgctgacgagagcacatccactgcctacatggaactgtcttcgttgcgatcagatgacaccgcagtgtatttttgtgcccgtgagaatttagataacagcggaacatactattacttcagtggctggtttgacccgtggggccaggggaccctggttactgtgtcctctgctagcacaaagggaccctccgtcttccctctagcaccatcaagtaaaagcacctctggtggcacggccgctctcgggtgcctggtgaaggattattttcccgaacctgtaactgtttcctggaactcaggagcccttaccagcggcgtgcacacattcccagcggtcctgcagagttctggtttgtactccctcagctcggtggtgactgtcccctcttcctcactggggacccaaacatacatttgtaatgttaatcataagcctagtaacaccaaagtggacaagagagtagagccaaaaagctgcgataagacgcacacttgtccgccctgccctgcaccagagctgctcggaggcccctccgtgtttttattccctccaaaacccaaggacacactgatgatctctaggaccccggaagtcacttgtgtggttgtggatgtcagccatgaggaccctgaagtgaagtttaattggtatgtagatggcgttgaggtgcacaacgccaaaacaaagccccgggaggaacagtacaattcaacctatcgcgtcgtgagtgtccttacggtgttgcatcaggactggctgaacgggaaagagtacaagtgcaaagtttccaataaggctctaccagcccctattgagaaaaccatcagcaaggcaaagggacagcccagagaaccacaagtgtatacactgcccccttctagggaagagatgactaaaaaccaggtatcactcacctgtcttgtcaagggtttctacccaagtgatatagctgtggagtgggaaagcaatggccagccggagaacaactataaaacaactccccctgttctggactccgacgggtcgtttttcttgtactctaagctcaccgtggataaaagccggtggcaacagggaaatgtcttctcctgctcagtgatgcacgaagccctgcacaaccattacacacagaagagtttatctctgagcccaggc

SEQ ID NO: 23646 - RNA, 1368 nt, synthetic construct
  misc_feature 1..1368: note = derived and/or modified sequence opt3 from Rafivirumab_HeavyChain
  source 1..1368: mol_type = other RNA
gaggtgcagctggtccaaagcggcgccgaagttaagaaacccgggtcctctgtgaaggtatcatgcaaagctagtggaggtaccttcaacagatacacagtgaattgggtcaggcaggcacctggccaggggctcgagtggatgggaggcatcattccaatatttggtactgccaactatgcgcagcggttccaagggcgccttacgatcaccgctgacgaaagcacatccactgcctacatggagctgtcttcgttgcgatcagatgacaccgcagtgtatttttgtgcccgtgaaaatttagataacagcggaacatactattacttcagtggctggtttgacccgtggggccaggggaccctggttactgtgtcctctgctagcacaaagggaccctccgtcttccctctagcaccatcaagtaaaagcacctctggtggcacggccgctctcgggtgcctggtgaaggattattttcccgagcctgtaactgtttcctggaactcaggagcccttaccagcggcgtgcacacattcccagcggtcctgcagagttctggtttgtactccctcagctcggtggtgactgtcccctcttcctcactggggacccagacatacatttgtaatgttaatcataagcctagtaacaccaaagtggacaagagagtagagccaaaaagctgcgataagacgcacacttgtccgccctgccctgcaccagaactgctcggaggcccctccgtgtttttattccctccaaaacccaaggacacactgatgatctctaggaccccggaggtcacttgtgtggttgtggatgtcagccatgaagaccctgaggtgaagtttaattggtatgtagatggcgttgaggtgcacaacgccaaaacaaagccccgggaggaacaatacaattcaacctatcgcgtcgtgagtgtccttacggtgttgcatcaggactggctgaacgggaaagaatacaagtgcaaagtttccaataaggctctaccagcccctattgagaaaaccatcagcaaggcaaagggacagcccagagaaccacaggtgtatacactgcccccttctagggaggagatgactaaaaaccaagtatcactcacctgtcttgtcaagggtttctacccaagtgatatagctgtggaatgggagagcaatggccagccggaaaacaactataaaacaactccccctgttctggactccgacgggtcgtttttcttgtactctaagctcaccgtggataaaagccggtggcagcaaggaaatgtcttctcctgctcagtgatgcacgaggccctgcacaaccattacacacagaagagtttatctctgagcccaggc

SEQ ID NO: 23647 - RNA, 654 nt, synthetic construct
  misc_feature 1..654: note = derived and/or modified sequence opt3 from Rafivirumab_LightChain1
  source 1..654: mol_type = other RNA
cagagcgccctgacccaacccagatccgtgtctggctcacctgggcagagtgtcacaatcagctgcactggaacgtcctctgacattggtggctacaacttcgtttcgtggtatcagcagcacccagggaaggctccgaaactcatgatatacgatgcaaccaagaggccctcaggagtgcctgaccggtttagcggcagtaaatccggtaatacagcctctcttactatcagcgggctgcaagcggaggatgaagctgactattactgttgctcctatgccggagattacaccccaggcgtagtgttcggcgggggaacaaagttgaccgtcttaggtcagcccaaagcagccccttcagtgactctgtttccacccagtagcgaggaactacaggctaacaaggcaacactcgtttgtctgatttctgacttctatcctggcgccgtgaccgtcgcttggaaggccgattcctcaccagtgaaagcgggggtagagacgactaccccgagcaagcagagtaataacaaatacgcagcctcttcctaccttagcctgacacccgaacaatggaagtcgcatcgctcttattcctgccaggttactcacgagggatcaaccgtggagaaaacagtcgctcctaccgaatgtagt

SEQ ID NO: 23648 - RNA, 654 nt, synthetic construct
  misc_feature 1..654: note = derived and/or modified sequence opt3 from Rafivirumab_LightChain
  source 1..654: mol_type = other RNA
gagagcgccctgacccagcccagatccgtgtctggctcacctgggcaaagtgtcacaatcagctgcactggaacgtcctctgacattggtggctacaacttcgtttcgtggtatcagcagcacccagggaaggctccgaaactcatgatatacgatgcaaccaagaggccctcaggagtgcctgaccggtttagcggcagtaaatccggtaatacagcctctcttactatcagcgggctgcaggcggaagatgaggctgactattactgttgctcctatgccggagattacaccccaggcgtagtgttcggcgggggaacaaagttgaccgtcttaggtcaacccaaagcagccccttcagtgactctgtttccacccagtagcgaagaactacaggctaacaaggcaacactcgtttgtctgatttctgacttctatcctggcgccgtgaccgtcgcttggaaggccgattcctcaccagtgaaagcgggggtagaaacgactaccccgagcaagcagagtaataacaaatacgcagcctcttcctaccttagcctgacacccgagcagtggaagtcgcatcgctcttattcctgccaagttactcacgagggatcaaccgtggagaaaacagtcgctcctaccgagtgtagt

SEQ ID NO: 23649 - RNA, 1332 nt, synthetic construct
  misc_feature 1..1332: note = derived and/or modified sequence opt3 from Ralpancizumab_HeavyChain1
  source 1..1332: mol_type = other RNA
caggtgcaactggtccagagcggcgccgaggttaagaaacccggggcttccgtgaaggtatcttgcaaagcatcaggatacaccttcacaagttattacatgcactgggtgagacaggcccctggtcagggcctcgaatggatgggggagatccatccaagcggaggcaggactaactataatgaaaagtttaaatcccgggtcacgatgacccgcgacacatctacttcgaccgtgtacatggagctttcaagcctgcgaagtgaagatacagcggtttattactgtgctcgtgagagaccgttgtatgcctccgacttatggggtcaagggaccactgtgacagtctctagcgcatccaccaagggaccctcagtgttccctctggccccatgcagtaggagcacgtctgagtccactgctgcactaggctgtctcgtaaaggattactttcccgaacctgttaccgtgtcatggaacagcggcgccctgacaagtggggtccacactttcccagctgtgcttcagtcttccggactgtacagcttgtcgtctgtggtcaccgttccctcctcaaattttggtacacagacctatacgtgcaacgtggaccataaacctagtaatactaaggtagataaaacagtggagcggaagtgttgcgtcgaatgtccaccgtgccccgcccctccagtggcgggccccagcgttttcctctttcctccaaaacccaaggacaccctgatgatttcccgcactccggaggtgacatgtgtcgtggtagatgtttctcacgaggaccctgaagtgcagttcaactggtacgtcgatggggtggaggtccataatgcaaagaccaaacccagagaggaacaatttaacagcacgttcagggtggtttcagtgctgaccgtagtccaccaggactggctcaatggaaaggaatataaatgcaaggtgagtaacaaaggcttaccatccagcatagagaagacaatctctaaaactaagggtcagcctcgggagccccaggtttacaccctgccaccctcacgcgaagagatgacaaagaatcaagtgagtcttacttgtttggtcaaagggttttatcctagcgatattgccgtggaatgggagtccaacggacagccagaaaataactacaagaccacaccgcccatgctggactctgatggctcgttctttctatatagcaaactcaccgtagacaagtcccgatggcagcaaggcaatgtgttctcatgcagtgttatgcacgaggctctgcataaccactacactcagaaatctcttagcctgtcccctgggaag

SEQ ID NO: 23650 - RNA, 642 nt, synthetic construct
  misc_feature 1..642: note = derived and/or modified sequence opt3 from Ralpancizumab_LightChain1
  source 1..642: mol_type = other RNA
gacatccagatgacccaaagcccctcctctctgtcagccagtgtgggcgatagagtcacaattacttgcaaggctagccaggacgttcacacggcagtggcctggtaccagcagaaacctgggaaggcgccaaaactccttatatatcatgcttcctacaggtataccggagtaccgtctcggttctcgggttcaggcagcgggacagattttactttcaccatcagttccctgcaacccgaggacattgccacatactattgtcagcagcgctactctttgtggcgaacctttggacagggcactaagttagaaatcaaacgtacagtggcagcccctagcgtcttcatttttccaccctccgatgagcaactgaagtcaggtaccgctagtgtggtttgcctactcaacaatttctatcctagagaagcaaaggtgcagtggaaagtcgacaacgccctgcagagcggaaattctcaggagtccgtgacggaacaagattcaaaggacagcacttacagtctttcttccaccctgacattgagcaaagctgattacgagaagcacaaagtatatgcctgtgaggttactcatcaggggctctcgtctccagtgaccaagtcctttaacaggggcgaatgc

SEQ ID NO: 23651 - RNA, 1338 nt, synthetic construct
  misc_feature 1..1338: note = derived and/or modified sequence opt3 from Ramucirumab_HeavyChain1
  source 1..1338: mol_type = other RNA
gaggtgcagctggtccaaagcggcgggggactcgttaagcccggtggctcccttagactgtcttgcgccgcttcagggttcacctttagtagctactccatgaactgggtgaggcaggcacctggaaaaggcttggaatgggtatcttcgatctcaagcagttcctcttatatttactatgccgacagcgtgaagggtcggttcacaatatcccgcgataatgcgaaaaactcattatacctgcagatgaatagtctacgagctgaggacactgccgtctattactgtgcacgtgtgacggatgcctttgacatctgggggcagggaaccatggttacagtgagctctgcttccactaagggcccatcagtcttcccgctcgcacccagcagtaaatctacctccggcgggacagccgctctgggatgccttgtgaaggattattttcctgaaccagtaaccgttagctggaactcgggtgccctgacttctggcgtgcacacattccccgcggtcttgcaatcctcagggctctacagtctgagctccgtggtgaccgtcccttctagctcactgggaacgcagacttacatttgtaatgttaaccataagccaagtaataccaaagtggacaagaaagtagagcccaagtcctgcgataaaacacacacttgtcctccatgcccggcacccgaactcttaggcggtcctagcgtgtttctgttcccacccaagcctaaggacacccttatgatctctagaacaccagaggtcacctgtgtggttgtggatgtctcacatgaggaccccgaagtgaaatttaactggtatgtagatggggttgaggtgcacaatgccaagacgaaaccgagggaggaacagtacaacagtacttatcgggtcgtgagcgtcttgacagtgctgcatcaggactggctaaatggaaaggagtacaaatgcaaggtttccaacaaagctctccctgcccccattgaaaagaccatctctaaggcaaaaggccaaccacgcgagcctcaggtgtatactctgcccccatcgagagaagagatgacaaagaatcaggtaagccttacctgtctggtcaaaggcttctacccctccgatatagctgtggaatgggagtcaaacgggcagcctgagaataactataagacgaccccaccggttttggacagtgacggatctttctttctctacagcaaactgacagtggataagtccaggtggcaacagggtaacgtcttttcatgcagcgtgatgcacgaagccttacacaatcattacactcagaagtctctgtccctcagtcccggcaaa

SEQ ID NO: 23652 - RNA, 642 nt, synthetic construct
  misc_feature 1..642: note = derived and/or modified sequence opt3 from Ramucirumab_LightChain1
  source 1..642: mol_type = other RNA
gacatccagatgacccaaagcccctcctctgtgtcagccagtattggcgatagagtcacaataacttgcagggctagccaggggatcgacaactggctgggatggtaccagcagaagcctggtaaagcaccaaagctccttatttatgatgcctccaatctggacacgggcgttccgtctcggttctcggggtcaggaagcggcacctactttacattgactatcagttccttacaagcggaggatttcgctgtgtatttttgtcagcaggccaaagcatttccccctaccttcggtgggggaacaaaggtagacattaaaggcaccgtggccgctccatctgtcttcatctttccccctagcgatgaacagctgaagtccggcactgcatcagtggtttgcctactcaacaatttctacccacgcgaggccaaggtgcaatggaaagtcgacaacgctctgcagagtgggaatagccaggaatctgtgacagagcaggattccaaggactcaacctatagccttagttctacgctgactttgtccaaagccgattacgaaaagcacaaagtatatgcgtgtgaggttacccatcaaggactcagctcgcccgtgacaaagtcttttaaccgaggtgagtgc

SEQ ID NO: 23653 - RNA, 687 nt, synthetic construct
  misc_feature 1..687: note = derived and/or modified sequence opt3 from Ranibiziuab_HeavyChain1
  source 1..687: mol_type = other RNA
gaggtgcagctggtcgaaagcggcgggggactcgttcaacccggtggctcccttagactgtcttgcgccgcttcagggtacgacttcacccactatggaaactgggtgaggcaggcacctggcaagggtttggagtgggtagggtggatcaatacatacactggagaaccaacgtatgccgcggattttaaacggcgcttcacctttagtttagacacaagcaagtccactgcttacctgcagaactctctacgagccgaggataccgcagtgtattactgtgccaaatatccgtactactatggcacatcgcattggtacttcgacgtctggggccaggggaccctcgtgactgtttcaagcgctagtacaaagggaccctccgtgtttcctctggcaccatctagcaaatccacctcaggtggcacggccgctcttgggtgcctggtcaaggattatttccccgaacctgtgactgtaagttggaatagcggagccttgacctctggcgttcacacatttccagcggtgctccaatcctcaggtctgtacagcctgagttctgtcgtgactgtgccctccagctcgctcgggacccagacatatatttgtaacgtcaatcataagccttctaacaccaaagttgacaagaaagtggagccaaagtcctgcgataaaacgcactta

SEQ ID NO: 23654 - RNA, 642 nt, synthetic construct
  misc_feature 1..642: note = derived and/or modified sequence opt3 from Ranibiziuab_LightChain1
  source 1..642: mol_type = other RNA
gacatccagctgacccaaagcccctcctctctctcagccagtgtgggcgatagagtcacaattacttgcagcgcttcccaggacatatctaactaccttaattggtatcagcagaagcctgggaaagcaccaaaggttctgatctacttcacgtcgtcattgcacagcggagtgccgagtaggttttccggttctggcagcgggaccgatttcacattaactatttcctcactgcaacccgaggactttgccacctattactgtcagcagtatagtacagtaccttggaccttcggacagggcactaaagtggaaatcaagcggacagtcgcggctccaagcgtgtttatttttcccccttctgatgagcaactaaaatccggtaccgcctcagttgtgtgcctcctgaacaatttctacccacgcgaagcaaaggtccagtggaaggtggacaacgcccttcagagcgggaatagtcaggagtctgtaacggaacaagattccaaagacagcacttattcgctgtcttccaccttgacactctcaaaggctgattacgagaaacataaggtttacgcatgtgaggtgactcaccagggactgagtagccccgtcaccaaatccttcaaccgaggcgaatgc

SEQ ID NO: 23655 - RNA, 639 nt, synthetic construct
  misc_feature 1..639: note = derived and/or modified sequence opt3 from Ranibizumab_fab_fragment
  source 1..639: mol_type = other RNA
gacatccagctgacccaaagcccctcctctctctcagccagtgtgggcgatagagtcacaattacttgcagcgcttcccaggacatatctaactaccttaattggtatcagcagaagcctgggaaagcaccaaaggttctgatctacttcacgtcgtcattgcacagcggagtgccgagtaggttttccggttctggcagcgggaccgatttcacattaactatttcctcactgcaacccgaggactttgccacctattactgtcagcagtatagtacagtaccttggaccttcggacagggcactaaagtggaaatcaagcggacagtcgcggctccaagcgtgtttatttttcccccttctgatgagcaactaaaatccggtaccgcctcagttgtgtgcctcctgaacaatttctacccacgcgaagcaaaggtccagtggaaggtggacaacgcccttcagagcgggaatagtcaggagtctgtaacggaacaagattccaaagacagcacttattcgctgtcttccaccttgacactctcaaaggctgattacgagaaacataaggtttacgcatgtgaggtgactcaccagggactgagtagccccgtcaccaaatccttcaaccgaggcgaa

SEQ ID NO: 23656 - RNA, 693 nt, synthetic construct
  misc_feature 1..693: note = derived and/or modified sequence opt3 from Ranibizumab_HeavyChain
  source 1..693: mol_type = other RNA
gaggtgcagctggtcgaaagcggcgggggactcgttcaacccggtggctcccttagactgtcttgcgccgcttcagggtacgacttcacccactatggaatgaactgggtgaggcaggcacctggcaagggtttggagtgggtagggtggatcaatacatacactggagaaccaacgtatgccgcggattttaaacggcgcttcacctttagtttagacacaagcaagtccactgcttacctgcagatgaactctctacgagccgaggataccgcagtgtattactgtgccaaatatccgtactactatggcacatcgcattggtacttcgacgtctggggccaggggaccctcgtgactgtttcaagcgctagtacaaagggaccctccgtgtttcctctggcaccatctagcaaatccacctcaggtggcacggccgctcttgggtgcctggtcaaggattatttccccgaacctgtgactgtaagttggaatagcggagccttgacctctggcgttcacacatttccagcggtgctccaatcctcaggtctgtacagcctgagttctgtcgtgactgtgccctccagctcgctcgggacccagacatatatttgtaacgtcaatcataagccttctaacaccaaagttgacaagaaagtggagccaaagtcctgcgataaaacgcactta

SEQ ID NO: 23657 - RNA, 654 nt, synthetic construct
  misc_feature 1..654: note = derived and/or modified sequence opt3 from Ranibizumab_LightChain
  source 1..654: mol_type = other RNA
gaggtgcagctggtcgaaagcggcgggggactcgttcaacccggtggctcccttagactgtcttgcgccgcttcagggtacgacttcacccactatggaatgaactgggtgaggcaggcacctggcaagggtttggagtgggtagggtggatcaatacatacactggagaaccaacgtatgccgcggattttaaacggcgcttcacctttagtttagacacaagcaagtccactgcttacctgcagatgaactctctacgagccgaggataccgcagtgtattactgtgccaaatatccgtactactatggcacatcgcattggtacttcgacgtctggggccaggggaccctcgtgactgtttcaagcgctagtacaaagggaccctccgtgtttcctctggcaccatctggtaccgccgctcttggctgcctggtcaaagattatttccccgaacctgtgacggtaagctggaactccggggccttgacttcaggagttcacacctttccagcggtgctccaaagtagcggcctgtactctctgtcctcagtcgtgacagtgcccagcagttctctcggtactcagacctatatttgtaatgtcaatcataagccttccaacacaaaggttgacaaaaaggtggagccaaaa

SEQ ID NO: 23658 - RNA, 642 nt, synthetic construct; identical to SEQ ID NO: 23654
  misc_feature 1..642: note = derived and/or modified sequence opt3 from Ranibizumab_LightChain_variant
  source 1..642: mol_type = other RNA

SEQ ID NO: 23659 - RNA, 1368 nt, synthetic construct
  misc_feature 1..1368: note = derived and/or modified sequence opt3 from Refanezumab_HeavyChain1
  source 1..1368: mol_type = other RNA
caggtgcaactggtccagagcggctccgagctcaagaaacccggggcctctgttaaggtgtcatgcaaagctagtggatacaccttcacaaactatggtatgaattgggtaagacaggcacctggccaggggcttgaatggatgggatggatcaacacttacacgggcgagccaacctatgccgacgattttacaggtaggttcgtgtttagcctggacacttccgtctctaccgcgtacttgcaaatttcgtcattaaaggctgaagatacagccgtgtattactgtgcacggaatccgataaactattacgggatcaattacgagggatatgttatggactactggggccagggcaccctggtgactgtcagcagtgcctccacaaaagggccctctgtgttccctctagctccaagctccaagtcaaccagtggaggtacggcagccctcggctgcctggtaaaggattattttcccgaacctgttactgtgagctggaactctggggctcttacctccggagtccacacattcccagccgtgctgcagtcaagcggcttgtacagtctctcttccgtggtcactgttcccagctcgtctctgggtacccagacatatatttgtaatgtgaaccataaaccttccaataccaaggtagacaaaaaggtggagccaaaatcatgcgataagacgcacacttgtccgccctgccctgcgccagagctggcaggggcccccagtgtctttctcttccctccaaagcccaaagacacattaatgatcagccgcaccccggaagtgacttgtgttgtggtcgatgtgtcccatgaggaccctgaagtaaagtttaactggtacgttgatggagtggaggtccacaatgctaaaacaaagccccgagaggaacaatataactctacctaccgtgtggtcagcgtgctgacggttcttcatcaggactggttgaatggcaaagagtacaagtgcaaagtgtcaaacaaggccctgccagcacctattgaaaagaccatcagtaaagctaagggccagcccagagagccacaggtatatacactacccccttccagggatgaactcactaaaaatcaagtcagcctgacctgtcttgtgaaggggttctacccatctgacatagccgttgagtgggagtcaaacggacagccggaaaacaattataaaacaactccccctgtgctggacagtgatggtagctttttcttgtactccaagctcaccgtcgacaagtctcggtggcagcaaggcaacgtgttttcgtgcagcgtaatgcacgaggcgctgcacaatcattatacacagaaatccttatcactgagtccagggaag

SEQ ID NO: 23660 - RNA, 657 nt, synthetic construct
  misc_feature 1..657: note = derived and/or modified sequence opt3 from Refanezumab_LightChain1
  source 1..657: mol_type = other RNA
gacatcgtgatgacccagagccccgattccctggccgtctctctcggcgagagagctacaattaactgcaagtcaagtcacagcgttctttactcctctaatcaaaagaactatctggcatggtaccagcagaagcctgggcagccaccgaaattgttaatatattgggcctcgactagggaatcaggagtgcccgaccggttcagcggtagtggctccgggacggattttaccctgacaatctctagcctacaagcggaggacgtagctgtgtactattgtcatcagtacctctcctcactgactttcggacagggcaccaaacttgaaattaaacgcacagtcgccgcacctagtgtgtttatcttcccacccagcgatgagcagctgaagtctggtaccgcctccgttgtgtgcttgctcaataacttttatcctcgagaagctaaggtccaatggaaagtggacaatgcactgcagtcagggaacagccaggagagtgtaactgagcaggattctaaggactccacatacagcctgtcgtctaccctcacgttatccaaagccgattacgaaaagcacaaagtttatgcttgtgaggtgactcatcaaggactgtcaagtccagtcaccaagagcttcaatcgtggcgaatgc

SEQ ID NO: 23661 - RNA, 1314 nt, synthetic construct
  misc_feature 1..1314: note = derived and/or modified sequence opt3 from REGN2810_HeavyChain1
  source 1..1314: mol_type = other RNA
gaggtgcagctgctcgaaagcggcggggtccttgttcaacccggaggttccctgagattgtcttgcgccgcttcaggcttcacctttagtaacttcgggacatgggtgaggcaggcacctggaaagggcttagagtgggtaagcggtatctccgggggaggccgggacacttactttgccgattctgtgaaaggccgcttcacgatttcgcgagacaattcaaagaacaccctgtatctacagaatagcctcaaaggggaagatacagcggtctactattgtgtgaagtggggaaacatatactttgactattggggtcagggcactctggttaccgtgagttccgcttctacaaaagggccaagcgtcttcccgcttgccccctgctcccgttcaaccagtgagagcactgcagccctgggatgtttggtgaaggattactttcctgaaccagtaacagtttcttggaactccggcgctctcacctcaggtgtgcacacgttccccgcagtcctgcaaagcagtgggctgtattctctctccagcgtggtgactgtcccttcgtcttccttaggaaccaagacatacacttgcaatgttgaccataaaccatcaaataccaaggtggataaaagagtagagagtaagtacgggcccccttgtccaccgtgccccgcccctgagtttctgggcggcccaagcgtgttcctttttccccctaaaccaaaggacacattgatctccaggacccccgaagtcacgtgtgtggttgtggatgtctctcaggaggacccggaagtgcagttcaactggtatgtagatggagttgaggtgcacaatgctaagactaaacctcgggaggaacagtttaacagcacataccgcgtcgtgtcagtcctgaccgtgctacatcaagactggctcaatggtaaggagtataaatgcaaggttagtaacaaaggcctgccctccagcattgaaaagactatctctaaagccaaggggcagccaagagagcctcaggtgtacacacttcccccatcacaggaagagaccaagaatcaagtaagtctgacgtgtttggtcaaaggattctatcccagcgatattgcggtggagtgggaatccaacggccagcctgagaataactacaagaccacaccaccggttctcgactctgacggttcgttctttctgtatagcaggttaactgtggataaatcccggtggcaggaagggaacgtcttctcatgcagtgtgcacgaggcactgcataatcactacacccaaaagtctctcagcctttccctgggc

SEQ ID NO: 23662 - RNA, 639 nt, synthetic construct
  misc_feature 1..639: note = derived and/or modified sequence opt3 from REGN2810_LightChain1
  source 1..639: mol_type = other RNA
gacatccagacccaaagcccctcctctctgtcagccagtgtgggcgatagcattacaataacttgcagagcttccctctctatcaacacgttccttaattggtaccagcagaagcctgggaaagcaccaaacctgttgatttatgccgcgtcgtcattacacggaggtgtcccgagcaggtttagtggctccgggtctggaaccgacttcacactgactatccggaccctacagcccgaggattttgctacatactattgtcaacagagctccaatacccctttcacttttggcccaggtacagttgtggacttccgccgaaccgtagccgcaccctcagtgtttattttccctccaagtgatgaacagctcaagagcgggacggcctctgtcgtgtgcctgcttaacaatttttacccccgtgaggctaaagttcagtggaaggtggacaacgcactgcaatccggaaattcacaggaaagcgtcactgagcaggatagtaaagactctacctattccttgagctcgacactcactctgtctaaggccgattacgaaaagcataaagtgtatgcttgtgaggtaacccaccagggcctgtcctcacctgttacaaagagtttcaacagaggcgagtgc

SEQ ID NO: 23663 - RNA, 651 nt, synthetic construct
  misc_feature 1..651: note = derived and/or modified sequence opt3 from rhuMab_HER2(9CI)_LightChain
  source 1..651: mol_type = other RNA
gtgcacagcgacatccagatgacccaatccccctcttcactgagtgccagcgtcggcgatagagttacaattacttgcaaggcttcccaggacgtgtctataggggtagcatggtaccagcagaaacctggaaaggccccaaaactccttatctattcggcgtcatacaggtatacgggtgtgccgagccggttcagtggctccgggtctggaaccgattttacactgactattagctccttgcaacccgaggacttcgctacctactattgtcagcagtactatatctacccttacacatttggccagggtaccaaggtcgaaattaaacgcactgtggccgcaccatcagttttcatctttccccctagtgatgagcaattaaagagcgggacagcctctgtggtctgcctgctaaacaatttctatccacgagaagctaaggtgcagtggaaagtagacaacgcactccagtccggaaattcacaggagagcgttaccgaacaagatagtaaggactctacgtactccctgagctcgactcttaccctgtctaaagccgattatgagaagcataaagtgtacgcttgtgaggtcacacaccagggcttgtcctcacccgtgactaagagttttaaccgtggcgaatgc

SEQ ID NO: 23664 - RNA, 1215 nt, synthetic construct
  misc_feature 1..1215: note = derived and/or modified sequence opt3 from rhuMab_HER2_HeavyChain
  source 1..1215: mol_type = other RNA
gaggtgcagctggtcgaaagcggcgggggactcgttcagcccggtggctcccttagactgtcttgcgccgcttcagggttcacctttacagactacactatggattgggtgaggcaggcacctggaaagggcttgacggccgtatattactgtgcgcggaacttaggtccaagtttctattttgactactgggggcagggaaccctggtgacagtcagctccgcttctactaaaggcccgtcggtgttccccctagccccttcaagcaagagtacctccggcgggacagcagccctcggatgcctggttaaagattattttccagagcccgtgaccgtctcttggaatagcggtgctcttacttccggcgtgcacacattccctgcagtactgcagtcaagtgggttgtacagcctctcttccgttgtgaccgtcccatcaagcagtctgggaacgcaaacttatatctgtaacgtgaatcataagccctctaacaccaaagtggacaagaaggtcgaacctaaatcctgcgataagacacacacttgtccaccgtgccccgcccctgagctgctcggcggtccaagcgttttcttatttccccctaaaccaaaggacaccctgatgatttcgcgcacacccgaagtgacctgtgtagtggtcgatgtgtctcatgaggacccggaggttaaatttaattggtacgtggatggggtcgaagtgcacaacgctaagacgaagcctcgagaggaacagtacaattccacttatcgtgtagtttcagtgcttacagtcttgcatcaggactggctgaacggaaaagagtacaagtgcaaagtgagtaataaggccctacccgcgccaatagagaaaaccatcagcaaggcaaaaggccagcctagagaaccccaagtctatactctcccaccctccagggaggaaatgacaaagaaccaggtgtctctgacctgtcttgttaagggcttctaccctagcgatattgccgtggagtgggaatcaaatgggcagccagagaacaattataaaacgaccccgcccgtactggacagtgatggatcctttttcttgtacagcaagctcacagtcgacaaatctcggtggcagcaaggtaacgtgttttcatgcagtgttatgcacgaggctctgcacaatcattatactcaaaagagcttatccctgtctcctggcccaaaa

SEQ ID NO: 23665 - RNA, 645 nt, synthetic construct
  misc_feature 1..645: note = derived and/or modified sequence opt3 from rhuMab_HER2_LightChain
  source 1..645: mol_type = other RNA
agcgacatccagatgacccaatccccctcttcactgagtgccagcgtgggcgatagagtcacaattacttgcagggcttcccaggacgttaacacggcagtggcctggtaccagcagaagcctgggaaagcgccaaagctccttatatattctgcttcgttcctgtactcaggagtaccgagccggtttagtggttcccgctctggcaccgatttcacattgactatcagctccttacaacccgaggactttgccacctattactgtcagcagcactatacaacccctccaactttcgggcagggaacaaaagtggaaattaagcgaaccgtcgcagccccctcagtgtttatcttccctccaagtgatgagcaactgaaaagcggcacggcttctgttgtgtgcctactcaataacttttacccccgtgaagcaaaggtccagtggaaggtggacaatgccctgcagtccggtaactcacaggagagcgtaactgaacaagatagtaaagactctacctattcccttagctcgacactgactttgtctaaggctgattacgagaaacataaggtttacgcctgtgaggtgacccaccaggggctctcctcacctgtcacaaaaagtttcaatagaggagaatgc

SEQ ID NO: 23666 - RNA, 318 nt, synthetic construct
  misc_feature 1..318: note = derived and/or modified sequence opt3 from rhuMab_HER2_LightChain_variant1
  source 1..318: mol_type = other RNA
accgtggccgctcccagcgtcttcatctttcctccatccgacgagcagctgaagtctggcacagcatcagttgtgtgcctccttaacaatttctacccgagagaagccaaagtacaatggaaggtggataacgcgctgcagagtgggaatagccaggagtccgtcactgaacaggactctaaagattcgacgtattcattgagcagtaccttaacactgtccaaggctgactacgagaaacacaaggtgtatgcctgtgaagttactcatcaaggactatctagccccgtgaccaagtcctttaacaggggtgagtgc

SEQ ID NO: 23667 - RNA, 642 nt, synthetic construct
  misc_feature 1..642: note = derived and/or modified sequence opt3 from rhuMab_HER2_LightChain_variant2
  source 1..642: mol_type = other RNA
gacatccagatgacccaaagcccctcctctctgtcagccagtgtgggcgatagagtcacaattacttgcagggctagccaggacgttaacacggcagtggcctggtaccagcagaagcctgggaaagcgccaaagctccttatatattccgcttctttcctgtactcgggagtaccgtcacggtttagcggtagtcgctccggcaccgatttcacattgactatctctagcttacaacccgaggactttgccacctattactgtcagcagcactatacaacccctccaactttcgggcagggaacaaaagtggaaattaagcgaacctgcgcagccccctccgtctttatcttccctccatcagatgagcaactgaaaagtggcacggctagcgtggtttgtctactcaataacttttacccccgtgaagcaaaggtgcagtggaaggtcgacaatgccctgcagtctggtaactcccaggagtcagtgactgaacaagatagcaaagacagtacctattctctttccagcacactgactttgtcgaaggctgattacgagaaacataaggtatacgcctgcgaggttacccaccaggggctctcttcccctgtgacaaaatcattcaatagaggagaatgt

SEQ ID NO: 23668 - RNA, 642 nt, synthetic construct
  misc_feature 1..642: note = derived and/or modified sequence opt3 from rhuMab_HER2_LightChain_variant3
  source 1..642: mol_type = other RNA
gacatccagatgacccaaagcccctcctctctgtcagccagtgtgggcgatagagtcacaattacttgcagggctagccaggacgttaacacggcagtggcctggtaccagcagaagcctgggaaagcgccaaagctccttatatattccgcttctttcctgtactcgggagtaccgtcacggtttagcggtagtcgctccggcaccgatttcacattgactatctctagcttacaacccgaggactttgccacctattactgtcagcagcactatacaacccctccaactttcgggcagggaacaaaagtggaaattaagcgaaccgtcgcagccccctccgtgtttatcttccctccatcagatgagcaactgaaaagtggcacggctagcgttgtgtgcctactcaataacttttacccccgtgaagcaaaggtccagtggaaggtggacaatgccctgcagtctggtaactcccaggagtcagtaactgaacaagatagcaaagacagtacctattctctttccagcacactgactttgtcgaaggctgattacgagaaacataaggtttacgcctgtgaggtgacccaccaggggctctcttcccctgtcacaaaatcattcaatagaggagaatgc

SEQ ID NO: 23669 - RNA, 645 nt, synthetic construct; identical to SEQ ID NO: 23665
  misc_feature 1..645: note = derived and/or modified sequence opt3 from rhuMab_HER2_LightChain_variant4
  source 1..645: mol_type = other RNA

SEQ ID NO: 23670 - RNA, 321 nt, synthetic construct
  misc_feature 1..321: note = derived and/or modified sequence opt3 from rhuMab_HER2_LightChain_V-Region
  source 1..321: mol_type = other RNA
gacatccagatgacccaaagcccctcctctctgtcagccagtgtgggcgatagagtcacaattacttgcagggctagccaggacgttaacacggcagtggcctggtaccagcagaagcctgggaaagcgccaaagctccttatatattccgcttctttcctgtactcgggagtaccgtcacggtttagcggtagtcgctccggcaccgatttcacattgactatctctagcttacaacccgaggactttgccacctattactgtcagcagcactatacaacccctccaactttcgggcagggaacaaaagtggaaattaag

SEQ ID NO: 23671 - RNA, 1350 nt, synthetic construct
  misc_feature 1..1350: note = derived and/or modified sequence opt3 from rhuMab_HER2_gamma1-Chain
  source 1..1350: mol_type = other RNA
gaggtgcagctggtcgaaagcggcgggggactcgttcaacccggtggctcccttagactgtcttgcgccgcttcagggttcaacatcaaggacacctacattcactgggtgaggcaggcacctggaaaaggcttggagtgggtagcccggatatatccaacaaatggttacactcgctatgcggatagtgtgaaggggcgatttacgatcagcgctgacacctccaaaaacacagcctacttacagatgaatagcctgcgtgcagaagatactgccgtctattactgttcgagatggggaggcgacggcttctatgctatggattactgggggcagggaaccctagtgacagtttcaagcgcaagtaccaagggtccgtccgtgtttcccctcgccccttctagcaaatccacttcaggcgggacagctgccctgggatgccttgtcaaggactacttcccagagcccgtgaccgtaagttggaacagcggcgcgctgacgtctggtgttcatacttttcctgcagtgttgcaatcctcagggctctatagcctgagttctgtcgtgaccgtgccatccagctcgctgggaacacagacttacatttgtaatgtcaaccacaagccctctaataccaaagttgataagaaagtggaacctaagtcctgcgacaaaacacatacctgtccaccgtgccccgcccctgagctcttaggcggcccatcagtattcctgtttccccctaagccaaaggatacgcttatgatcagtaggactcccgaggtgacatgtgtcgtggttgacgtgagccacgaagatccggaggtcaaattcaactggtatgtggacggggtagaagttcataatgctaagaccaaacctcgggaggagcagtacaactccacttatcgcgtggtctctgtgttgacagtcctgcaccaggattggctaaatggaaaggaatacaaatgcaaggtgagcaacaaagccctccccgcaccaattgagaagaccatctcaaaggctaaaggtcaacctagagaaccccaggtttatacgctgccacccagtagggaggaaatgaccaagaatcaggtgtcccttacatgtctggtaaaaggcttttaccctagcgacatagccgtcgagtgggagtctaacgggcagccagaaaataactacaagactaccccgcccgtgttggactcagatggaagtttctttctctatagcaaactgacagttgacaagtcccggtggcaacagggcaacgtgttctcttgctcggtcatgcacgaggcgttacataatcactacactcagaagtctctgtccctctcacctggtaaa

SEQ ID NO: 23672 - RNA, 1350 nt, synthetic construct
  misc_feature 1..1350: note = derived and/or modified sequence opt3 from rhuMab_HER2__gamma1-Chain
  source 1..1350: mol_type = other RNA
gaggtgcagctggtcgaaagcggcgggggactcgttcaacccggtggctcccttagactgtcttgcgccgcttcagggttcaacatcaaggacacctacattcactgggtgaggcaggcacctggaaaaggcttggagtgggtagcccggatatatccaacaaatggttacactcgctatgcggatagtgtgaaggggcgatttacgatcagcgctgacacctccaaaaacacagcctacttacagatgaatagcctgcgtgcagaagatactgccgtctattactgttcgagatggggaggcgacggcttctatgctatggattactgggggcagggaaccctagtgacagtttcaagctgcagtaccaagggtccgtccgtgtttcccctcgcaccttctagcaaatccacttcaggcgggacagccgctctgggatgtcttgtcaaggactacttcccagagcccgtgaccgtaagttggaacagcggcgccctgacgtctggtgttcatacttttcctgcggtgttgcaatcctcagggctctatagcctgagttctgtcgtgaccgtgccatccagctcgctgggaacacagacttacatttgcaatgtcaaccacaagccctctaataccaaagttgataagaaagtggaacctaagtcctgtgacaaaacacatacctgcccaccgtgtcccgcacctgagctcttaggcggcccatcagtattcctgtttccccctaagccaaaggatacgcttatgatcagtaggactcccgaggtgacatgcgtcgtggttgacgtgagccacgaagatccggaggtcaaattcaactggtatgtggacggggtagaagttcataatgccaagaccaaacctcgggaggagcagtacaactccacttatcgcgtggtctctgtgttgacagtcctgcaccaggattggctaaatggaaaggaatacaaatgtaaggtgagcaacaaagctctccccgccccaattgagaagaccatctcaaaggcaaaaggtcaacctagagaaccccaggtttatacgctgccacccagtagggaggaaatgaccaagaatcaggtgtcccttacatgcctggtaaaaggcttttaccctagcgacatagctgtcgagtgggagtctaacgggcagccagaaaataactacaagactaccccgcccgtgttggactcagatggaagtttctttctctatagcaaactgacagttgacaagtcccggtggcaacagggcaacgtgttctcttgttcggtcatgcacgaggccttacataatcactacactcagaagtctctgtccctctcacctggtaaa

SEQ ID NO: 23673 - RNA, 729 nt, synthetic construct
  misc_feature 1..729: note = derived and/or modified sequence opt3 from rhuMab_HER2_gamma1-Chain__rhuMab_HER2_LightChain_sc4D5
  source 1..729: mol_type = other RNA
gaggtgcagctggtcgaaagcggcgggggactcgttcaacccggtggctcccttagactgtcttgcgccgcttcagggttcaacatcaaggacacctacattcactgggtgaggcaggcacctggaaaaggcttggagtgggtagcccggatatatccaacaaatggttacactcgctatgcggatagtgtgaaggggcgatttacgatcagcgctgacacctccaaaaacacagcctacttacagatgaactctctgcgtgcagaagatactgccgtctattactgttcgagatggggaggcgacggcttctatgctatggattactgggggcagggaaccctagtgacagtttcaagcggtggcgggggaagtggcggtgggggatccggcggcgggggatctgacattcaaatgacccagagcccgtcctcactcagtgcaagcgtgggtgatagggtcactatcacatgccgggcctctcaggacgtgaataccgctgtagcctggtaccagcaaaagcccggcaaagcgcctaagctgcttatttattccgcatcatttctgtacagcggggttccaagtcgcttctctggatccagaagcggcacggattttactttgaccatctcgtctctccagcccgaggacttcgccacatattactgtcagcagcattatactacccctccaacatttggtcaagggaccaaggtggaaataaaaagg

SEQ ID NO: 23674 - RNA, 1350 nt, synthetic construct; identical to SEQ ID NO: 23671
  misc_feature 1..1350: note = derived and/or modified sequence opt3 from rhuMab_HER2_gamma1-Chain_variant1
  source 1..1350: mol_type = other RNA

SEQ ID NO: 23675 - RNA, 1350 nt, synthetic construct; identical to SEQ ID NO: 23672
  misc_feature 1..1350: note = derived and/or modified sequence opt3 from rhuMab_HER2_gamma1-Chain_variant2
  source 1..1350: mol_type = other RNA

SEQ ID NO: 23676 - RNA, 1350 nt, synthetic construct
  misc_feature 1..1350: note = derived and/or modified sequence opt3 from rhuMab_HER2_gamma1-Chain_variant3
  source 1..1350: mol_type = other RNA
gaggtgcagctggtcgaaagcggcgggggactcgttcaacccggtggctcccttagactgtcttgcgccgcttcagggttcaacatcaaggacacctacattcactgggtgaggcaggcacctggaaaaggcttggagtgggtagcccggatatatccaacaaatggttacactcgctatgcggatagtgtgaaggggcgatttacgatcagcgctgacacctccaaaaacacagcctacttacagatgaatagcctgcgttgtgaagatactgcagtctattactgctcgagatggggaggcgacggcttctatgccatggattactgggggcagggaaccctagtgacagtttcaagcgctagtaccaagggtccgtccgtgtttcccctcgcaccttctagcaaatccacttcaggcgggacagccgctctgggatgtcttgtcaaggactacttcccagagcccgtgaccgtaagttggaacagcggcgccctgacgtctggtgttcatacttttcctgcggtgttgcaatcctcagggctctatagcctgagttctgtcgtgaccgtgccatccagctcgctgggaacacagacttacatttgcaatgtcaaccacaagccctctaataccaaagttgataagaaagtggaacctaagtcctgtgacaaaacacatacctgcccaccgtgtcccgcacctgagctcttaggcggcccatcagtattcctgtttccccctaagccaaaggatacgcttatgatcagtaggactcccgaggtgacatgcgtcgtggttgacgtgagccacgaagatccggaggtcaaattcaactggtatgtggacggggtagaagttcataatgccaagaccaaacctcgggaggagcagtacaactccacttatcgcgtggtctctgtgttgacagtcctgcaccaggattggctaaatggaaaggaatacaaatgtaaggtgagcaacaaagctctccccgccccaattgagaagaccatctcaaaggcaaaaggtcaacctagagaaccccaggtttatacgctgccacccagtagggaggaaatgaccaagaatcaggtgtcccttacatgcctggtaaaaggcttttaccctagcgacatagctgtcgagtgggagtctaacgggcagccagaaaataactacaagactaccccgcccgtgttggactcagatggaagtttctttctctatagcaaactgacagttgacaagtcccggtggcaacagggcaacgtgttctcttgttcggtcatgcacgaggccttacataatcactacactcagaagtctctgtccctctcacctggtaaa

SEQ ID NO: 23677 - RNA, 360 nt, synthetic construct
  misc_feature 1..360: note = derived and/or modified sequence opt3 from rhuMab_HER2_gamma1-Chain_V-Region
  source 1..360: mol_type = other RNA
gaggtgcagctggtcgaaagcggcgggggactcgttcaacccggtggctcccttagactgtcttgcgccgcttcagggttcaatatcaaggacacctacattcactgggtgaggcaggcacctggaaaaggcttggagtgggtagcccggatatatccaacaaatggttacactcgctatgcggatagtgtgaaggggcgatttacgatcagcgctgacacctccaaaaacacagcctacttacagatgaactctctgcgtgcagaagatactgccgtctattactgttcgagatggggaggcgacggcttctatgctatggattactgggggcagggaaccctagtgacagtttcaagc

SEQ ID NO: 23678 - RNA, 1359 nt, synthetic construct; identical to SEQ ID NO: 23009
  misc_feature 1..1359: note = derived and/or modified sequence opt3 from rhuMAb-VEGF_HeavyChain1
  source 1..1359: mol_type = other RNA

SEQ ID NO: 23679 - RNA, 642 nt, synthetic construct; identical to SEQ ID NO: 23010
  misc_feature 1..642: note = derived and/or modified sequence opt3 from rhuMAb-VEGF_LightChain1
  source 1..642: mol_type = other RNA

SEQ ID NO: 23680 - RNA, 642 nt, synthetic construct; identical to SEQ ID NO: 23010
  misc_feature 1..642: note = derived and/or modified sequence opt3 from rhuMAb-VEGF_LightChain
  source 1..642: mol_type = other RNA

SEQ ID NO: 23681 - RNA, 321 nt, synthetic construct; identical to SEQ ID NO: 23019
  misc_feature 1..321: note = derived and/or modified sequence opt3 from rhuMAb-VEGF_LightChain__VG-Region
  source 1..321: mol_type = other RNA

SEQ ID NO: 23682 - RNA, 1359 nt, synthetic construct; identical to SEQ ID NO: 23009
  misc_feature 1..1359: note = derived and/or modified sequence opt3 from rhuMAb-VEGF_gamma1-Chain
  source 1..1359: mol_type = other RNA

SEQ ID NO: 23683 - RNA, 369 nt, synthetic construct; identical to SEQ ID NO: 23014
  misc_feature 1..369: note = derived and/or modified sequence opt3 from rhuMAb-VEGF_gamma1-Chain_VDG-Region
  source 1..369: mol_type = other RNA

SEQ ID NO: 23684 - RNA, 1338 nt, synthetic construct
  misc_feature 1..1338: note = derived and/or modified sequence opt3 from Rilotumumab_HeavyChain1
  source 1..1338: mol_type = other RNA
caggtgcagctgcaggagagcggccccgggctcgtcaagccttccgaaaccctttctctgacatgcactgtttcaggaggtagtatcagcatttactattggtcctggataagacagccaccgggcaaagggttggagtggatcggatacgtgtattactctggctcgacgaactataatccctcattaaagagcagggtaaccattagtgtggacacatccaaaaaccagttctctctgaagctaaatagcgtcactgccgctgataccgcagtgtactattgtgcccggggtgggtacgacttttggtccggatacttcgattattggggccaaggcacactcgttaccgtgtcaagtgcgagcactaaagggccttctgtctttccactggctccctgctcccgctcaacaagcgaaagtaccgccgcacttggatgtctggtgaaggactacttccctgagccagtaacggtttcttggaactccggtgccttgactagcggcgtgcacacctttcccgctgtcctccagtcgtctgggctgtattccctgtcaagtgtggtgacagtccctagctccaatttcggaactcagacctacacatgcaacgttgatcataagccatctaataccaaagtggacaagacggtagaacgaaaatgttgcgtggagtgtccgccctgccctgcaccacccgtcgccggccctagcgtgtttctcttcccacccaagccgaaagatactttaatgatctcacgtacacctgaggttacctgtgtggtcgtggacgtaagtcacgaagatcccgaggttcagtttaactggtatgtggacggtgtcgaagtgcataatgctaagactaagccaagagaggagcaattcaactccacatttagggtcgtgagcgttctgaccgtggtacaccaggattggcttaatgggaaagaatacaagtgcaaagtctctaacaagggattgcctgcccccattgagaaaacgatctcaaagaccaaaggccagccacgggaaccccaggtgtatacactgcctccaagtcgcgaggaaatgactaagaatcaagttagcctaacctgtctcgtgaagggcttctacccgtccgacatagcggtcgagtgggagtctaacgggcagcccgaaaataactacaaaacaactcctccaatgctggattcggacggtagctttttcctttattccaagctgaccgtggacaaatcaagatggcagcaaggaaacgtattcagttgctctgtgatgcatgaggcattgcacaatcactacacacaaaagagcctctccctgtcacccggcaaa

SEQ ID NO: 23685 - RNA, 645 nt, synthetic construct
  misc_feature 1..645: note = derived and/or modified sequence opt3 from Rilotumumab_LightChain1
  source 1..645: mol_type = other RNA
gagatcgtgatgacccagagccccgccacactgtccgtctctcctggcgaaagagctactctctcatgcagggcaagtcaaagcgttgactccaaccttgcctggtaccggcagaagccagggcaggcgccgcgcctgttgatttatggagcttctacgcgagccaccggtatacccgcacgtttctcgggctcagggagcggaacagagtttactttaaccatcagttccctgcagtctgaagatttcgccgtgtactattgtcaacagtacattaattggcctccaatcacatttggccagggtaccagactagagattaaaaggactgtagctgcacccagcgtgttcatctttcctccatccgacgaacagctcaagtcagggacagccagtgtcgtgtgcctgcttaacaatttctatccccgggaggctaaagttcaatggaaggtggataacgccctgcagagcggaaattctcaggagtccgtcaccgaacaggactcaaaagatagcacgtacagtttgtcttccactctcaccctgagcaaggcggactatgagaagcacaaagtgtacgcatgtgaagtaacacatcaaggcctgtcgtctcctgttactaagtcctttaaccgcggcgagtgc

SEQ ID NO: 23686 - RNA, 1071 nt, synthetic construct; identical to SEQ ID NO: 23643
  misc_feature 1..1071: note = derived and/or modified sequence opt3 from Rilotumumab_scFv-CH_chain
  source 1..1071: mol_type = other RNA

SEQ ID NO: 23687 - RNA, 1347 nt, synthetic construct
  misc_feature 1..1347: note = derived and/or modified sequence opt3 from Rinucumab_HeavyChain1
  source 1..1347: mol_type = other RNA
cagctgcaactccaggagagcggccccgggcttgtgaagccttccgaaaccctgtctttgacatgcactgtctcaggaggtagtatcacgagctcctcttactattggggctggattagacagccaccggggaaaggattagagtggataggctcgatctactataggggttcaaccaactacaatcccagcctgaagagtcgggttacaatttccgtggactctagcaaaaaccagttctatctaaaggtatcctcagtgactgccgtcgataccgctgtgtactattgtgcacgccaaaatggggccgcgcgacctagttggtttgacccatggggacagggcacactcgttaccgtgagctctgcttccactaaaggcccctcagtcttccctctggccccatgcagccgtagtacatctgaatccaccgcagcccttgggtgtctggtgaaggattactttcccgagcctgtaacggttagctggaactcgggagctttgacttctggtgtgcacaccttcccagcagtcctccagtcctcaggcctgtacagtctgagctccgtggtgacagtcccgtctagctcactcgggactaagacctatacatgcaatgttgaccataaacccagtaacaccaaggtggataaaagagtagaatccaagtacggacctccatgtcccccttgcccagcccccgagtttttaggcggtccgagcgtgttcctgtttcctcccaaaccaaaggacacgcttatgatctctaggactcctgaggtcacatgtgtggttgtggatgtctcacaggaagaccccgaggtgcaattcaattggtatgtagatggggttgaagtgcacaacgctaagaccaaaccacgggaggagcagtttaatagtacttaccgcgtcgtgagcgtcttgacagtgctgcatcaggactggctaaacggaaaggaatataaatgcaaggtttccaataaaggcctcccctcttcgattgagaagaccatcagcaaagccaagggccagcctagagaaccacaagtgtacacgctgccgccctcccaggaggaaatgaccaagaaccaggtatcacttacatgtctggtcaaagggttctatcctagtgatatagcggtggagtgggagtctaatggacaaccagaaaacaattacaagactacaccccctgttttggacagcgatggttcctttttcctctactcaaggctgaccgtggacaaaagccggtggcaggagggcaacgtcttttcttgctccgtgatgcacgaagcattacataaccactatactcagaagagtctgagcctctctcttgggaaa

SEQ ID NO: 23688 - RNA, 1344 nt, synthetic construct
  misc_feature 1..1344: note = derived and/or modified sequence opt3 from Rinucumab_HeavyChain
  source 1..1344: mol_type = other RNA
cagctgcaactccaggagagcggccccgggcttgtgaagccttccgaaaccctgtctttgacatgcactgtctcaggaggtagtatcacgagctcctcttactattggggctggattagacagccaccggggaaaggattagagtggataggctcgatctactataggggttcaaccaactacaatcccagcctgaagagtcgggttacaatttccgtggactctagcaaaaaccagttctatctaaaggtatcctcagtgactgccgtcgataccgctgtgtactattgtgcacgccaaaatggggccgcgcgacctagttggtttgacccatggggacagggcacactcgttaccgtgagctctgcttccactaaaggcccctcagtcttccctctggccccatgcagccgtagtacatctgaatccaccgcagcccttgggtgtctggtgaaggattactttcccgagcctgtaacggttagctggaactcgggagctttgacttctggtgtgcacaccttcccagcagtcctccagtcctcaggcctgtacagtctgagctccgtggtgacagtcccgtctagctcactcgggactaagacctatacatgcaatgttgaccataaacccagtaacaccaaggtggataaaagagtagaatccaagtacggacctccatgtcccccttgcccagcccccgagtttttaggcggtccgagcgtgttcctgtttcctcccaaaccaaaggacacgcttatgatctctaggactcctgaggtcacatgtgtggttgtggatgtctcacaggaagaccccgaggtgcaattcaattggtatgtagatggggttgaagtgcacaacgctaagaccaaaccacgggaggagcagtttaatagtacttaccgcgtcgtgagcgtcttgacagtgctgcatcaggactggctaaacggaaaggaatataaatgcaaggtttccaataaaggcctcccctcttcgattgagaagaccatcagcaaagccaagggccagcctagagaaccacaagtgtacacgctgccgccctcccaggaggaaatgaccaagaaccaggtatcacttacatgtctggtcaaagggttctatcctagtgatatagcggtggagtgggagtctaatggacaaccagaaaacaattacaagactacaccccctgttttggacagcgatggttcctttttcctctactcaaggctgaccgtggacaaaagccggtggcaggagggcaacgtcttttcttgctccgtgatgcacgaagcattacataaccactatactcagaagagtctgagcctctctcttggg

SEQ ID NO: 23689 - RNA, 645 nt, synthetic construct
  misc_feature 1..645: note = derived and/or modified sequence opt3 from Rinucumab_LightChain1
  source 1..645: mol_type = other RNA
gagatcgtgctgacccagagccccgacacaatttccctctctcctggcgaaagagccactctttcatgcagggctagtcaaagcatatcctctatctacctggcatggtatcagcagaagccagggcaggccccgcggttgttaatttacggagcgtcgtcacgcgtcacgggtatccccgatcgattcagcgttagtggctccgggaccgactttacactgactatttctcgtctagagcctgaagatttcgctgtgtattactgtcaacactatggaatcagcccatttaccttcggccccggtacaaaagtagacataagaaggaccgtggccgcaccttccgtctttatcttcccaccctcagatgagcagctcaagagtgggactgccagcgtggtttgcctgcttaacaatttttaccctcgggaagctaaagtgcagtggaaggtcgacaacgcactgcagtctggaaattcccaagagtcagtgacagagcaggatagcaaagacagtacctattctttgtccagcacgctcactctgtcgaaggccgattacgaaaagcataaagtatacgcttgtgaggttacccaccagggcctgtcttccccagtgacaaagtcattcaaccgcggcgaatgc

SEQ ID NO: 23690 - RNA, 1347 nt, synthetic construct
  misc_feature 1..1347: note = derived and/or modified sequence opt3 from Risankizumab_HeavyChain1
  source 1..1347: mol_type = other RNA
caggtgcaactggtccagagcggcgccgaggttaagaaacccgggtcctctgtgaaggtatcatgcaaagctagtggatacaccttcacagaccagactatccactggatgagacaggcacctggtcaaggcctcgaatggattgggtatatatacccaagggatgacagcccgaagtataacgagaattttaaaggaaaggtgacgatcaccgccgataagtccacatctactgcgtacatggaactttcgtcactgcggagcgaggacaccgctgtctattactgtgccattcccgatcgcagtggctatgcatggttcatctactggggtcaggggacattggtgaccgtttcctctgccagcactaaaggaccttccgtgtttccattagctccctcaagtaagagcacatctggcggcaccgcagccctggggtgcctagtcaaagactacttccctgaaccagtgacggtatcctggaactcaggagctctcactagcggtgttcatacctttcccgccgtgctgcagagttctggcctttattccctgagctcggtcgtgacagtgccttcttcctcattggggactcagacctacatttgtaatgtcaaccacaagccaagtaatacaaaagttgataagcgagtggagccgaaaagctgcgacaaaacccatacgtgtcccccttgcccagcgcccgaggcagccggaggcccttccgtattcctctttccacccaagccgaaagatactctgatgatctctcgtacacctgaagtgacctgtgtcgtggttgacgtgagccacgaggatcccgaagtcaagttcaactggtatgtggacggtgtagaggttcataatgctaaaactaagccaagagaggaacaatacaactcaacatatagggtggtcagtgtgctgaccgtcctccaccaggattggttaaatgggaaagagtacaagtgcaaggtgtccaacaaagccctgcctgcacccatagaaaagacgatcagcaaagctaagggacagccacgggagccccaggtttatacccttcctccatctcgcgaagagatgacaaagaatcaagtgtcattgacttgtctggtaaagggcttttacccgagtgacattgccgtcgagtgggaaagcaacggccagcccgagaataactacaagaccacacctccagtgctagactccgatgggtctttctttctctattcgaaactgactgttgacaagagcagatggcagcaaggaaatgtgttctcctgctcagtcatgcacgaagcgcttcataaccactacacccagaaaagtctgtctttgagccccggt

SEQ ID NO: 23691 - RNA, 642 nt, synthetic construct
  misc_feature 1..642: note = derived and/or modified sequence opt3 from Risankizumab_LightChain1
  source 1..642: mol_type = other RNA
gacatccagatgacccaaagcccctcctctctgtcagccagtgtgggcgatagagtcacaattacttgcaaggctagcagggacgttgcaatagccgtggcgtggtaccagcagaaacctgggaaggtaccaaaactccttatctattgggcttccacgcggcacaccggagtgccgtctcgcttctcgggttcaggcagccgaacagattttactctgaccattagttccttgcagcccgaggacgtcgccgattacttctgtcatcaatattctagctacccttttacattcgggtccggaaccaagttagaaatcaaacgtactgtggcagccccatcagtttttatttttccccctagtgacgagcagctaaagagcggcacagcttctgtggtctgcctgctcaacaatttctatccaagagaagcaaaggtgcagtggaaagtagataacgccctgcagtccggtaattcacaagagagcgttaccgaacaggacagtaaggattctacgtactcccttagctcgactctgaccttgtctaaagctgactatgagaagcacaaagtgtacgcctgtgaggtcacacatcaggggctctcctcacccgtgactaagagtttcaacaggggagaatgc

SEQ ID NO: 23692 - RNA, 1353 nt, synthetic construct
  misc_feature 1..1353: note = derived and/or modified sequence opt3 from Rituximab_HeavyChain
  source 1..1353: mol_type = other RNA
caggtgcaactgcagcagcccggcgccgagctcgtcaagcctggggctagcgttaaaatgtcctgcaaggcatctggatacaccttcacatcatataacatgcactgggtgaaacagactccaggtagaggccttgaatggatcggggccatttacccgggaaatggcgacacgagttataaccaaaagtttaaaggtaaggcgaccctgacagctgataagagctcctctactgcctacatgcagttgtcgtcattaaccagcgaggacagtgcagtatattactgtgccaggtccacatattacgggggagattggtacttcaatgtgtggggcgctggcaccactgtcacagtgtctgcagccagcaccaaagggccctccgtttttcctctggctccatcaagtaagagcacgtctggaggtactgccgcgctaggctgcctcgtgaaagactatttccccgaacctgtcaccgtgtcctggaactcaggggcactgacaagcggagtacatacttttccagccgttcttcagagttctggcctgtactccttgagctcggtggtcaccgtgccctcttcctcactcggtacacagacctatatatgtaatgtgaaccacaagcctagtaatacgaaagtcgataagaaggttgagccaaaaagctgcgacaagactcatacatgtccgccctgccctgctccagaactgctcgggggaccctccgtgttcctgtttcctccaaaacccaaggataccttaatgatctctcggactccggaggtaacatgtgtggtcgtggacgttagccacgaggatcctgaagtgaaattcaactggtacgtcgacggcgtggaggtacataatgccaagaccaaaccccgcgaagaacaatataactcaacgtaccgagttgtgagtgtcctgaccgtgcttcaccaggattggttgaatggcaaggagtataagtgcaaagtctccaacaaggcactgccagctcctattgagaaaacaatcagcaaggccaaagggcagccccgtgagccacaggtgtacactctacccccttctagagacgaactcaccaagaatcaagtttcactgacatgtcttgtgaagggattttacccaagtgatattgcggtagagtgggaaagcaacggtcagccggagaataactataaaactacaccccctgtcctggactccgacggctctttctttttgtactcgaagctcaccgtggataaatccaggtggcagcaagggaacgttttcagctgctcagtgatgcacgaggccctgcataatcactatacccagaagagtttatctctgagcccaggaaaa

SEQ ID NO: 23693 - RNA, 1353 nt, synthetic construct
  misc_feature 1..1353: note = derived and/or modified sequence opt3 from Rituximab_HeavyChain_variant
  source 1..1353: mol_type = other RNA
caggtgcaactgcagcagcccggcgccgagctcgtcaagcctggggctagcgttaaaatgtcctgcaaggcatctggatacaccttcacatcatataacatgcactgggtgaaacagactccaggtagaggccttgaatggatcggggccatttacccgggaaatggcgacacgagttataaccaaaagtttaaaggtaaggcgaccctgacagctgataagagctcctctactgcctacatgcagttgtcgtcattaaccagcgaggacagtgcagtatattactgtgccaggtccacatattacgggggagattggtacttcaatgtgtggggcgctggcaccactgtcacagtgtctgcagccagcaccaaagggccctccgtttttcctctggctccatcaagtaagagcacgtctggaggtactgccgcgctaggctgcctcgtgaaagactatttccccgaacctgtcaccgtgtcctggaactcaggggcactgacaagcggagtacatacttttccagccgttcttcagagttctggcctgtactccttgagctcggtggtcaccgtgccctcttcctcactcggtacacagacctatatatgtaatgtgaaccacaagcctagtaatacgaaagtcgataagaaggctgagccaaaaagctgcgacaagactcatacatgtccgccctgccctgccccagaactgctcgggggaccctccgttttcctgtttcctccaaaacccaaggataccttaatgatctctcggactccggaggtgacatgtgtagtggtcgacgtgagccacgaggatcctgaagttaaattcaactggtacgtggacggcgtcgaggtgcataatgcaaagaccaaaccccgcgaagaacaatataactcaacgtaccgagtagttagtgtgctgaccgtccttcaccaggattggttgaatggcaaggagtataagtgcaaagtgtccaacaaggctctgccagcccctattgagaaaacaatcagcaaggcgaaagggcagccccgtgagccacaggtctacactctacccccttctagagacgaactcaccaagaatcaagtgtcactgacatgtcttgttaagggattttacccaagtgatattgccgtggagtgggaaagcaacggtcagccggagaataactataaaactacaccccctgtactggactccgacggctctttctttttgtactcgaagctcaccgtcgataaatccaggtggcagcaagggaacgtgttcagctgctcagttatgcacgaggcactgcataatcactatacccagaagagtttatctctgagcccaggaaaa

SEQ ID NO: 23694 - RNA, 639 nt, synthetic construct
  misc_feature 1..639: note = derived and/or modified sequence opt3 from Rituximab_LightChain
  source 1..639: mol_type = other RNA
cagatcgtgctgagccaatcccccgccattctctctgcttcacctggcgagaaggtcaccatgacatgcagagcaagtagctccgtttcttacatacactggttccagcagaaaccagggtcgtcaccgaagccctggatctatgccactagcaaccttgcgagtggagtgcctgtaaggttttccggttctggcagcgggacgtcctactcactgaccattagtcgggtggaagctgaggacgccgcaacatattactgtcagcaatggactagcaatccacccaccttcggaggcggtacaaaattggaaatcaagcgcaccgtcgccgctccttctgtgtttattttcccaccctccgatgagcagttaaaatcagggactgcaagcgttgtgtgcctgctaaacaatttttatcctcgagaagccaaggtccagtggaaggtggacaacgctctccagagtggaaattctcaagagtccgtaacagagcaggatagcaaagactcgacctactctctgtcctcaacgcttactctgagtaaggccgattatgaaaaacataaggtttacgcgtgtgaggtgacccaccagggcttgagctccccagtcacaaaatctttcaaccgtggcgaatgc

SEQ ID NO: 23695 - RNA, 714 nt, synthetic construct
  misc_feature 1..714: note = derived and/or modified sequence opt3 from Rivabazumab_pegol_HeavyChain1
  source 1..714: mol_type = other RNA
gaggtgcagctggtcgaaagcggcgggggagttgtgcaacccggtaggtccctcaggctttcttgcgccgcttcaggcttcacctttagtaactaccctatgcactgggtacggcaggcaccagggaagggactggagtgggtggccgtcatcagctatgacggctccgaaaaatggtacgcggattctgtgaagggtcgcttcacaatttcgcgagacaattcaaagaacactttgtatttagagatgaatagcctgcgtccggaagatacggctgtttactattgtgccagaaacagaggggacatatactatgattttacctacgcaatggacatctggggacagggcacaactgtgaccgtcagttccgcctctacaaaaggccccagcgtgttccctctagctccatcctcaaaaagtaccagcgggggaactgcagccctcggttgcctggtaaaggattactttcccgagcctgttacagtgtcttggaactccggcgctcttacctcaggggtccatacgttcccagccgtgctgcagagcagtggattgtattctctctccagcgtggtcactgttccctcgtcttccctgggcacccaaacatacatttgtaatgtgaatcacaagccttcaaacactaaagtagacaagaaagtggagccaaagagtagcgataaaacccatacatgcccgccctgtcctgcg

SEQ ID NO: 23696 - RNA, 642 nt, synthetic construct
  misc_feature 1..642: note = derived and/or modified sequence opt3 from Rivabazumab_pegol_LightChain1
  source 1..642: mol_type = other RNA
gacatccagctgacccaaagcccctccacactctctgcctcagtgggcgatagtgtcactattacgtgcagagctagcgagggggttgacaggtggcttgcatggtaccagcagaagcctggacgggccccaaaactgttgatatatgatgcgtccaccttacagtctggtgtgccgtcgcgcttctcaggcagcgggagtggaacagaattttccctgactatctctagcctacaacccgacgatgtagctacctactattgtcagcacttctggggcacaccttacacctttggtcaggggactaagctcgagattaaacgaacagtggccgcaccatccgtcttcatctttcccccttcagacgaacagctgaagagtggaaccgccagcgtggtttgccttctgaacaatttctatccacgtgaggctaaagtgcaatggaaggtcgataacgcattgcagtctggcaattcccaggaatcagtgacggagcaggacagcaaggatagtacttactctctctccagcaccctgacactgtcgaaagccgactatgagaagcataaagtatacgcttgtgaagttactcaccaaggcctctcttcccccgtgaccaagtcatttaacagaggggagagt

SEQ ID NO: 23697 - RNA, 1344 nt, synthetic construct
  misc_feature 1..1344: note = derived and/or modified sequence opt3 from Robatumumab_HeavyChain1
  source 1..1344: mol_type = other RNA
gaggtgcagctggtccaaagcggcgggggactcgttaagcccggtggctcccttagactgtcttgcgccgcttcagggttcacctttagtagcttcgcaatgcactgggtgaggcaggcccctggaaaaggcttggaatggatctccgtaattgacacacggggtgcgacttactatgctgattctgtgaaggggcgctttacgatatcgcgagacaacgccaaaaattcattatacctgcagatgaacagcctacgtgcagaggataccgccgtctattactgtgctagactcggaaatttctattacggcatggacgtgtggggccaggggacaactgttaccgtgagttccgcatctacaaagggaccaagcgtctttccgctggccccctcctcaaaaagtaccagcggtggcactgctgcccttgggtgcctggtgaaggattatttccctgaaccagtaacagtttcttggaactccggagcgttgacctcaggcgtgcatacgtttcccgcagtcctccaaagcagtggtctgtactctctgtccagcgtggtgactgtcccttcgtcttccctcgggacccagacatacatctgtaatgttaaccacaagccatcaaatactaaagtggacaagaaagtagagcccaagagttgcgataaaacccatacatgtcctccatgcccggcccccgaattactgggaggccctagcgtgttcctttttccacccaagcctaaggacaccttgatgatttccaggacgccagaggtcacttgtgtggttgtggatgtctctcacgaggaccccgaagtgaaattcaactggtatgtagatggcgttgaggtgcataatgctaagacaaaaccgcgggaggaacagtacaacagcacctatcgcgtcgtgtcagtcctgactgtgctacaccaggactggctcaatgggaaggagtacaaatgcaaggttagtaacaaagccctgcctgcacccatcgaaaagacaatttccaaggctaaaggacaaccaagagagcctcaggtgtatacccttcccccaagcagggatgaactgacgaagaatcaggtatctttgacctgtctcgtcaaaggtttttacccctcagacatcgccgtggagtgggaaagtaacggccagcctgagaataactataagacaactccaccggttctggacagcgatgggtccttctttttatactctaaactgaccgtggacaagtcgcggtggcaacagggaaacgtcttcagctgctccgtgatgcacgaggcgctccataatcactacacacagaagtcacttagtctgtctcccggcaaa

SEQ ID NO: 23698 - RNA, 642 nt, synthetic construct
  misc_feature 1..642: note = derived and/or modified sequence opt3 from Robatumumab_LightChain1
  source 1..642: mol_type = other RNA
gagatcgtgctgacccagagccccggcacactctccgtctctcctggggaacgggccactctttcatgcagggctagtcaaagcattggatcctctctgcactggtaccagcagaagccaggtcaggcaccgcggttgttaataaaatatgcctcgcaatcactgagcggcatccccgaccgcttcagtgggtccggatctggcacggattttaccctaacaattagccgactcgagcctgaagacttcgcggtttactattgtcatcagtcctcacgtctgccacacacttttggtcaggggaccaaggtggagatcaaaagaacagtagctgcccccagtgtgttcatttttcctccaagcgatgaacagcttaagtctggaaccgcatccgtcgtgtgcctgttgaacaatttctaccccagggaggccaaagttcaatggaaggtggacaacgctctccagtcaggcaatagccaggagagtgtcactgaacaggattctaaggactccacatatagcctgtcgtctaccctgacgctctccaaagcagattacgagaagcataaagtgtatgcctgtgaagtaactcaccaaggcttatcaagtcctgttaccaagagctttaacagaggggagtgc

SEQ ID NO: 23699 - RNA, 1368 nt, synthetic construct
  misc_feature 1..1368: note = derived and/or modified sequence opt3 from Roledumab_HeavyChain1
  source 1..1368: mol_type = other RNA
caggtgcaactggtcgagagcggcgggggagttgtgcagcccggtagatccctcaggctttcttgcaccgcctcaggcttcacatttaagaactacgctatgcactgggtacggcaggcccctgcaaaagggctggaatgggtggcgactatcagttatgacggacgcaatattcagtacgctgatagcgtcaagggccgattcacgttttcccgtgacaactctcaagataccttgtatttacagcttaattcgctaagaccagaggacacagccgtgtactattgtgcaaggccggttcggtcacgctggctccagctgggtcttgaagatgccttccatatatgggggcagggaactatggtgaccgtcagcagtgcttccacaaaaggcccctctgtgtttcctctggcaccaagctccaagtcaaccagtggcgggactgccgctttgggatgcctcgtaaaagactacttccccgagcctgttacagtgagctggaactctggtgccctgacctccggcgtccacacgtttccagcggtgctgcaatcaagcgggctctatagtttatcttccgtggtcactgttcccagctcgtctctgggaacccagacatacatctgtaatgtgaaccataagccttccaatactaaggtagataaaaaggtggaaccaaaatcatgcgacaagacccacacatgtccgccctgccctgcaccagagcttttgggcggtcccagtgtcttcctgtttcctccaaaacccaaggataccctaatgattagcagaacgccggaggtgacttgtgttgtggtcgacgtgtcccatgaagatcctgaggtaaagttcaactggtacgttgacggggtggaagtccacaatgccaaaacaaagcccagggaggagcagtataactctacctaccgggtggtcagcgtgctcactgttctgcaccaggattggcttaatggaaaagaatataagtgcaaagtgtcaaacaaggctctgccagcccctatcgagaaaacaattagtaaggcaaagggccaaccccgcgaaccacaggtatacaccttgcccccttcccgagacgagctcacgaaaaatcaggtcagcctgacctgtttagtgaagggcttttatccatctgacatcgctgttgaatgggagtcaaacgggcaaccggagaataactacaaaacaactccccctgtgctggatagtgacggtagcttctttctctattccaagctgaccgtcgataaatctagatggcagcagggaaacgtgttctcgtgcagcgtaatgcatgaagccctgcacaatcattacacacagaagtccttgtcactaagtccaggcaag

SEQ ID NO: 23700 - RNA, 642 nt, synthetic construct
  misc_feature 1..642: note = derived and/or modified sequence opt3 from Roledumab_LightChain1
  source 1..642: mol_type = other RNA
gccatcagaatgacccagagcccctcctctttctcagctagtacaggcgacagggtgactattacgtgccgggcaagccaagatatacgcaactacgtcgcctggtatcagcagaagtccgggaaagcgcctaagtttctgatctacgctgcctctaccctccagtcgggagttccatcacgattcagcggtagtggctccgggacagactttactcttaccattaattctctgcaaagcgaggatttcgcaacatattactgtcagcagtattacaactccccgcccacctttggacagggcactcgtgtggaaatcacaagaaccgtagccgctccttcagtgttcatttttccacccagtgacgagcaattgaaaagcggtacggcatctgtcgtgtgcttactgaataacttctatcctagggaagccaaggttcagtggaaagtggataatgctctacagtccgggaactcacaggagagcgtcactgaacaagacagtaaggattctacctactccctcagctcgacactgactctttctaaggccgactacgagaaacacaaggtgtatgcgtgtgaggtaacccatcagggactgtcctcaccagttacaaaaagttttaatcggggcgaatgc

SEQ ID NO: 23701 - RNA, 639 nt, synthetic construct; identical to SEQ ID NO: 23655
  misc_feature 1..639: note = derived and/or modified sequence opt3 from Romosozumab_fab_fragment
  source 1..639: mol_type = other RNA

SEQ ID NO: 23702 - RNA, 1347 nt, synthetic construct
  misc_feature 1..1347: note = derived and/or modified sequence opt3 from Romosozumab_HeavyChain1
  source 1..1347: mol_type = other RNA
gaggtgcagctggtccaaagcggcgccgaagttaagaaacccggggcttccgtgaaggtatcttgcaaagcatcaggatacaccttcacagactataacatgcactgggtgagacaggcccctggtcagggcctcgagtggatgggggaaatcaatccaaacagtggaggcgcgggttacaatcagaagtttaaagggagggtcactatgacgaccgatacaagcacttccaccgcttatatggagcttcggtctctgcgctcggacgatacagccgtgtactattgtgcacgattgggatacgacgatatttatgacgattggtacttcgacgtttggggccaaggcaccactgtgacagtctcaagcgccagtaccaaggggccgtccgtgtttcccttagctccttgctctcgtagcacgtccgaatcaactgcagccctgggatgtctagtaaaggattacttcccagagcccgttaccgtgagttggaacagcggtgctctcacatctggcgtccatacttttcctgccgtgctgcagtcctcagggctttatagcctgagttctgtggtcaccgttccatccagcaatttcggaacacagacctacacgtgcaacgtggaccacaaaccctcgaatactaaggtagataaaacagtggagagaaagtgttgcgtcgaatgtcctccatgcccggcgccccctgtggcaggcccatctgttttcttgtttccccctaaaccaaaggacaccctcatgatatccaggactcccgaggtgacatgtgtcgtggtagatgtttcacatgaagacccggaggtgcagtttaactggtatgtcgacggtgtggaggtccacaatgccaagaccaaacctcgggaggaacaattcaacagtacgtttcgcgtggttagcgtgctgaccgtagtccatcaggattggctgaatgggaaggaatacaaatgcaaggtgtccaacaaaggactccccgctccaatcgagaagacaatttctaaaactaagggccagcctagagaaccccaggtttataccttaccacccagcagggaggagatgacaaagaatcaagtgtcactgacttgtcttgtcaaaggcttctaccctagtgacatcgccgtggaatgggagtccaacgggcagccagaaaataactataagaccacaccgcccatgttggatagcgacggatcatttttcctgtactctaaactaaccgtagataagagtcggtggcagcaaggtaacgtgttcagctgctccgttatgcacgaggcactccacaatcattacactcagaaatctctgtcgcttagccctggcaag

SEQ ID NO: 23703 - RNA, 642 nt, synthetic construct
  misc_feature 1..642: note = derived and/or modified sequence opt3 from Romosozumab_LightChain1
  source 1..642: mol_type = other RNA
gacatccagatgacccaaagcccctcctctctgtcagccagtgtgggcgatagagtcacaattacttgcagggctagccaggacatatccaactacctcaattggtatcagcagaagcctgggaaagcaccaaaacttctgatctactatacgtctcggttgttatcgggagttccgtcacgcttcagcggtagtggctccgggaccgattttacactgactatttctagcctacaacccgaggacttcgccacctactattgtcagcagggagatacactcccttacacctttggcggtgggactaaggtggaaatcaagcgaacagtagcggctccatccgtgttcatttttcccccttcagacgagcagctgaaaagtggaaccgccagcgtcgtgtgccttctgaacaatttctatccacgtgaagcaaaggttcaatggaaggtggataacgccttgcagtctggcaattcccaggagtcagtcacggaacaggacagcaaagatagtacttactctctctccagcaccctgacactgtcgaaggctgactacgagaaacacaaggtgtatgcatgtgaggtaactcatcaaggcctctcttcccccgttaccaaatcatttaacagaggggaatgc

SEQ ID NO: 23704 - RNA, 1326 nt, synthetic construct
  misc_feature 1..1326: note = derived and/or modified sequence opt3 from Rontalizuab_HeavyChain1
  source 1..1326: mol_type = other RNA
gaggtgcagctggtcgaaagcggcgggggactcgttcaacccggtggctcccttagactgtcttgcgccacctcagggtacacattcactgagtatatcattcactgggtgaggcaggctcctggaaagggcttggaatgggtagcaagtataaacccagactacgatatcacgaattataaccagcggtttaaaggtcgcttcaccattagcttagacaagtccaaacgaacagcctacctgcaaaattctctacgtgcggaggatactgctgtgtattactgtgcctcgtggatctcagactttttcgattattgggggcagggaaccctcgtcacagtgagcagtgcatccaccaagggcccgtctgtttttcccctggcccctagctccaaatcaactagcggcgggacagctgcacttggatgcctggtgaaggactacttcccagaacccgtcaccgtgagctggaactctggtgccttgacgtccggcgtacatacttttcctgctgttctccagtcaagcgggctgtacagtctgtcttccgtggtcaccgtgccaagctcgtctctcggaacacagacttatatttgtaatgtgaaccacaagccctccaataccaaagtcgataagaaagttgagcctaagtcatgcgacaaaacacatacctgtccaccgtgccccgcccctgagttactgggcggtccaagtgtgttcctttttccccctaagccaaaggatacgttgatcagcagaactcccgaagtaacatgtgtggtcgtggacgtttcccacgaggatccggaagtgaaattcaactggtacgtcgacggggtggaggtacataatgcgaagaccaaacctagggaggaacagtataactctacttaccgggttgtgagcgtcctgacagtgctacaccaagattggctcaatggaaaggagtataaatgcaaggtctcaaacaaagcactgcccgccccaatagaaaagaccatcagtaaggctaaaggccagcctcgcgagccccaggtgtacacgcttccaccctccagagaagagaccaagaatcaggttagcctgacatgtttggtgaaaggcttttatccttctgacattgccgtagagtgggaatcaaacgggcaaccagagaataactacaagactaccccgcccgtcctcgacagtgatggaagtttctttctgtactccaaattaacagtggacaagtctaggtggcagcagggtaacgttttctcgtgcagcgtgcacgaagcactgcataatcactatactcaaaagtccctctcacttagtcctggc

SEQ ID NO: 23705 - RNA, 648 nt, synthetic construct
  misc_feature 1..648: note = derived and/or modified sequence opt3 from Rontalizuab_LightChain1
  source 1..648: mol_type = other RNA
gacatccagacccaaagcccctcctctctgtcagccagtgtgggcgatagagtcacaattacttgcagggctagccagtccgtttctacgtcgtcatacagctatcactggtaccagcagaagcctgggaaagcaccaaaggtgctcataagttatgcctccaaccttgagtctggagtaccgagccggttctccggttcaggcagtgggaccgactttacactgactatcagctctttgcaacccgaagatttcgcgacctactattgtcagcattcctggggcattcctcgcacatttggacagggtaccaaagtggagatcaagcgaactgtcgctgccccatcagtgttcatttttccccctagcgacgaacagttaaaaagtgggacagcatctgttgtgtgcctgctaaataacttctacccacgtgaggccaaggtccaatggaaggtggataatgctctccagtccggaaacagccaggaatcggtaaccgagcaggactctaaagattccacgtattcactgagtagcactcttaccctgtccaaggcagactacgagaaacacaaggtttacgcctgtgaagtgacacatcaaggcttgtctagccccgtcactaaatcatttaatagaggcgagtgc

SEQ ID NO: 23706 - RNA, 1341 nt, synthetic construct
  misc_feature 1..1341: note = derived and/or modified sequence opt3 from Rontalizumab_HeavyChain1
  source 1..1341: mol_type = other RNA
gaggtgcagctggtcgaaagcggcgggggactcgttcaacccggtggctcccttagactgtcttgcgccacctcagggtacacattcactgagtatatcattcactgggtgaggcaggctcctggaaagggcttggaatgggtagcaagtataaacccagactacgatatcacgaattataaccagcggtttaaaggtcgcttcaccattagcttagacaagtccaaacgaacagcctacctgcagatgaatagtctacgtgcggaggatactgctgtgtattactgtgcctcgtggatctcagactttttcgattattgggggcaaggaaccctcgtcacagtgagcagtgcatccaccaagggcccgtctgtttttcccctggcccctagctccaaatcaacttctggcgggacagctgcacttggatgcctggtgaaggactacttcccagaacccgtcaccgtgagctggaactctggtgccttgacgtccggcgtacatacttttcctgctgttctccagtcaagcgggctgtacagtctgtcttccgtggtcaccgtgccaagctcgtctctcggaacacagacttatatttgtaatgtgaaccacaagccctccaataccaaagtcgataagaaagttgagcctaagtcatgcgacaaaacacatacctgtccaccgtgccccgcccctgagttactgggcggtccaagtgtgttcctttttccccctaagccaaaggatacgttgatgatcagcagaactcccgaagtaacatgtgtggtcgtggacgtttcccacgaggatccggaagtgaaattcaactggtacgtcgacggggtggaggtacataatgcgaagaccaaacctagggaggaacagtataactctacttaccgggttgtgagcgtcctgacagtgctacaccaagattggctcaatggaaaggagtataaatgcaaggtctcaaacaaagcactgcccgccccaatagaaaagaccatcagtaaggctaaaggccagcctcgcgagccccaggtgtacacgcttccaccctccagagaagagatgaccaagaatcaggttagcctgacatgtttggtgaaaggcttttatccttctgacattgccgtagagtgggaatcaaacgggcaaccagagaataactacaagactaccccgcccgtcctcgacagtgatggtagcttctttctgtactccaaattaacagtggacaagtctaggtggcagcagggaaacgttttctcgtgcagcgtgatgcacgaagcactgcataatcactatactcaaaagtccctctcacttagtcctggcaaa

SEQ ID NO: 23707 - RNA, 654 nt, synthetic construct
  misc_feature 1..654: note = derived and/or modified sequence opt3 from Rontalizumab_LightChain1
  source 1..654: mol_type = other RNA
gacatccagatgacccaaagcccctcctctctgtcagccagtgtgggcgatagagtcacaattacttgcagggctagccagtccgtttctacgtcgtcatacagctatatgcactggtaccagcagaagcctgggaaagcaccaaaggtgctcataagttatgcctccaaccttgagtctggagtaccgagccggttctccggttcaggcagtgggaccgactttacactgactatcagctctttgcaacccgaagatttcgcgacctactattgtcagcattcctggggcattcctcgcacatttggacagggtaccaaagtggagatcaagcgaactgtcgctgccccatcagtgttcatttttccccctagcgacgaacagttaaaaagtgggacagcatctgttgtgtgcctgctaaataacttctacccacgtgaggccaaggtccaatggaaggtggataatgctctccagtccggaaacagccaggaatcggtaaccgagcaggactctaaagattccacgtattcactgagtagcactcttaccctgtccaaggcagactacgagaaacacaaggtttacgcctgtgaagtgacacatcaaggcttgtctagccccgtcactaaatcatttaatagaggcgagtgc

SEQ ID NO: 23708 - RNA, 1341 nt, synthetic construct
  misc_feature 1..1341: note = derived and/or modified sequence opt3 from Rovalpituzumab_tesirine_HeavyChain1
  source 1..1341: mol_type = other RNA
caggtgcaactggtccagagcggcgccgaggttaagaaacccggggcttccgtgaaggtatcttgcaaagcatcaggatacaccttcacaaactatggtatgaattgggtgagacaggcccctggccaggggctcgaatggatgggatggatcaacacttacacgggcgagccaacctatgcggacgattttaagggtagggtcacaatgactaccgacacaagtaccagcactgcttacatggaacttcggtccctgcgctctgatgacacagccgtgtattactgtgcacgaattggggattcgtcaccgagcgactattggggacaaggcaccttggttacggtgagttccgcctctactaaaggccccagcgtcttccctttagctccatcctcaaagagtaccagcgggggaacagcagccctgggttgcctagtgaaggattactttcccgagcctgtaactgtttcttggaactccggcgctctcacctcaggggtgcacacattcccagccgtcctgcagagcagtggactttactctctgtccagcgtggtgaccgtcccctcgtcttccttgggcacgcagacttatatatgtaatgttaatcataaaccttcaaacacaaaggtggacaaaaaggtagaaccaaaaagttgcgataagacccacacttgtccgccctgccctgcgccagagctcctgggtgggcccagcgtgtttctgttccctccaaagcccaaagacacactcatgatctcccgtaccccggaggtcacgtgtgtggttgtggatgtctctcatgaagaccctgaggtgaagtttaattggtacgtagatggagttgaagtgcacaacgcaaaaaccaagcccagagaggagcagtataatagcacatacagggtcgtgtcagtcttaactgtgctgcatcaagactggcttaacggcaaagaatataagtgcaaagttagtaataaggccttgccagctcctattgagaagaccatctccaaagccaagggccagccccgggaaccacaggtgtacacactgccccctagccgcgacgagctaactaaaaaccaggtatctctcacctgtctggtcaaggggttctatccatcagatattgcagtggaatgggagagtaatggacaaccggagaacaattacaaaacaactccccctgttcttgacagcgatggttcctttttcctgtactctaagttgaccgtggacaagtcgagatggcagcagggcaacgtctttagctgctccgtgatgcacgaagctctccacaaccattatacgcaaaaatcactgagtttatctccaggg

SEQ ID NO: 23709 - RNA, 642 nt, synthetic construct
  misc_feature 1..642: note = derived and/or modified sequence opt3 from Rovalpituzumab_tesirine_LightChain1
  source 1..642: mol_type = other RNA
gagatcgtgatgacccagagccccgccacactgtccgtctctcctggcgaaagagctactctctcatgcaaggcaagtcaaagcgtttccaacgacgtggtatggtaccagcagaaaccagggcaggccccgaggcttctgatttattacgcgtctaatcggtatacgggaatacccgctcgcttctcgggttcaggcagcgggaccgagtttacattgactatcagttccttacaatctgaagatttcgccgtgtactattgtcagcaggactacaccagcccttggacatttggacagggcaccaagctggagattaaacgaactgtcgcagccccatccgtgttcatctttcccccttcagatgaacaactaaagagtggtacagctagcgttgtgtgcctcctgaacaatttctatccacgtgaggcaaaagtccagtggaaggtggacaacgcccttcagtctggaaattcccaggagtcagtaaccgaacaagatagcaaggacagtacgtactctctgtccagcactttgaccctctcgaaagctgattacgagaagcacaaagtttatgcctgtgaagtgacacatcaggggctgtcttcccccgtcactaagtcatttaacagaggcgagtgc

SEQ ID NO: 23710 - RNA, 1341 nt, synthetic construct
  misc_feature 1..1341: note = derived and/or modified sequence opt3 from Rovelizumab_HeavyChain1
  source 1..1341: mol_type = other RNA
caggtgcaactggtccagagcggcgccgaggttaagaaacccggggcttccgtgaaggtatcttgcaaagcatcaggatacaccttcacaaacaattggatgcagtgggtgagacaggcccctggtcaaggcctcgaatggatgggggcgatctttccaggagacgatgagactaggtatacgcagaagttccggggcaaagctaccattacagccgacaccagtactagcacagcatacatggaactttcctctctgcgctcggaggataccgccgtctattactgtggtcgagggggaaagttgcgtccgtttgctttagactattggggccagggcactctggtgacagtttcaagcgcaagtaccaaggggccctccgtgttccctctagccccatgctctagaagcacgtccgaatcaactgctgccctcggatgtctggtcaaagattactttcccgagcctgtgaccgtaagttggaacagcggtgcgcttacatctggcgttcacactttcccagcagtgctgcagtcctcagggttgtatagcctcagttctgtcgtgaccgtgccctccagctcgctgggaacaaagacctacacgtgcaatgtcgaccataaaccttctaacactaaggttgataaaagggtggagtccaagtacggcccaccgtgtccctcatgccctgccccagaatttctgggtgggcccagtgtattcctctttcctccaaagcccaaagacacattaatgataagccggaccccggaggtgacttgtgtcgtggttgatgtgtcccaagaagaccctgaggtccagttcaattggtatgtggatggagtagaggttcacaacgctaagacaaaaccccgcgaggaacagtttaattctacctacagagtggtcagcgtgctgacggtccttcatcaggactggttgaacggcaaggaatataaatgcaaggtgtcaaataaaggcctgccaagttccatcgagaagaccattagcaaggccaaagggcaacctagggaaccccaggtttacacactaccaccctctcaggaggagatgactaagaaccaagtgtcactcacctgtctggtaaaaggattctatcctagtgatatcgcagtcgaatgggagagcaatggtcagccagaaaacaattacaagacaactccgcccgtgcttgactccgacggctcgtttttcctgtattctcggttgaccgttgataaaagccgctggcaggaggggaacgtgttctcctgctcagtcatgcacgaagctctccataatcactacacacagaagagtctgtctttaagcctgggaaag

SEQ ID NO: 23711 - RNA, 654 nt, synthetic construct
  misc_feature 1..654: note = derived and/or modified sequence opt3 from Rovelizumab_LightChain1
  source 1..654: mol_type = other RNA
gacatccagatgacccaaagcccctcctctctgtcagccagtgtgggcgatagagtcacaattacttgcagggctagcgagtccgttgaatcttacgggaacaatttcatgtattggtaccagcagaagcctggaaaagcaccaaagctccttatatatctggcctcgaacttggagtcaggtgtgccgagccggtttagtggctccgggtctggaacggacttcaccttaacaatcagctccctgcagcccgaagattttgcgacttactattgtcaccaagacaatgaggatcctccaaccttcggccagggtacaaaactagaaattaagcgcaccgtagctgccccctcagtgtttatcttccctccaagtgacgagcagctcaaaagcgggactgcatctgtcgtgtgcctgcttaacaatttttacccccgagaggccaaggttcagtggaaggtggataacgctctgcaatccggaaattcacaggaaagcgtcacagagcaggacagtaaagattctacctattccttgagctcgacgctcactctgtctaaggcagactacgaaaaacataaggtgtacgcctgtgaggtaacccaccagggcctgtcctcacctgttacaaaaagtttcaaccgtggcgagtgc

SEQ ID NO: 23712 - RNA, 1341 nt, synthetic construct
  misc_feature 1..1341: note = derived and/or modified sequence opt3 from Ruplizumab_HeavyChain1
  source 1..1341: mol_type = other RNA
caggtgcaactggtccagagcggcgccgaggttgtgaagcccggggcttccgtaaaactctcttgcaaggcatcaggatacatcttcaccagttattacatgtattgggtgaaacaggcccctggtcagggccttgaatggattggggagataaacccaagcaatggagacacaaactttaatgaaaagttcaaatccaaggcgactctgacggtcgataagtctgcttcgaccgcctacatggagttgagctcattaagaagtgaagacacagcagtgtattactgtactaggtccgatggccggaacgacatggattcttggggtcaagggaccctggttacagtgagctccgcctcaaccaaaggaccgagtgtctttcccctagctcctagctctaagtccacttcaggcggcacagcagccctcgggtgcctggtgaaagactatttcccagagcccgtaaccgttagctggaatagtggagctcttacgtctggtgtgcacacttttcctgccgtcctgcagtccagcggcttgtactcgctctcttccgtggtgaccgtcccatcaagtagcctggggacacagacttacatctgtaacgttaatcataagccctccaacaccaaagtggataagaaggtagagcctaaatcttgcgacaagacacacacctgtccaccgtgccccgcgcctgaactgctcggaggcccaagcgtgttcttatttccccctaaaccaaaggatacgctgatgatttcacgcactcccgaggtcacatgtgtggttgtggacgtcagtcatgaagatccggaggtgaaattcaattggtatgtagacggtgttgaggtgcacaacgcaaagaccaaacctcgagaagaacagtacaattccacttatcgtgtcgtgagcgtccttacagtgttgcatcaagattggctgaacgggaaggaatacaagtgcaaagtttctaataaggccctacccgctccaatcgagaaaaccatttcaaaggccaaaggacagcctagagaaccccaggtgtatacgctcccacccagtagggacgagctgaccaagaaccaggtaagccttacatgtctggtcaagggcttttacccttccgacatcgcagtggagtgggaatctaatggccaaccagagaacaactataaaactaccccgcccgttttggattcggacgggagcttctttctctactccaagctgacagtggataaatcacggtggcagcagggaaatgtcttcagttgctctgtgatgcacgaggctttacacaaccattacactcaaaagagcctgtccctctcacctggt

SEQ ID NO: 23713 - RNA, 654 nt, synthetic construct
  misc_feature 1..654: note = derived and/or modified sequence opt3 from Ruplizumab_LightChain1
  source 1..654: mol_type = other RNA
gacatcgtgctgacccagagccccgccacactctccgtctctcctggcgagagagctactatttcatgcagggcaagtcaacgggttagctcctctacgtactcgtatatgcactggtaccagcagaaaccagggcagccgcccaaacttctgataaagtatgcctcaaacttggaaagcggagtgcctgcgcgcttcagtggttccggctctgggaccgattttacattaactatcagctccgtagagccagaagacttcgctacctactattgtcaacattcatgggagattccccctacatttggaggcggtaccaaactggaaatcaagcgaactgtggccgcaccaagtgtcttcatttttccccctagcgatgagcagctaaaatctgggacagcctccgtggtttgcctcctgaataacttctacccacgtgaggctaaggtgcagtggaaggtcgacaatgcacttcagtcaggaaacagccaagaaagtgtgaccgagcaggattctaaagactccacgtatagcctgtcgtctactttgaccctctccaaggccgattacgaaaaacacaaggtatacgcttgtgaggttacacatcagggcctgtcaagtccggtgactaagagctttaatagaggcgagtgc

SEQ ID NO: 23714 - RNA, 1353 nt, synthetic construct
  misc_feature 1..1353: note = derived and/or modified sequence opt3 from Sacituzumab_govitecan_HeavyChain1
  source 1..1353: mol_type = other RNA
caggtgcaactgcagcagagcggctccgagctcaagaaacccggggcctctgtcaaggtttcatgcaaagctagtggatacaccttcacaaactatggtatgaattgggtgaagcaggcacctggccaagggcttaaatggatgggatggatcaacacttacacgggcgaaccaacctatacagacgattttaagggtagattcgcctttagcctggacacttccgtatctaccgcgtacttgcagatttcgtcattaaaggctgatgacacagccgtgtatttctgtgcaaggggagggtttggcagcagttactggtatttcgatgtctggggccaggggtccctggtgaccgtttctagcgcctccactaaaggaccgtcagtgtttcccctagctcctagtagcaagtctacatccggtggcaccgcagccctcgggtgcctggtcaaagactacttcccagagcccgtgacggtatcatggaatagcggagctcttacaagtggcgttcacacctttcctgccgtgctgcagtcttccggtttgtacagcctctcgtctgtcgtgacagtgccatcctcaagtctggggactcaaacctatatatgtaacgtcaatcataagcccagcaacacaaaagttgataagcgggtggaacctaagtcctgcgacaaaacccacacgtgtccaccgtgccccgcgcctgagctgctcggaggcccatctgtattcttatttccccctaagccaaaagatactctgatgatcagccgcacacccgaagtgacctgtgtcgtggttgacgtgtcacatgaggatccggaggtcaagttcaattggtacgtggacggcgtagaagttcacaacgcaaaaactaagcctcgagaggaacagtataatagtacataccgtgtggtctccgtgcttaccgtcttgcatcaggattggctgaacgggaaagagtataagtgcaaggtgagcaataaagccctacccgctccaattgagaagacgatctctaaagccaagggacagcctagagaaccccaagtttacaccctcccaccctcaagggaggaaatgactaaaaaccaggtgagtctgacttgtcttgtaaagggtttttatcctagcgacattgcagtcgagtgggaatccaatggccagccagagaacaattacaagaccacaccgcccgtgctggactctgatgggtcgttcttcttgtacagcaaactcactgttgacaagtcccggtggcaacagggaaacgtgttttcatgcagtgtcatgcacgaggctctgcacaaccattatacccagaaatctttaagcctgtcccctggcaag

SEQ ID NO: 23715 - RNA, 642 nt, synthetic construct
  misc_feature 1..642: note = derived and/or modified sequence opt3 from Sacituzumab_govitecan_LightChain1
  source 1..642: mol_type = other RNA
gacatccagctgacccaaagcccctcctctctctcagccagtgtgggcgatagagtcagcattacatgcaaggcttcccaggacgtttctatagcagtggcctggtaccagcagaaacctgggaaggcgccaaaacttctgatctattcggcttcatacaggtatactggagtaccggatcggttcagcggtagtggctccgggacggactttaccttgacaatttctagcttacaacccgaggatttcgccgtgtactattgtcagcagcactacatcactcctctgacctttggagcaggcacaaaggtcgaaattaaacgcaccgtggccgctccatccgttttcatctttcccccttcagacgagcagctaaagagtggtactgcaagcgtggtctgcctcctgaacaatttctatccacgagaagccaaggtgcaatggaaagtagataacgcccttcagtctggaaattcccaggagtcagttacagaacaggacagcaaggatagtacctactctctgtccagcacgttgactctctcgaaagctgactacgagaagcataaagtgtatgcgtgtgaggtcacccaccaagggctgtcttcccccgtgacaaagtcatttaaccgtggcgaatgc

SEQ ID NO: 23716 - RNA, 1326 nt, synthetic construct
  misc_feature 1..1326: note = derived and/or modified sequence opt3 from Samalizumab_HeavyChain1
  source 1..1326: mol_type = other RNA
caggtgcaactgcagcagagcggctccgagctcaagaaacccggggcctctgtcaagatctcatgcaaagctagtggatacagcttcaccgactatattatactttgggttagacagaaccctggtaagggcctggaatggatcgggcacattgatccatactatggatcctctaattacaacttgaaatttaagggcagggtgacaatcactgcagaccaatcgacgaccacagcctatatggagttatcaagcctgcggagtgaagatactgcggtatactattgtggtcgctccaagcgagactacttcgattactgggggcagggaaccacactaaccgtgtctagcgcttccactaaaggcccgtcagtctttcccctcgccccttgcagtcgtagcacatctgagtccaccgcagccctgggctgtcttgtgaaggactatttcccagaacccgttacggtgtcatggaatagcggggctctgaccagtggagtccatacttttcctgcagtgttgcagtcttccggtctctacagcctgtcgtctgtagttacagtgccatcctcaaacttcggcactcagacctatacatgcaatgtcgatcacaaacccagtaacaccaaggtggacaaaacggtggagagaaagtgttgcgtcgagtgtcctccatgcccggctccccctgttgccgggccaagcgtgtttctgtttccccctaagccaaaagatactctcatgatttccaggacacccgaagtaacctgtgtggtcgtggacgtttctcaagaggatccggaagtgcagttcaattggtacgtcgacggagtggaggtacataacgccaagactaaacctcgggaggaacagttcaatagcacatatcgcgttgtgtcagtcttaaccgtgctgcaccaggattggcttaacggcaaggagtacaaatgcaaggtcagtaataaaggtttgccctccagcatcgaaaagacgatatctaaggcgaaagggcaaccaagagagcctcaggtgtataccctgcccccatcacaggaagagatgacaaagaaccaagttagtctaacttgtctcgtgaaaggattttaccccagcgacatcgcagtagagtgggaatccaatggccagcctgagaacaattacaagaccacaccaccggtcctggactctgatggctcgttctttctttatagcaggctgactgtggacaaatcccggtggcaggaagggaacgttttctcatgcagtgtgatgcatgaggccttgcacaaccactacacccagaagtctctcagcctgtccttagga

SEQ ID NO: 23717 - RNA, 642 nt, synthetic construct
  misc_feature 1..642: note = derived and/or modified sequence opt3 from Samalizumab_LightChain1
  source 1..642: mol_type = other RNA
gacatccagatgacccaaagcccctcctctctgtcagccagtattggcgatagagtgacaataacttgcaaggctagccaggacatcaactcctacctctcttggttccagcagaaacctgggaaggcaccaaaacttctgatttatagggccaatcggttggtcgatggagttccgtcgcgcttttcaggtagcggcagtgggacggactacaccttaacaatctcctctctgcaacccgaggatttcgcggtgtattactgtctacagtatgacgaatttccttacactttcggaggcggtaccaagctcgagattaaacgaacagtagctgccccaagcgtgtttatctttcccccttccgatgaacagctgaagtcagggaccgcaagtgtcgtgtgccttctgaacaatttctatccacgtgaggccaaggttcagtggaaagtggacaacgctttgcaaagcggaaattctcaggaatccgtcactgagcaggattcaaaggacagcacatacagtctctcttccaccctgacgctgagcaaagcagattacgagaagcacaaagtgtatgcctgtgaagtaactcatcagggcctctcgtctcccgttaccaagtccttcaacagaggcgagtgc

SEQ ID NO: 23718 - RNA, 1338 nt, synthetic construct
  misc_feature 1..1338: note = derived and/or modified sequence opt3 from Sarilumab_HeavyChain1
  source 1..1338: mol_type = other RNA
gaggtgcagctggtcgaaagcggcgggggactcgttcaacccggtagatcccttaggctgtcttgcgccgcttcacggttcacctttgacgattacgcaatgcactgggtgcgccaggcccctggcaaggggttggagtgggtaagtggaatcagctggaactccggccgaattggttatgcggactctgtgaaagggcgtttcacaatatcgagagataatgctgaaaactcattatttctgcagatgaatggactaagggccgaggacactgcactctactattgtgccaagggccgggatagcttcgacatctggggccaggggacgatggtcaccgtgagttccgcttctacaaaaggaccaagcgtttttccgctggcaccctcctcaaagagtactagcggtggcaccgccgctcttgggtgcctggtgaaagattacttccctgaaccagtcacagtgtcttggaactccggagccttgacctcaggcgtacatacttttcccgcggttctccaaagcagtggtctgtattctctgtccagcgtggtcacagtgccttcgtcttccctcgggacccagacgtacatttgtaatgtgaaccacaagccatcaaatactaaggtcgacaaaaaggttgagcccaaaagttgcgataagacccatacatgtcctccatgcccggcacccgagttactgggaggccctagcgtgttcctttttccacccaaacctaaggacactttgatgatctcccgcaccccagaagtaacatgtgtggtcgtggatgtttctcacgaggaccccgaagtgaagttcaactggtatgtcgatggcgtggaggtacataatgccaaaaccaagccgagagaggaacagtacaacagcacgtacagggttgtgtcagtcctgactgtgctacaccaggactggctcaatgggaaagagtataagtgcaaagtcagtaacaaggctctgcctgcccccattgagaaaacaatctccaaggcaaagggacaaccacgggaacctcaggtgtacacccttcccccaagccgcgacgaactgactaaaaatcaggtttctttgacatgtctcgtgaagggtttttatccctcagatatagctgtagagtgggagagtaacggccagcctgaaaataactacaaaaccacgccaccggtcctggacagcgatgggtccttctttttatattctaagctgaccgtggacaaatcgcgatggcaacagggaaacgttttcagctgctccgtgatgcacgaggccctccataatcactacacacagaagtcacttagtctgtctcccggcaag

SEQ ID NO: 23719 - RNA, 642 nt, synthetic construct
  misc_feature 1..642: note = derived and/or modified sequence opt3 from Sarilumab_LightChain1
  source 1..642: mol_type = other RNA
gacatccagatgacccaaagcccctcctctgtgtcagccagtgtcggcgatagagttacaattacttgcagggctagccaggggatatcctcttggctggcatggtaccagcagaagcctggaaaagccccaaagctccttatctatggtgcgtcgtcactggagagcggcgtgccgagtcggttctccgggtctggaagcggcacggactttaccttgacaatttcctcattacaacccgaagatttcgctagttactattgtcagcaggccaacagctttccttacactttcggtcaggggaccaaactggagatcaagcgcacagtagcagccccatctgtgtttatttttcccccttccgacgaacaactaaaatcaggaaccgctagcgtcgtgtgcctcctgaataacttctatccacgagaggcaaaggttcagtggaaggtggataatgcccttcagagtggcaactctcaggaatccgtcactgagcaagacagcaaagattcgacatactctctgtcctcaaccttgacgctcagtaaggctgactatgagaaacacaaggtgtacgcctgtgaagtaactcatcagggcctgagctcccccgttaccaaatctttcaatcgtggggagtgc

SEQ ID NO: 23720 - RNA, 1296 nt, synthetic construct
  misc_feature 1..1296: note = derived and/or modified sequence opt3 from Satumomab_pendetide_HeavyChain
  source 1..1296: mol_type = other RNA
caggtgcaactgcagcagagcgacgccgagctcgtcaagcccggcgcttccgttaaaatctcttgcaaggcatcagggtacaccttcacagatcacgccattcattgggcgaaacagaagcctgaacaaggacttgagtggataggttatatcagtccaggcaacgacgatattaaatacaatgaaaagtttaaggggaaagctactctgacggccgacaagagctcctctaccgcatatatgcagttgaactcgttaacatcagaggatagcgccgtgtacttctgtaaaagaagttattacggacactggggccagggtactaccctgacagtatcctctgctagcaccaaggggccgtccgtgtttcccctagcaccttgctcaaggagtactagcgaatctacagccgctctcggatgtctggtcaaagactatttcccagagcccgtgaccgtttcctggaactcaggcgcccttacgagcggcgtgcatacttttcctgcggtcctgcagagttctgggttgtactccctcagctcggtggtaaccgttccatcttcctcactgggaacaaagacttacacatgcaatgtggatcacaagcccagtaatacaaaagtcgacaagcgggtgtgtcctccatgcaaatgtccggcacccaacctgctcggtggccctagcgtgttcatctttccacccaagattaaagatgtcttaatgatctccctgtctcctatagttacctgcgtggtagtggacgtcagcgaggatgacccagatgtgcaaatctcatggttcgttaataacgtggaagtccatacggcccagactcagacacaccgcgaggactataatagtacccttcgagtggtatccgctttgcccattcagcaccaagactggatgagcgggaaggaatttaaatgtaaggttaacaataaggatctgccggcccctatcgagcgtactatttctaaacccaagggatcagtgagagcaccacaggtctacgtgctacctcccccagaggaagagatgaccaaaaagcaggtcaccctcacgtgcatggtgaccgacttcatgcccgaagatatctatgttgagtggacaaacaatggcaaaactgaactgaactacaagaataccgagcctgtgcttgacagtgatggtagctattttatgtactccaagctgagggtagagaaaaagaactgggtcgaacggaactcttattcgtgtagcgtggttcatgaggggttgcacaatcatcacacaactaaatccttctcacgc

SEQ ID NO: 23721 - RNA, 630 nt, synthetic construct
  misc_feature 1..630: note = derived and/or modified sequence opt3 from Satumomab_pendetide_LightChain
  source 1..630: mol_type = other RNA
gacatccagatgacccaaagccccgcctccctgtctgtgtcagtcggcgagacagttactattacgtgcagagctagtgaaaacatatacagcaatctcgcatggtatcagcagaagcaggggaaatcccctcaacttctggtgtacgccgcgaccaacttggctgatggagtaccatctaggttctcgggttcaggcagcgggacacagtatagtttaaagatcaattccctgcagtctgaggactttggaagctactattgtcagcacttctggggcactccgtacacctttggtgggggaacacggctagaaattaaacgcgccgatgcagcccccaccgtgttcatctttcctccatccgacgagcaactcaagtcaggcactgctagtgtcgtgtgcctgcttaacaatttctatccccgagaagcaaaagttcagtggaaggtggataacgccctgcagagcggcaattctcaggagtccgtcacagagcaagactcaaaggatagcacctacagtttgtcttccacgctcactctgagcaaagctgactacgaaaagcataaagtgtatgcctgtgaggtaacccaccaggggctgtcgtctcctgttacaaagtcctttaac

SEQ ID NO: 23722 - RNA, 1371 nt, synthetic construct
  misc_feature 1..1371: note = derived and/or modified sequence opt3 from Secukinumab_HeavyChain1
  source 1..1371: mol_type = other RNA
gaggtgcagctggtcgaaagcggcgggggactcgttcaacccggtggctcccttagactgtcttgcgccgcttcagggttcacctttagtaactactggatgaattgggtgaggcaggcacctggaaagggcttggagtgggtagccgcgatcaaccaggacggtagcgaaaaatattacgtggggtccgtcaagggacggttcacaatttctcgcgataatgctaaaaactcgttatatctgcagatgaatagcctacgagtggaggacactgccgtttactattgtgtgcgtgattactatgacatactcacggattactacatccactattggtactttgacctgtggggcagaggcacccttgtcacagtgtcaagtgcatccactaaggggccatctgtattcccgctggcccccagctccaaatcaaccagtggaggtacagctgcattgggctgcctcgttaaggattattttcctgaaccagtgaccgtcagctggaactctggggccctgacttccggagtgcatacattccccgctgtgctgcaatcaagcggcctctacagtttatcttccgtcgttaccgtgcctagctcgtctctgggtacgcagacttatatttgtaatgtaaaccacaagccatccaataccaaagtggacaagagggtcgagcccaaatcatgcgataagacacatacttgtcctccatgcccggcccccgagcttttgggagggcctagtgtgtttctgttcccacccaaacctaaggacaccctaatgatcagccggacaccagaagttacctgtgtggtcgtggatgtatcccacgaggaccccgaagttaagtttaactggtacgtggatggcgtcgaggtgcataatgcgaaaacgaagccgcgcgaggaacagtataactctacttacagagtcgtgagcgttctcacagtgctgcaccaggactggcttaatggcaaagagtacaagtgcaaagtatcaaacaaggcactgcctgcccccattgagaaaaccatcagtaaggctaaggggcaaccaagggaacctcaggtctatactttgcccccatcccgggaagagatgaccaaaaatcaggtgagcctcacatgtctggttaagggattctacccctctgacatagccgtggagtgggaatcaaacggtcagcctgagaacaattataaaacgaccccaccggtcttagatagtgacggcagctttttcctgtactccaagctcacagtggataaatctcgctggcaacaggggaacgtattttcgtgcagcgtgatgcacgaagcacttcataatcactatactcagaagtccctgtcattgagtcccggaaag

SEQ ID NO: 23723 - RNA, 645 nt, synthetic construct
  misc_feature 1..645: note = derived and/or modified sequence opt3 from Secukinumab_LightChain1
  source 1..645: mol_type = other RNA
gagatcgtgctgacccagagccccggcacactctccctttctcctggggaaagagccactctgtcatgcagggctagtcaaagcgtctcctcttcgtacttggcatggtatcagcagaagccaggacaggccccgcggttactgatttacggtgcgtcaagccgcgctacgggcatacccgaccgattcagtgggtccggatctggcaccgattttacactaactatcagccgtctcgagcctgaagacttcgccgtttattactgtcaacagtatggttcctcaccatgcacctttgggcagggaacaagactggagattaaaaggaccgtggcagcccccagtgtattcatctttcctccaagcgatgaacagcttaagtctggcactgcttccgtggtctgtctgttgaacaatttctacccccgggaggcaaaagtgcaatggaaggttgacaacgccctccagtcaggcaatagccaggagagtgtgacagaacaggattctaaagactccacctatagcctgtcgtctacgctgactctctccaaggctgattacgagaagcacaaagtctacgcctgcgaagtgacccatcaagggttatcaagtcctgtaacaaagagctttaaccgcggagagtgt

SEQ ID NO: 23724 - RNA, 1335 nt, synthetic construct
  misc_feature 1..1335: note = derived and/or modified sequence opt3 from Seribantumab_HeavyChain1
  source 1..1335: mol_type = other RNA
gaggtgcaactgctcgaaagcggcgggggacttgtccaacccggtggctccctgagattgtcttgcgccgcttcagggttcacctttagtcactacgttatggcatgggtgaggcaggcccctggaaagggcttagagtgggtaagctccatctcttcgtcaggtgggtggacactgtatgcggacagcgtgaaaggacggttcactattagtcgcgataactccaagaatacgctatacctccagatgaactctctgcgagctgaagacaccgccgtctattactgtacacgtggccttaaaatggcaactatatttgattattggggccaggggaccctggtgacagttagctccgcctcaaccaagggaccaagtgtgttcccgttggctccctgcagcagatctacttccgagtcaacagcagccctcggttgtctggtcaaagactactttcctgaaccagtgaccgtaagctggaatagtggcgctctgacgtctggggttcatactttccccgccgtgctccaatccagcggattatattcgctgtcttccgtcgtgaccgtgccttcaagtaactttggcacacagacttacacatgcaatgtcgatcacaagccaagcaacacaaaggttgacaaaaccgtggagaggaagtgttgcgtagagtgtcccccttgcccagcgccgcccgtggcaggtccttccgtcttcctttttccacccaaacctaaggatacgttgatgatctctcggactccagaagtgacatgtgttgtggtcgacgtgagccatgaggatcccgaagtacagttcaattggtacgttgacggggtggaggtccacaacgccaaaaccaagccgcgcgaggaacagtttaattcaactttcagagtggtcagtgtgctgacagttgtgcatcaagattggctaaacggaaaggagtataaatgcaaggtatccaataaaggcctccctgctcccattgaaaagaccatcagcaaaacgaagggccagccaagggagcctcaggtctacaccctgcccccatctcgggaagagatgaccaaaaaccaggtgtcacttacttgtctggttaaggggttttatcccagtgacattgccgtggagtgggaaagcaatggacaacctgagaacaattacaagaccacaccaccgatgttggattccgacggttctttcttcctctattcgaaactgactgtcgacaagagccgctggcagcagggcaacgtgttttcctgctcagtaatgcacgaagcattacacaaccattacacccagaaaagtctgtctctcagccccgggaag

SEQ ID NO: 23725 - RNA, 651 nt, synthetic construct
  misc_feature 1..651: note = derived and/or modified sequence opt3 from Seribantumab_LightChain1
  source 1..651: mol_type = other RNA
cagagcgccctgacccaacccgcttccgtgtctggctcacctgggcagagtatcacaattagctgcactggaacgtcctctgacgtcggttcgtacaacgttgtgtcatggtatcagcagcacccaggcaaggcaccgaaactcataatctacgaggtaagccaaagacccagtggggtgtccaataggttctctggaagcaagtccggcaacaccgcctcacttacaattagtggtctgcagactgaagatgaggcggactattactgttgcagctatgctgggtcttccatctttgtcattttcggaggcggcaccaaagtgacagttttggggcagcctaaggccgcaccatcagtgaccttatttccccctagcagtgaagaactgcaggccaataaagctactctagtctgtctcgtgtctgatttctacccaggagcagtaacagttgcctggaaggctgacggttcccccgtgaaggtcggcgtggaaaccacgaaacctagcaagcaatcgaacaataaatatgccgcgtcttcctacctgtcacttactccagagcagtggaagagtcatcggagctactcctgccgcgtgacccacgaggggtctacagtcgagaaaactgttgcaccggccgagtgtagc

SEQ ID NO: 23726 - RNA, 1353 nt, synthetic construct
  misc_feature 1..1353: note = derived and/or modified sequence opt3 from Setoxaximab_HeavyChain1
  source 1..1353: mol_type = other RNA
gaggtgcagctgcaacagcccggccctgaactcgagaagccaggggccagcgtcaaactttcctgcaaggcttctggatactcattcaccgactataacatgaattgggttaaacagaacaatggtgaaagtctggagtggatcggcaagattgatccgtactatgggggacccagctacaaccagaaatttaaggacaaggcaacattgactgtggataaatcctcttcgacggcctatatgcaattaaagtcactgaccagcgaagacagtgcggtatactattgtacaagaggcggtaatagggattggtacttcgacgtgtggggagctgggactaccctaacagtctccgccgagtttgcatctaccaaaggccctagcgtgttcccactcgccccctcctcaaagagtactagcggcgggacagctgcactgggatgccttgttaaagattactttcctgagccagtgaccgtctcttggaactccggtgccctgacgtcaggcgtgcacactttccccgctgtattgcagagcagtgggctctattctctgtccagcgttgtgaccgtcccttcgtcttccctgggaacacagacttacatatgtaatgtgaaccataagccatcaaataccaaggtggacaaaaaggtcgaaccgaaaagttgcgataagacacacacctgtcccccttgcccagcccccgagctcttaggcggtcctagcgtttttctgttcccacccaaaccgaaggacacgcttatgatctcccggactcctgaagtgacatgtgtagtggtcgatgtgtctcatgaggaccccgaggttaaatttaactggtatgtggatggggtcgaagtgcacaatgcgaagaccaagccacgcgaggaacagtacaacagcacttatcgagtagtttcagtgttgacagtcctgcatcaagactggctaaatggaaaagagtacaagtgcaaagtgagtaacaaggcactccctgcccccattgagaaaaccatctccaaggctaagggccagccacgtgaaccccaggtctatacgctgcctccaagcagagacgagcttaccaaaaatcaggtgtctctgacatgtttggttaagggcttctacccgtcagatattgccgtggaatgggagagtaacgggcaacccgaaaacaattacaaaactacccctccagtactcgacagcgatggatcctttttcctgtattctaagttaacagtcgacaaatcgaggtggcagcagggtaacgtgtttagctgctccgttatgcacgaggcactgcacaatcattacactcaaaagtcactcagtctttctcccggcaag

SEQ ID NO: 23727 - RNA, 660 nt, synthetic construct
  misc_feature 1..660: note = derived and/or modified sequence opt3 from Setoxaximab_LightChain1
  source 1..660: mol_type = other RNA
gacatcgtgctgagccagtccccctcttcactcgtcgttagtgtgggcgagaaggtaaccatgagctgcaaatcctctcaatcgcttctgtactcaagaaaccagaagaattatttggcctggtaccagcagaaacctgggcaaagcccaaaggtgttaatttattgggctagtacaagggaatccggagtcccggatcggctgactggttctggcagcgggacggacttcaccctaacaatatcctcagtgaaagcagaggatctcgccgtttactattgtcagcagtactatagttaccccctgacttttggagcgggcaccaaacttgaactgaagcgcacagtggctgcccctagcgtcttcatctttccaccctctgacgagcagttgaagtccggtaccgcatcagtggtatgcctcctgaacaatttctaccctcgagaagccaaggttcaatggaaagtggataacgctctgcagagcgggaatagtcaggagtctgtcactgagcaggactccaaggatagcacatattcgctctcttccaccttaacgctgtcaaaagcagactacgaaaagcacaaggtgtatgcctgtgaggtgactcatcaaggacttagtagcccagtcaccaaatcctttaaccgtggcgaatgc

SEQ ID NO: 23728 - RNA, 1338 nt, synthetic construct
  misc_feature 1..1338: note = derived and/or modified sequence opt3 from Sifalimumab_HeavyChain1
  source 1..1338: mol_type = other RNA
caggtgcaactggtccagagcggcgccgaggttaagaaacccggggcttccgtgaaggtatcttgcaaagcatcaggatacaccttcacaagttatagcatctcctgggtgagacaggcccctggtcagggcctcgaatggatggggtggatttctgtctacaacggaaatactaactatgcgcaaaagtttcagggcagggtgacgatgaccacagacacttcgacctcaacagcttaccttgagctgcggagcttgcgcagtgatgacaccgccgtttattactgtgcacgagatccaatagccgctggttattgggggcagggaactttagtgacagtctcctctgcaagcaccaaaggcccgtccgtgttccccctggccccttcaagtaagagcacgtctggcgggactgctgccctaggatgcctcgtaaaggactactttccagaacccgttaccgtgtcctggaactcaggtgcgctgacaagcggcgtccacactttccctgcagtgcttcagagttctgggctgtactccttgagctcggtggtcaccgttccatcttcctcactcggaacacaaacctatatctgtaatgtgaatcataaacccagtaacacgaaggtagataaaaaggtggagcctaaaagctgcgacaagactcacacatgtccaccgtgccccgcccctgaactgctgggcggtccatccgtctttctctttccccctaagccaaaagataccttaatgatttctcgtactcccgaggtgacatgtgttgtggtcgacgtgagccatgaggatccggaagtaaagtttaattggtacgttgacggggtggaggtccacaacgctaaaaccaagcctagagaggaacagtataattcaacgtacagggtggtcagtgtgctgaccgttcttcatcaggattggttgaacggaaaagagtataagtgcaaagtgtccaataaggccctgcccgcaccaatcgaaaagacaattagcaaagctaagggccagcctcgggagccccaagtatacactctaccaccctctcgcgaagagatgaccaaaaaccaggtctcactcacatgtctggtgaagggcttctatcctagtgacatcgccgttgaatgggagagcaatgggcagccagagaacaattacaaaactaccccgcccgtgcttgattccgacggatctttcttcctgtactcgaagttgacagtcgacaagagcagatggcaacagggtaacgtgttttcctgctcagtaatgcacgaagcgctccacaaccattatacccagaaaagtctgtctttaagccctggcaag

SEQ ID NO: 23729 - RNA, 645 nt, synthetic construct
  misc_feature 1..645: note = derived and/or modified sequence opt3 from Sifalimumab_LightChain1
  source 1..645: mol_type = other RNA
gagatcgtgctgacccagagccccggcacactctccctttctcctggggaaagagccactctgtcatgcagggctagtcaaagcgtctcctctacgtacttggcatggtatcagcagaagccaggacaggccccgcggttactgatttacggtgcgtcgtcacgcgctaccggcatacccgaccgattcagcgggagtggatccggcacagattttactctaaccatctctcgtctcgagcctgaagacttcgccgtttattactgtcaacagtatggtagctccccaagaacatttgggcagggaaccaaagtggagattaagaggactgtagcagccccctcagtgttcatctttcctccaagtgatgaacagctgaaaagcggcacagcttctgtcgtgtgccttctgaacaatttctacccccgggaggcaaaggttcaatggaaagtggacaacgccttgcagtccggcaattcacaggagagcgtcaccgaacaggatagtaaggactctacgtattccctcagctcgactctgaccctgtctaaggctgattacgagaaacacaaggtgtacgcctgtgaagtaacacatcaagggctctcctcacctgttactaaaagttttaaccgcggagagtgc

SEQ ID NO: 23730 - RNA, 1347 nt, synthetic construct
  misc_feature 1..1347: note = derived and/or modified sequence opt3 from Siltuximab_HeavyChain1
  source 1..1347: mol_type = other RNA
gaggtgcagctggtcgaaagcggcgggaagctccttaaacccggaggttccctgaagttgtcttgcgccgcttcaggcttcacctttagtagcttcgcaatgtcctggtttagacaatctcctgagaaaaggttagaatgggttgccgagatctcgtcagggggaagctacacatattacccagacactgtgacgggccggttcaccattagtcgcgataacgcgaagaatacactgtatctagaaatgtcctctctccgaagcgaggacactgctatgtactattgtgcccgtggtctgtgggggtactatgcacttgattactggggacagggcacctccgtaacagtgtcaagtgccagcaccaaaggcccgtctgtctttcccctggctccttcctcaaagagcacaagtgggggaactgcagccttgggttgcctcgtgaaggactacttcccagagcccgttaccgtgtcttggaactccggcgctctgacgagcggggtccacacttttcctgccgtgctgcagtcgtctggactctattccttatcaagtgtagttaccgtgccaagctcctctctgggcacacagacttacatatgtaatgtcaaccataaacccagcaataccaaggtggataaaaaggtggaacctaaatcatgcgacaagacacacacctgtccaccgtgccccgcgcctgagcttttgggtgggccaagtgtcttcctgtttccccctaagccaaaagatacgctaatgatctccagaactcccgaagttacatgtgtggtagtggacgtcagccatgaggatccggaggtgaagttcaactggtatgttgacggagtggaagtccacaatgcaaaaaccaagcctagggaggaacaatacaactctacttatcgggtggtatcagttctcacagtgctgcatcaggattggcttaatggcaaagagtacaagtgcaaagtcagtaacaaggccctgcccgctccaattgaaaagaccatcagcaaagccaagggccagcctcgcgagccccaggtgtatacgttgccaccctccagagacgagctcaccaaaaatcaagtctctctgacatgtttagtgaaggggttttacccttcggatattgcagttgaatgggagagcaacggacagccagaaaataactacaaaactaccccgcccgtgctggactccgacggttcattctttctctatagtaaacttacagtagataagtctaggtggcagcagggcaatgtcttcagctgctccgtgatgcacgaggctctgcacaaccattacactcaaaagtcattgagcctatctcctgggaag

SEQ ID NO: 23731 - RNA, 639 nt, synthetic construct
  misc_feature 1..639: note = derived and/or modified sequence opt3 from Siltuximab_LightChain1
  source 1..639: mol_type = other RNA
cagatcgtgctgattcaaagccccgccataatgtccgcttctcctggcgagaaggtcaccatgacatgctcagcaagtagctccgtttcttacatgtattggtaccagcagaaaccagggtcgtcaccgagactccttatctatgacactagcaacctggccagtggagtgcccgtaaggttctccggttctggcagcgggacgtcctactcattgaccattagtcggatggaagcggaggatgctgccacatattactgtcagcaatggagcggatatccttacacttttggcggtgggaccaagttagaaatcaaacgcacagtggcagccccatctgtcttcatttttcccccttccgacgagcagctgaagtcaggaaccgctagcgtggtttgcctactcaataacttctacccacgagaagcaaaagtgcagtggaaggtcgataatgccctgcagagtggcaactctcaagagtccgtgactgagcaggacagcaaggattcgacatattctctttcctcaaccctgacgttgagtaaagctgactacgaaaagcacaaagtatatgcctgtgaggttactcatcagggcctcagctcccccgtgaccaagtcttttaatcgtggggaatgc

SEQ ID NO: 23732 - RNA, 1329 nt, synthetic construct
  misc_feature 1..1329: note = derived and/or modified sequence opt3 from Simtuzumab_HeavyChain1
  source 1..1329: mol_type = other RNA
caggtgcaactggtccagagcggcgccgaggttaagaaacccggggcttccgtgaaggtatcttgcaaagcatcaggatacgccttcacctattacctcatcgaatgggtgagacaggcgcctggtcagggccttgagtggattggggtcataaacccaggaagtggcggtacaaattataacgaaaagtttaaagggagggctactatcacggccgacaagagcacctccacagcatacatggagctgtcttcgttgcggtcagaagatactgccgtgtatttctgtgctcgcaattggatgaactttgactactggggacaaggcaccacagttaccgtgagcagtgcatccactaagggcccgtctgtcttccccttagccccttgcagccgatccacatcagagagtaccgctgccctggggtgtctagtgaaagattattttccagagcccgtaacggttagctggaactctggagcgctcacttccggtgtgcacaccttccctgcagtcctgcagtcaagcggcctttacagtctgtcttccgtggtgacagtcccaagctcgtctttggggactaagacctacacatgcaatgttgaccataaaccctccaataccaaggtggataaacgtgtagaatcaaagtatggacctccatgtccgccctgccctgccccagagtttctcggcggtcccagtgtgttcctgtttcctccaaagcccaaagacacgctgatgattagcagaactccggaagtcacatgtgtggttgtggatgtctcccaggaggaccctgaggtgcagttcaactggtacgtagatggggttgaagtgcacaatgctaagaccaaacccagggaggaacaatttaactctacttatcgggtcgtgagcgtcctcacagtgttacatcaggactggctgaatggaaaggagtacaaatgcaaggtttcaaacaaaggccttccaagttccatcgaaaagaccattagcaaggccaaaggccagcctcgcgagccccaggtgtatacgttgccaccctctcaagaggaaatgaccaagaatcaggtatcactgacatgtctagtcaaagggttctaccctagtgatatcgcagtggagtgggaaagcaacggacagccagagaataactataagactaccccgcccgttctcgactccgatggtagctttttcctgtactcgagacttacagtggacaaatctaggtggcaagaaggcaacgtcttctcctgctcagtgatgcacgaggctctgcataatcactacactcagaagagtttgtctctcagcctggggaag

SEQ ID NO: 23733 - RNA, 657 nt, synthetic construct
  misc_feature 1..657: note = derived and/or modified sequence opt3 from Simtuzumab_LightChain1
  source 1..657: mol_type = other RNA
gacatcgtgatgacccagacacccctgagcctctccgtcactcctggccaaccagcctctatttcatgcagaagtagcaagtcccttctgcactctaacgggaatacgtacttgtattggttcttacagaaaccgggacagtcgccccagtttctgatatacaggatgtcaaacctagctagcggtgttcctgatcggttcagtggctccgggtctggaaccgactttacactcaagatcagccgcgtggaggcagaagatgtaggcgtgtattactgtatgcaacatctggagtatccatacactttcggtgggggaaccaaagtcgaaattaagcgaacagtggccgcgccctccgtttttatcttccctccatcagacgagcagcttaaaagtggcaccgctagcgtggtctgcctgttgaataacttttatccccgtgaagccaaggtgcagtggaaggtagataatgcactccagtctggcaactcccaagagtcagttactgagcaggacagcaaagatagtacatactctctgtccagcaccctgacgctctcgaaggccgactacgaaaaacacaaggtgtatgcttgtgaggtcactcatcaggggttatcttcccctgtgaccaaatcattcaatagaggagaatgc

SEQ ID NO: 23734 - RNA, 1347 nt, synthetic construct
  misc_feature 1..1347: note = derived and/or modified sequence opt3 from Sirukumab_HeavyChain1
  source 1..1347: mol_type = other RNA
gaggtgcagctggtcgaaagcggcgggggactcgttcaacccggtggctcccttagactgtcttgcgccgcttcagggttcacctttagtcctttcgcaatgagctgggtgaggcaggccccaggaaagggcttggagtgggtagcgaaaatctccccgggtgggtcttggacatactattcggacactgtgacgggacggtttaccatttcacgcgataacgctaagaatagcttatacctgcagatgaacagtctacgagccgaagacacagcagtctattactgtgcccgtcagctctggggctattacgctctggatatatggggccaagggactaccgtgacagtttcctctgcaagcaccaaaggaccctccgtgttccctcttgccccatcaagtaagagcacttctggtggcacagctgccctggggtgcttggtcaaagactattttcccgagcctgtgaccgtatcctggaactcaggagcgctcacgagcggcgttcacactttcccagcagtgctgcagagttctggtctgtactccctcagctcggtcgtgaccgtgccctcttcctcattagggacacagacttacatctgtaatgtcaatcataagcctagtaacaccaaggttgataaaaaggtggaaccaaaaagctgcgacaagacacacacctgtccgccctgccctgccccagagctgcttggaggcccctccgtatttttgttccctccaaaacccaaggatacgctgatgatttctagaactccggaggtgacatgtgtcgtggttgacgtgagccatgaagatcctgaggtcaagtttaattggtatgtggacggcgtagaagttcacaacgctaaaaccaagcccagggaggagcagtacaattcaacttatcgggtggtcagtgtgctaacagtcctccatcaagattggctgaacgggaaagaatacaagtgcaaagtgtccaataaggcccttccagcacctatcgagaaaaccattagcaaggctaagggacagccccgcgaaccacaggtttatacgctgcccccttctagagacgagttgaccaaaaaccaggtgtcactcacatgtctggtaaagggtttctacccaagtgatatcgccgtcgaatgggagagcaatggccaaccggagaacaattataaaactacaccccctgtgttagactccgacgggagctttttcctgtactcgaagctcaccgttgataaatctaggtggcagcagggaaacgtgttttcctgctcagtcatgcacgaagcgcttcacaaccattacactcaaaagagtctgtctttgagcccaggcaag

SEQ ID NO: 23735 - RNA, 639 nt, synthetic construct
  misc_feature 1..639: note = derived and/or modified sequence opt3 from Sirukumab_LightChain1
  source 1..639: mol_type = other RNA
gagatcgtgctgacccagagccccgccacactctccctttctcctggcgaaagagctactctgtcatgcagtgcaagcatttccgtctcttacatgtattggtaccaacagaagccagggcaggccccgaggttgttaatatatgacatgtcgaacctggcgtcaggaatccccgctcggttcagcggtagtggctccgggacggattttaccctaacaatttctagcctcgagcctgaagacttcgccgtttactattgtatgcagtggtccggatacccatatacttttggcggtgggaccaaagtggagatcaagcgcacagtagcagccccctcagtgttcatttttcctccaagtgatgaacaactgaaaagcggaaccgcttctgtcgtgtgccttctgaataacttctacccccgagaggcaaaggttcagtggaaagtggacaatgccttgcagtccggcaactcacaggagagcgtcactgaacaagatagtaaggactctacatactccctcagctcgaccctgacgctgtctaaggctgattatgagaaacacaaggtgtacgcctgtgaagtaactcatcagggcctctcctcacctgttaccaaaagttttaatcgtggggagtgc

SEQ ID NO: 23736 - RNA, 1338 nt, synthetic construct
  misc_feature 1..1338: note = derived and/or modified sequence opt3 from Sofituzumab_vedotin_HeavyChain1
  source 1..1338: mol_type = other RNA
gaggtgcagctggtcgaaagcggcgggggactcgttcaacccggtggctcccttagactgtcttgcgccgcttcagggtacagtatcaccaacgactatgcatggaattgggtgaggcaggcccctggaaagggcttggagtgggtaggttacattagctattccgggtacacaacttataacccatctttaaaatcgcggttcacgatatcacgcgataccagcaagaatacactgtacctacagatgaacagtctccgagcggaagacactgctgtgtattactgtgcccgttggacctccggactggattactggggccagggcacacttgtcaccgtgtctagcgcatccactaaagggccgtcagtttttcccctggcccctagtagcaagtctacatccggaggtaccgctgcattgggctgcctcgtgaaagactatttcccagagcccgtcacggtgtcatggaatagcggggccctgacaagtggagtacacacctttcctgctgttctgcaatcttccggcctctacagcttatcgtctgtggtcacagtgccatcctcaagtctgggtactcagacctatatctgtaacgtgaatcataagcccagcaacacaaaggtcgataaaaaggttgaacctaaatcctgcgacaagacccacacgtgtccaccgtgccccgcccctgagcttttgggagggccatctgtgttcctgtttccccctaaaccaaaggatactctaatgattagcagaacacccgaggtaacctgtgtggtcgtggacgtttcacatgaagatccggaggtgaagttcaattggtacgtcgacggcgtggaagtacacaacgcgaaaactaagcctagggaggagcagtataatagtacataccgggttgtgtccgtcctcaccgtgctgcatcaggattggcttaacggcaaagaatataagtgcaaagtcagcaataaggcactgcccgccccaatcgagaaaacgatttctaaggctaaggggcaacctcgcgaaccccaggtgtacaccttgccaccctcaagagaggaaatgactaaaaaccaggttagtctcacttgtctggtgaagggattttaccctagcgacatcgccgtagagtgggagtccaatggtcagccagaaaacaactataaaaccacaccgcccgtcttagattctgacggctcgttctttctgtacagcaagctcactgtggacaaatccaggtggcaacaggggaatgttttctcatgcagtgtgatgcacgaggcacttcacaaccattatacccagaagtctctgagcttgtcccctggaaag

SEQ ID NO: 23737 - RNA, 642 nt, synthetic construct
  misc_feature 1..642: note = derived and/or modified sequence opt3 from Sofituzumab_vedotin_LightChain1
  source 1..642: mol_type = other RNA
gacatccagatgacccaaagcccctcctctctgtcagccagtgtgggcgatagagtcacaattacttgcaaggctagcgacctcatacacaactggcttgcatggtaccagcagaaacctgggaaggccccaaaactgttgatctatggagcgacgtccttagagaccggtgttccgtctaggttctcgggctcagggagcggaacagattttactctgaccattagttccctacagcccgaagacttcgctacatactattgtcaacagtactggaccactccttttacattcggccagggtaccaaggtggagatcaaacggacggtagccgcaccatctgtgtttatttttccccctagcgatgaacagctcaagtccgggactgcctcagtcgtgtgcctgcttaataacttctatccacgcgaggctaaggttcaatggaaagtggacaatgcactgcagagtggaaacagccaggaatctgtcaccgagcaggattccaaggactcaacatacagcttgagttctactctcaccctgtccaaagccgattatgagaagcataaagtgtacgcttgtgaagtaacacaccaaggcctgagctcgcccgttaccaagtctttcaatcgaggcgagtgc

SEQ ID NO: 23738 - RNA, 1323 nt, synthetic construct
  misc_feature 1..1323: note = derived and/or modified sequence opt3 from Solanezumab_HeavyChain1
  source 1..1323: mol_type = other RNA
gaggtgcagctggtcgaaagcggcgggggactcgttcaacccggtggctcccttagactgtcttgcgctgcttcagggttcacctttagtaggtacagcatgtcctgggtgcggcaggcacctggaaagggcttggagttagtagcccagatcaactctgtgggtaattcgacatattacccagacactgtcaaagggcgcttcacgatttcacgagataacgcgaagaataccctgtatctacagatgaacagcctccgtgctgaagacacagccgtgtactattgtgcaagtggagattactggggccaaggcactctggttaccgtgtcctctgccagcacaaaagggccgtccgtctttccccttgctccttcaagtaagagcacctctggaggtactgcagccctgggctgcttggtgaaagactatttcccagagcccgtaacagtttcctggaatagcggggctctcaccagcggagtgcacacgtttcctgccgtcctgcagagttctggcctgtactccctcagctcggtggtgactgtcccatcttcctcattaggtacccagacatacatatgtaacgttaatcataagcccagtaacactaaggtggataaaaaggtagaacctaaaagctgcgacaagacccacacatgtccaccgtgccccgcgcctgagctgcttgggggaccatccgtgttcttgtttccccctaaaccaaaggataccctgatgatctctagaacgcccgaggtcacttgtgtggttgtggacgtcagccatgaagatccggaggtgaagttcaattggtatgtagacggcgttgaagtgcacaacgcaaaaacaaagcctagggaggagcagtacaattcaacctatcgggtcgtgagtgtcctaactgtgctccatcaagattggctgaacggcaaagaatacaagtgcaaagtttccaataaggcccttcccgctccaattgagaaaacaatcagcaaggccaaggggcagcctcgcgaaccccaggtgtataccctgccaccctctagagacgagttgacgaaaaaccaggtatcactcacctgtctggtcaagggattttaccctagtgatattgcagtggaatgggagagcaatggtcaaccagagaacaactataaaacaactccgcccgttttagactccgacggctctttctttctgtactcgaagctcaccgtggataaatcaaggtggcagcaggggaatgtcttctcctgctcagtgatgcacgaagcccttcacaaccattacacacaaaagagtctgtctttgagccctgga

SEQ ID NO: 23739 - RNA, 1326 nt, synthetic construct
  misc_feature 1..1326: note = derived and/or modified sequence opt3 from Solanezumab_HeavyChain
  source 1..1326: mol_type = other RNA
gaggtgcagctggtcgaaagcggcgggggactcgttcaacccggtggctcccttagactgtcttgcgctgcttcagggttcacctttagtaggtacagcatgtcctgggtgcggcaggcacctggaaagggcttggagttagtagcccagatcaactctgtgggtaattcgacatattacccagacactgtcaaagggcgcttcacgatttcacgagataacgcgaagaataccctgtatctacagatgaacagcctccgtgctgaagacacagccgtgtactattgtgcaagtggagattactggggccaaggcactctggttaccgtgtcctctgccagcacaaaagggccgtccgtctttccccttgctccttcaagtaagagcacctctggaggtactgcagccctgggctgcttggtgaaagactatttcccagagcccgtaacagtttcctggaatagcggggctctcaccagcggagtgcacacgtttcctgccgtcctgcagagttctggcctgtactccctcagctcggtggtgactgtcccatcttcctcattaggtacccagacatacatatgtaacgttaatcataagcccagtaacactaaggtggataaaaaggtagaacctaaaagctgcgacaagacccacacatgtccaccgtgccccgcgcctgagctgcttgggggaccatccgtgttcttgtttccccctaaaccaaaggataccctgatgatctctagaacgcccgaggtcacttgtgtggttgtggacgtcagccatgaagatccggaggtgaagttcaattggtatgtagacggcgttgaagtgcacaacgcaaaaacaaagcctagggaggagcagtacaattcaacctatcgggtcgtgagtgtcctaactgtgctccatcaagattggctgaacggcaaagaatacaagtgcaaagtttccaataaggcccttcccgctccaattgagaaaacaatcagcaaggccaaggggcagcctcgcgaaccccaggtgtataccctgccaccctctagagacgagttgacgaaaaaccaggtatcactcacctgtctggtcaagggattttaccctagtgatattgcagtggaatgggagagcaatggtcaaccagagaacaactataaaacaactccgcccgttttagactccgacggctctttctttctgtactcgaagctcaccgtggataaatcaaggtggcagcaggggaatgtcttctcctgctcagtgatgcacgaagcccttcacaaccattacacacaaaagagtctgtctttgagccctggaaag

SEQ ID NO: 23740 - RNA, 657 nt, synthetic construct
  misc_feature 1..657: note = derived and/or modified sequence opt3 from Solanezumab_LightChain1
  source 1..657: mol_type = other RNA
gacgtggtcatgacccagagccccctgtccctccctgttacacttggccaaccagcctctatctcatgcaggagtagccagtccctgatttactctgatgggaacgcttatttgcactggttcttacagaaaccgggacagtcgcccaggctgctaatatacaaagtgtcaaatcggtttagcggtgtacctgaccgcttcagtggctccgggtctggaactgattttacgctcaagatcagccgagtggaggcagaagacgtcggcgtgtattactgttcccaatcaacccatgttccatggacattcggtcaggggactaaagtggagattaagcgtaccgtcgccgcgcccagtgtgtttatcttccctccaagcgatgaacagctgaaatctggaacagcttccgtagtttgccttctgaacaatttttatcccagagaggccaaggtgcagtggaaggtcgacaacgcattgcaatcaggcaatagccaggaaagtgtgaccgagcaggattctaaagactccacttacagcctctcgtctacactgaccctgtccaaggccgattatgagaaacacaaggtgtacgcttgtgaagtcacgcatcagggcctctcaagtcctgttactaagagcttcaacagaggggagtgc

SEQ ID NO: 23741 - RNA, 1506 nt, synthetic construct
  misc_feature 1..1506: note = derived and/or modified sequence opt3 from Solitomab_HeavyChain1
  source 1..1506: mol_type = other RNA
gagctggtgatgacccagagcccctcctctctcacagtcactgccggcgaaaaggttacgatgtcatgcaaaagtagccaatcccttctgaactctgggaatcagaagaactacttgacctggtatcagcagaaacctggacaaccaccgaagttactgatctactgggcttcgacaagagagtcaggtgtgcccgacaggttcactggcagcgggagtggaaccgattttacactaaccatttcctctgtacaggcagaagacctcgccgtgtattactgtcagaatgattatagctaccctctgactttcggcgcgggtacaaaacttgagataaaagggggaggcggctccgggggaggtggctcagggggaggcggtagtgaagtccagctgttggagcaaagcggggctgagctcgtgcggccaggaacctctgttaagatctcctgcaaggcctcaggctatgcatttacgaactactggctgggctgggtgaagcagcgccccgggcacggactggaatggattggtgacatcttccctggcagcgggaatattcattacaacgagaaatttaagggaaaagccactctcaccgctgataagagttcttccacagcatatatgcagttaagctcgctgactttcgaagactctgccgtctacttttgtgctcgacttcgtaattgggatgagccaatggactattggggccagggtaccacagtgaccgtatcctcagggggcggaggcagtgatgttcaattggtgcagagcggggccgaggtcaagaaacccggagcgtccgtgaaggtgtcttgcaaagcaagcggttacacgttcactagatatacaatgcactgggtcaggcaggcccctggccaagggctggaatggatcggatacataaacccatcacggggctataccaattacgctgacagtgttaagggtcgctttactatcacaaccgataaatccacgagcaccgcctacatggagctatcttcactcagaagtgaagacacagcaacttattactgtgctaggtattacgatgaccattattgcctggactactgggggcagggcaccacagtgactgtaagctccggagagggcacctctacagggtcgggaggtagcggcgggtccggaggcgccgatgacattgtgcttacccagtcaccggcgactctgagtttgtctcccggtgaacgggccacgctcagctgtcgcgcatcccagtcagtcagctatatgaactggtaccaacagaagcctgggaaagctccaaagcgatggatctacgatacatctaaggtggcctccggcgttcccgctagattcagtggaagcggctctgggaccgactattccctgactattaattcattagaggccgaggatgcagccacctactattgccagcagtggagtagcaaccctctgacatttggaggcggtaccaaagtggaaatcaagcaccatcaccaccatcac

SEQ ID NO: 23742 - RNA, 1506 nt, synthetic construct; identical to SEQ ID NO: 23741
  misc_feature 1..1506: note = derived and/or modified sequence opt3 from Solitomab_SingleChain
  source 1..1506: mol_type = other RNA

SEQ ID NO: 23743 - RNA, 702 nt, synthetic construct
  misc_feature 1..702: note = derived and/or modified sequence opt3 from Sonepcizumab_LightChain_Precursor
  source 1..702: mol_type = other RNA
atgagcgtgcccacccaggtcctgggcctccttctgttgtggttaacagacgccagatgcgagactacggttacccaatccccttctttcctgtcagctagtgtgggggatagggtaacaatcacttgtattaccacaaccgacatagatgacgatatgaactggtttcagcaggaaccaggaaaggcaccgaaactactcatcagcgagggtaatattctgcggcccggcgtgccttcccgcttctcttcgtcagggtacggaactgactttacacttaccatcagcaagctgcagccagaagatttcgccacgtattactgcttgcaaagtgacaacctcccctttactttcggccagggtaccaaactggagattaagcgaacagtcgcggctccttccgtgtttatcttcccaccctctgatgaacagctgaaaagcgggactgcctccgttgtgtgtctcttaaataacttttatcctcgtgaggcaaaggtccagtggaaggtggacaatgccctgcaatcaggaaacagtcaggagagcgtaaccgaacaggattctaaagactccacatactcacttagcagtaccttgacgctgtctaaggctgattatgagaaacacaaggtttacgcatgcgaagtgactcatcagggcctatccagcccagtcacaaaatcgttcaatagaggcgagtgt

SEQ ID NO: 23744 - RNA, 1365 nt, synthetic construct
  misc_feature 1..1365: note = derived and/or modified sequence opt3 from Sonepcizumab_gamma1-Chain_Precursor
  source 1..1365: mol_type = other RNA
atggagtggagctgggtgttcctgtttttcctctccgtcaccacaggcgttcactctgaagtgcagcttgtacaatcaggggccgaggtgaagaaacccggagaaagtctgaagatcagctgccagtcctttggttacattttcatagaccatactatccactggatgagacagatgcctggccaggggttggagtggatgggagctatttctccaaggcatgatatcacgaaatataacgaaatgtttcggggccaagtcaccatttcggcagacaagtcaagcagtacagcctacttacagtggtcctctctgaaagcgagcgatactgctatgtatttctgtgcccgcggtgggttttacggatccaccatctggttcgacttttggggccagggcacaatggtgaccgtttcaagtgcaagcactaaggggccgtctgtgttccccctagccccttcctcaaagagcacaagtggaggtaccgctgcactcggctgcctggtcaaagattattttccagagcccgtgacggtatcttggaactccggggcccttactagcggagttcacaccttccctgctgtgctgcagtcgtctggcttgtactccctctcaagtgtcgtgacagtgccaagctcctctctgggtactcaaacctatatatgtaatgtcaatcataagcccagcaacacaaaagttgacaagcgagtggcccctgagctgctcgggggaccatcagtatttttattcccgcccaaacctaaggataccctgatgatcagtcgtacgccagaagtgacttgcgtcgtggttgacgtgtcccacgaggatcccgaagtcaagttcaattggtacgtggacggcgtagaggttcacaacgcgaaaacaaagcctagagaggaacagtacaatagcacctatagggtggtctctgtgcttactgtcttgcatcaggattggctgaacggcaaagagtacaagtgtaaagtgtcaaataaggcactaccagcccccattgagaaaacaatcagtaaggctaaggggcagccgcgggaacctcaagtttataccctcccacccagccgcgaagagatgacgaaaaaccaggtgtccctgacctgccttgtaaagggattttacccttctgacattgccgtcgagtgggaatcgaatggtcagcccgagaacaattataaaacaactccacccgtgctggatagcgacggctccttctttttgtactcaaagctcaccgttgacaaaagtagatggcaacaggggaacgtgttctcttgtagcgtcatgcacgaagcactgcataatcactatacacagaagtccttatcactgagccctggaaag

SEQ ID NO: 23745 - RNA, 1338 nt, synthetic construct
  misc_feature 1..1338: note = derived and/or modified sequence opt3 from Stamulumab_HeavyChain1
  source 1..1338: mol_type = other RNA
gtgcagctggtccaaagcggcgccgaggttaagaaacccggggcttccgtgaaggtatcttgcaaagcatcaggatacaccttcacaagttattacatgcactgggtgagacaggcccctggtcagggcctcgaatggatggggatcattaacccaagcggaggctccacttcttatgcgcagaagtttcaaggtagggtcacgatgacccgggacacatcgacttcaaccgtgtacatggagcttagcagtctgcgctccgaagatacagctgtttattactgtgcccgagacgagaattgggggttcgatccgtggggacagggcaccttggtgactgtctctagcgcatccacaaaaggcccctcagtgtttcctttagccccaagtagcaagtctacctccgggggaacggctgcactgggttgcctagtaaaggactatttccccgaacctgttactgtgtcatggaacagcggcgccctcaccagtggggtccatacatttccagctgtgctgcagtcttccggactttacagcctgtcgtctgtggtcactgttccctcctcaagtttgggcacccagacatacatatgtaatgtgaaccacaaacctagcaataccaaggtagataaaaaggtggagccaaaatcctgcgacaagacgcatacttgtccgccctgccctgccccagagctcctgggtgggccctctgtcttcctgtttcctccaaagcccaaagatacactcatgatcagccgtaccccggaagtgacttgtgttgtggtcgacgtgtcacacgaggatcctgaagtaaagttcaactggtatgttgacggagtggaggtccataatgcgaaaacaaagcccagagaggaacaatacaacagtacctatagggtggtctccgtgttaacggttctgcaccaggattggcttaatggcaaagagtacaagtgcaaagtgagcaacaaggcattgccagcccctattgaaaagaccatctctaaagctaagggccagccccgggagccacaggtatatacactgcccccttcacgcgaagagatgactaaaaatcaagtcagtctaacctgtctcgtgaaggggttttacccaagcgacattgccgttgagtgggaatccaacggacagccggagaataactataaaacaactccccctgtgctggattctgacggttcgttctttctttacagcaagctgaccgtcgacaagtccagatggcagcaaggcaatgtgttctcatgcagtgtaatgcacgaagcattgcataaccactacacacagaaatctctcagcctgtccccagggaag

SEQ ID NO: 23746 - RNA, 633 nt, synthetic construct
  misc_feature 1..633: note = derived and/or modified sequence opt3 from Stamulumab_LightChain1
  source 1..633: mol_type = other RNA
agctacgagctgacccagcccccttccgtgtctgtctcaccaggccaaacagccagtatcacttgcagcgggcacgctctcggagacaagttcgtttcctggtatcagcagaaaccgggtcagtctcccgtgcttgtaatttacgatgacacgcaaagaccttcgggcataccagaaaggttttcagggagcaacagtggaaataccgcaacactgactatctccggcacccaggccatggatgaggcggactattactgtcaggcttgggattctagcttcgtgtttggtgggggaacaaaggtcaccgtgttgggccagcccaaagccgcaccttccgttactttattcccaccctcaagtgaggaactgcaagccaacaaggctaccctagtgtgcctcattagcgacttttatcctggcgcagtcacagtggcctggaaagctgattcttccccagtaaaggccggggttgaaacgactaccccgtcaaagcagagcaataacaaatacgcggcaagttcttatctgtcccttacacccgagcagtggaaaagccatcggtcgtactcttgtcaggtgactcacgagggatccaccgtcgaaaagacagtggcccctaccgagtgctca

SEQ ID NO: 23747 - RNA, 1356 nt, synthetic construct
  misc_feature 1..1356: note = derived and/or modified sequence opt3 from Suptavumab_HeavyChain1
  source 1..1356: mol_type = other RNA
gaggtgcagctggtcgaaagcggcggggacctcgttcaacccggaagatcccttaggctgtcttgcgtggcttcaggtttcacctttgatgactacgctatgcactgggtacggcaggcacctggcaaggggttggagtgggtgagtggagtcagctggtccggctctacagtgggttatgccgattcggttaaagggcgcttcactgtgtcacgagacaacgcgcaaaagagcttatacctgcagatgaatagtctacgtgctgaagatacggccctctattactgtgtcaaagacgcatataagtttaactactattactacggactggatgtgtggggccaaggcaccacagtaactgtttcctctgccagcaccaaagggccatccgtgttcccgcttgctccctcaagtaagagcacatctggaggtaccgcagccctgggctgcttggtcaaggactattttcctgagccagtgactgtgtcctggaactcaggggctctcacaagcggagtccataccttccccgccgttctgcagagttctggcctgtactccctcagctcggtggtaacggtgccttcttcctcattaggtactcagacctatatctgtaatgtcaatcacaaaccaagtaacacaaaggtggataaaaaggttgaacccaaaagctgcgacaagactcatacctgtcctccatgcccggcgcccgagctgcttgggggaccttccgtgtttttgttcccacccaagcctaaagatacactgatgatttctagaaccccagaggtcacgtgtgtggtagttgacgtgagccacgaagatcccgaggtcaagtttaattggtacgtggacggcgtcgaagtgcataacgcaaaaactaagccgagggaggagcagtataattcaacataccgggttgtgagtgtactaaccgtcctccaccaagactggctgaacggcaaagaatataagtgcaaagtgtccaataaggcccttcctgctcccatagagaagactatcagcaaagccaaggggcagccacgcgaacctcaggtttacacactgcccccatctagagatgagttgaccaaaaaccaggtgtcactcacgtgtctggtcaagggattctaccccagtgacattgcagtggaatgggagagcaatggtcaacctgagaacaattataaaaccacaccaccggtattagattccgacggcagctttttcctgtactcgaagctcactgtggataagtctaggtggcagcaggggaacgtcttttcctgctcagttatgcacgaagcccttcataaccactatacccagaaaagtctgtctttgagccccgga

SEQ ID NO: 23748 - RNA, 642 nt, synthetic construct
  misc_feature 1..642: note = derived and/or modified sequence opt3 from Suptavumab_LightChain1
  source 1..642: mol_type = other RNA
gagatcgtgatgacccagagccccgccacactgtccgtctctcctggcgaaagggctactctctcatgcagggcaagtcaaacgattcttagcaacctggcctggtacttgcagaagccagggcaggcgccgcggttactgatatatggagcttccacccgcgccacaggtctacccgcacgattctctggctcggggtcaggaactgagtttaccctcacaatcagcagtctgcagtccgaagacttcgccgtttactattgtcaacagtacaataactggcctcttacctttggcggtgggactaaagtggagattaagcgtacagtagctgcaccatctgtgttcatctttccccctagcgatgaacagctgaaatccggaaccgcctcagtcgtgtgcttgctcaataacttctatccaagagaggctaaggttcagtggaaagtggacaatgccctgcaaagtggcaacagccaggagtctgtcacggaacaggattccaaggactcaacttacagcctgagttctaccctcacattatccaaggcggattatgagaaacacaaggtgtacgcatgtgaagtaactcatcagggcctgagctcgcccgttaccaaatcttttaatagaggggagtgc

SEQ ID NO: 23749 - RNA, 1344 nt, synthetic construct
  misc_feature 1..1344: note = derived and/or modified sequence opt3 from Suvizumab_HeavyChain1
  source 1..1344: mol_type = other RNA
caggtgcaactggtccagagcggcgccgaggttaagaaacccggggcttccgtgaaggtatcttgcaaagcatcaggatacaccttcacaaacagttggatcggttggtttagacaggcccctggccaggggctcgaatggattggagacatatatccaggcggtgggtacactaattataacgagatcttcaagggaaaagcgacgatgaccgctgatacaagcactaataccgcctacatggaactttcctctctgaggtcggaggacacagcagtgtattactgttcacggggcattccgggctatgccatggattactgggggcaaggaaccttggtcactgtgagcagtgcttccacaaagggtccctctgtttttcctttagcaccaagctccaagtcaaccagtggcgggacggccgctctgggatgcctagtgaaagactacttccccgaacctgtcactgtgagctggaactctggcgccctcacctccggtgtacacacatttccagcggttctgcagtcaagcgggctttatagtctgtcttccgtggtcactgtgcccagctcgtctttgggaacccagacatacatctgtaatgtgaaccataagccttccaataccaaagtcgataagaaagttgagccaaagtcatgcgacaagacgcacacttgtccgccctgccctgcaccagagctcctgggcggccccagtgtgttcctgtttcctccaaaacccaaggatacactcatgattagccgcaccccggaagtaacttgtgtggtcgtggacgtttcccatgaggatcctgaagtgaaattcaactggtatgtcgacggggtggaggtacacaatgccaagacaaaaccccgagaggaacagtacaactctacctatcgtgttgtgagcgtcttaacggtgctgcatcaagattggcttaatggaaaggagtacaaatgcaaggtctcaaacaaggctttgccagcccctatcgagaaaaccataagtaaggcaaaaggtcagcccagagaaccacaggtgtatacactgcccccttccagggacgaactaactaagaatcaggttagcctcacctgtctggtgaaaggcttttacccatctgatatcgctgtagagtgggagtcaaacgggcaaccggaaaataactacaagacaactccccctgtccttgacagtgacggcagcttctttctgtattccaagttgaccgtggataaatctcggtggcagcagggaaacgttttctcgtgcagcgtgatgcacgaggccctccacaatcattacacacaaaagtccctgtcattaagtccaggtaaa

SEQ ID NO: 23750 - RNA, 660 nt, synthetic construct
  misc_feature 1..660: note = derived and/or modified sequence opt3 from Suvizumab_LightChain1
  source 1..660: mol_type = other RNA
gacatccagatgacccaaagacccgatagcctgtccgcctctgtgggcgacagggtcacaatgtcatgcaagagtagccagtccctccttaactctggggatcagaaaaattacctgacttggtatcagcaaaagcctggacagccaccgaaattgttaatttactgggcttcgacgggtgagtcaggcgttcccgaccggttcagcgggagtggatccggcaccgattttacattcactatatctagcctgcagcctgaagacatcgcaacctattactgtcagaacgattattcctacccatggacatttggtcaagggaccaaggtggagattaaacgcactgtagccgcgccctcagtgttcatctttcctccaagtgacgaacagctaaagagcggaacagcttctgtcgtgtgcctcctgaataacttctatccccgagaggccaaggttcagtggaaagtggataatgcacttcagtccggcaactcacaagaaagcgtcaccgagcaggacagtaaggattctacgtactccctgagctcgactttgaccctctctaaagccgactacgagaagcacaaagtgtatgcttgtgaagtaacacatcagggcctgtcctcacctgttactaagagttttaatcgtggggagtgc

SEQ ID NO: 23751 - RNA, 1350 nt, synthetic construct
  misc_feature 1..1350: note = derived and/or modified sequence opt3 from Tabalumab_HeavyChain1
  source 1..1350: mol_type = other RNA
caggtgcaactgcagcagtggggcgccgggctccttaagcccagcgagaccctgtccttgacatgcgctgtctacggaggttctttctcaggctattactggagttggatcagacagcctccagggaaaggattagaatggattggcgagataaaccacagcggttccactaattataacccgtctctgaagtcgagggttacgatctcagtggacaccagcaaaaatcaatttagtctaaagctctcctctgtaacagcagccgatactgcggtgtactattgtgctcgggggtactatgacattctgaccggatactactattacttcgattattggggccagggcacacttgtcaccgtgagctccgcctcaactaaagggcccagtgtttttcctctggcaccatgcagccgctctacatccgaatcaaccgccgctttgggatgtctcgtgaaggactacttccccgagcctgtcacggtgagctggaacagtggtgcactgacttctggcgtacatacctttccagccgttctgcagtccagcgggctctattcgttatcttccgtggtcacagtgccctcaagtagcctgggaactaagacctacacatgcaatgtggatcacaaaccttccaacaccaaggtcgacaaacgagttgaatctaagtatggcccaccgtgtcccccttgcccagctcccgagttccttggtgggcctagcgtgtttttgttcccacccaaaccgaaggatacgctgatgatctcacgtactcctgaggtaacatgtgtggtcgtggacgttagtcaggaagatcccgaggtgcaatttaattggtacgtcgacggagtggaagtacataacgccaagaccaaaccaagagaggagcagttcaattccacttacagggttgtgagcgtcctaacagtgctccaccaggattggctgaacggcaaggaatataaatgcaaggtctctaataaaggccttccttcaagtattgagaagaccatcagcaaagcgaaggggcagccccgggaaccacaagtgtacacgctgcccccttcccaggaggaaatgaccaagaaccaggtttctttgacatgtctcgtgaaaggattttatccatcggacatagcagtagagtgggagagcaatggtcaaccggaaaacaattacaagactacaccccctgtcctggattccgacggctcattctttttatatagtcgcctgaccgtggacaaatctagatggcaggaggggaacgttttcagctgctccgtgatgcatgaagccctccacaaccactacactcagaagtcacttagcctgtctttgggaaaa

SEQ ID NO: 23752 - RNA, 642 nt, synthetic construct
  misc_feature 1..642: note = derived and/or modified sequence opt3 from Tabalumab_LightChain1
  source 1..642: mol_type = other RNA
gagatcgtgctgacccagagccccgccacactctccctttctcctggcgaaagagctactctgtcatgcagggcaagtcaaagcgtctcccggtacttggcctggtatcagcagaagccagggcaggcgccgcgcttactgatttacgacgcttctaaccgagccacgggaatacccgcacgtttctcgggttcaggcagcgggaccgatagtacactaactatctcctctctcgagcctgaagactttgccgtttattactgtcaacagagaagcaattggccaaggaccttcggacagggcacaaaagtggagattaagcggaccgtagctgcaccctccgtgtttatcttccctccatcagatgaacagctgaaaagtggtactgccagcgtcgtgtgccttctgaacaatttttatccccgcgaggctaaggttcaatggaaagtggacaacgccttgcagtctggaaattcccaggagtcagtcacagaacaggatagcaaggacagtacctactctctctccaacacgctgactctgagcaaggcggattatgagaaacacaaggtgtacgcatgtgaagtaacccatcaagggctctcgtctcctgttacaaaatccttcaatagaggcgagtgc

SEQ ID NO: 23753 - RNA, 1332 nt, synthetic construct
  misc_feature 1..1332: note = derived and/or modified sequence opt3 from Tacatuzuab_HeavyChain1
  source 1..1332: mol_type = other RNA
caggtgcaactgcagcagagcggcgccgaggtcaagaaacccgggtcctctgttaaggtgtcatgcaaagctagtggatacgcattcaccagctatgtaatccactgggtgagacaggcccctggtcaaggcctctactggattgggtatatacatccatacaacggaggcacaaagtataatgaaaaatttaagggtaaggcgactatcacggctgacgagtccaccaacacagcctacgaactttcttcgctgaggtcagaggatactgcattctatttttgtgcccggagcgggggaggcgacccgttcgcttactggggccaggggagtttggtcaccgtgtcctctgcaagcacaaaaggaccctccgtttttcctttagccccatcaagtaagagcacctctggtggcactgctgccctggggtgcctagtgaaagattacttccccgaacctgtcacagtgtcctggaactcaggagcgctcaccagcggcgtacacacgtttccagcagttctgcagagttctggtctttattccctgagctcggtggtcactgtgccctcttcctcattggggacccagacatacatttgtaatgtgaatcataagcctagtaacactaaagtcgacaagcgcgttgagccaaagagctgcgataaaacccacacatgtccgccctgccctgccccagagctcctgggaggcccctccgtgttcctgtttcctccaaagcccaaagacaccctcatctctcgaacgccggaagtaacttgtgtggtcgtggatgttagccatgaggaccctgaagtgaagttcaattggtatgtcgatggcgtggaggtacacaacgctaaaacaaagccccgtgaggaacaatacaattcaacctatagagttgtgagtgtcttaactgtgctgcaccaggactggcttaacgggaaagagtacaagtgcaaggtctccaataaagccttgccagcacctattgaaaagacaatcagcaaagctaagggacagcccagggagccacaggtgtataccctgcccccttctcgggaagagacgaaaaaccaagtttcactaacctgtctcgtgaagggtttttacccaagtgatatagccgtagagtgggaaagcaatggccagccggagaacaattacaagacaactccccctgtcctggactccgatgggtctttctttctttattcgaaactgaccgtggacaagagccgctggcagcaaggaaacgttttctcctgctcagtgcatgaagcgttgcacaaccattacacacagaaaagtctctctctgagcccaggcaag

SEQ ID NO: 23754 - RNA, 636 nt, synthetic construct
  misc_feature 1..636: note = derived and/or modified sequence opt3 from Tacatuzuab_LightChain1
  source 1..636: mol_type = other RNA
gacatccagctgacccaaagcccctcctctctctcagccagtgtgggcgatagagtcacaattacttgcaaggctagccaggacataaacaaatacatcgggtggtatcagcagaagcctggaaaagcaccaaaacttctgcactacacgtccgccttgttaccgggtattccctctaggttctcgggctcagggagcggacgggattatacctttacaatcagttccctgcaacctgaggacattgcgacttactattgtctacagtacgatgacctctggaccttcggcggtgggacaaagctgcagatcaagcgcaccgttgctgccccatctgtgtttatatttccccctagcgatgaacagcttaagtccggaactgcatcagtagtgtgcctgttgaataacttctatccacgagaggccaaagtccaatggaaggtggacaatgctctccagagtggcaacagccaggaatctgttacagagcaggattccaaagactcaacctacagcctgagttctacgctgactctctccaaggcagattacgaaaaacataaggtgtatgcctgtgaggtcacccaccaaggcttaagctcgcccgtgacaaagtctttcaatcgtggggagtgc

SEQ ID NO: 23755 - RNA, 678 nt, synthetic construct
  misc_feature 1..678: note = derived and/or modified sequence opt3 from Tadocizumab_fab_fragment_HeavyChain
  source 1..678: mol_type = other RNA
caggtgcaactggtccagagcggcgccgaggttaagaaacccgggtcctctgtgaaggtatcatgcaaagctagtggatacgcattcaccaactatctcatcgaatgggtgagacaggcccctggtcagggccttgagtggattggggtcatatacccaggaagcggcggtacaaattataacgaaaagtttaaagggagggtgactctgacggttgacgagtccaccaatacagcgtacatggaattgtcttcgttacggtcagaggatactgctgtgtatttctgtgcccgccgagacggaaactacggctggtttgcatattggggccaagggaccctggtcacagtgagcagtgcctccaccaagggaccgtctgtattccccctagctcctagctccaagtcaacttctggtggcacagcagccctcgggtgcctggttaaagattactttccagagcccgtgaccgtcagctggaatagtggagctcttacgtccggcgtgcacactttccctgccgtgctgcagtcaagcggtttgtacagtctctcttccgtcgttaccgtgccaagctcgtctctggggacacagacttatatctgtaacgtaaatcataagccctccaacaccaaagtggacaagaaagtcgaacctaagtcatgcgataagacacac

SEQ ID NO: 23756 - RNA, 582 nt, synthetic construct
  misc_feature 1..582: note = derived and/or modified sequence opt3 from Tadocizumab_fab_fragment_LightChain
  source 1..582: mol_type = other RNA
gacatccagatgacccaaacacccagcactctgtccgcctctgtgggcgatagagtcacgatttcatgcagggctagtcaggacataaacaattacctcaactggtatcagcagaagcctgggaaagcaccaaaacttctgatctactataccagcacattgcactccggagttccgtctcggttctcgggttcaggcagcgggactgattacaccttaacaattagttccctgcaacccgacgattttgccacctatttctgtcagcagggaaatactctaccttggacatttggccagggtaccaaagtggaggtaaagcgcacggtggcggctccatctgtcttcatctttccccctagcgacgaacaactcaaatccgggactgcctcagtggtttgcctgcttaacaatttctacgagagtgtgaccgaacaggatagcaaggactctacatattccctgtcaagcactttgaccctcagtaaggcagattacgagaaacataaggtctacgcctgtgaagtgacacaccagggactgtcttccccagtaaccaagagctttaaccgaggcgagtgc

SEQ ID NO: 23757 - RNA, 1359 nt, synthetic construct
  misc_feature 1..1359: note = derived and/or modified sequence opt3 from Talizumab_HeavyChain1
  source 1..1359: mol_type = other RNA
caggtgcaactggtccagagcggcgccgaggttaagaaacccggggcttccgtgaaggtatcttgcaaagcatcaggatacaccttcagtatgtattggctcgaatgggtgagacaggcccctggtcacggccttgagtgggtcggggaaatcagcccaggaacatttactacgaactacaatgagaagttcaaagcgagggctacctttacagccgacacttccaccaacacagcatatatggaactgtcttcgttgcggtcagaggataccgccgtgtactattgtgctcgcttcagccattttagtggctccaattacgactatttcgattactggggtcaggggactttagttacagtgtctagcgcatccaccaagggaccgtcagtctttcccctggcccctagtagcaagtctacgtccggcggcactgctgccctagggtgcctcgtgaaagactacttcccagagcccgtaaccgtttcatggaacagcggagcgctgacaagtggtgtgcacacttttcctgcagtccttcaatcttccggcctgtatagcttgtcgtctgtggtgaccgtcccatcctcaagtctcgggacacagacctacatttgtaatgttaaccataagcccagcaatacgaaagtggataagaaagtagaacctaagtcctgcgacaagactcacacatgtccaccgtgccccgcccctgagctgctgggaggcccatctgtgttcctctttccccctaaaccaaaggataccttaatgataagccgaactcccgaagtcacatgtgtggttgtggacgtctcacatgaggatccggaggtgaaattcaactggtatgtagacggtgttgaagtgcacaatgctaagaccaaacctcgtgaggaacagtacaacagtacgtatagagtcgtgtccgtcctgaccgtgcttcaccaggattggttgaatgggaaggagtacaaatgcaaggttagcaacaaggccctgcccgcaccaatcgagaaaacaatttctaaggctaaaggacaacctagggaaccccaggtgtatactctaccaccctcacgggacgagctcaccaagaatcaggtaagtctgacatgtcttgtcaaaggcttttaccctagcgatatcgccgtggaatgggagtccaacggccagccagaaaataactacaagactaccccgcccgttctggactctgacgggtcgttcttcttgtatagcaagctcacagtggataaatcccgctggcaacagggaaacgtcttttcatgcagtgtgatgcatgaggcgctgcacaatcattacacccagaagtctttaagcctgtcccctggtaaa

SEQ ID NO: 23758 - RNA, 642 nt, synthetic construct
  misc_feature 1..642: note = derived and/or modified sequence opt3 from Talizumab_LightChain1
  source 1..642: mol_type = other RNA
gacatcctgctcacccagagccccggcacactttccctgtctcctggggagagggccactttgtcatgcagggctagtcaaagcattggaacgaacatacactggtaccagcagaagccaggtcaggcaccgcggttactgatcaaatatgcctccgaatctatttcgggcatcccctcacgcttcagcgggagtggatccggcaccgattttacactaactatttctcgactcgagcctgaagacttcgcgatgtactattgtcaacagagcgattcctggccaaccacatttggtcaggggaccaaggtggagatcaaacgtactgtcgctgccccctcagttttcatatttcctccaagtgacgaacagcttaagagcggaacagcatctgtggtatgcctgctgaataacttctaccccagagaggccaaagtgcaatggaaggtcgataatgctttgcagtccggcaactcacaggagagcgtgaccgaacaggacagtaaggattctacgtattccctcagctcgactctgaccctgtctaaagcagactacgagaagcataaagtttatgcctgtgaagtgacacaccaaggcctctcctcacctgtcactaagagttttaatagaggggagtgc

SEQ ID NO: 23759 - RNA, 1368 nt, synthetic construct
  misc_feature 1..1368: note = derived and/or modified sequence opt3 from Tamtuvetmab_HeavyChain1
  source 1..1368: mol_type = other RNA
gaggtgaagctgctcgaaagcggcgggggacttgtccagcccggtggctccatgagactgtcttgcgccgggtcaggattcacctttacagacttctacatgaactggatcaggcaacctgctggcaaagcaccagagtggttgggttttattcgggataaggccaaagggtatactacggaatacaatccgagtgttaagggacgcttcaccataagccgagacaacacacagaatatgttatatctgcagatgaacactctacgtgcggaggataccgctacatactattgtgccagagaaggccacaccgcagccccctttgactactggggccaggggactctcgtgacagtatcctctgcttcgaccacggcaccttcagtgttcccactggcccccagctgcggaagtacttccggttctaccgtcgctcttgcctgtctggtgagcggctattttcctgagccagttacagtgtcctggaactcagggagtttgactagcggagtccataccttcccctctgtgctccaatcctcaggcctgtacagcctgagttctatggtaacagttccttcctcaaggtggccatcggagacctttacgtgcaatgtggcgcacccggcatctaaaactaaggtcgataagcccgtgcctaaacgggaaaatggtcgcgtgccaagaccccctgactgtccaaagtgccccgccccggagatgctcgggggaccttccgtcttcatctttcccccaaaacctaaggatacattactgattgctaggacccccgaagttacttgtgtggtagtggaccttgatccagaggaccccgaggtccagatctcatggttcgtggatggcaaacagatgcagacagccaagacccaacctcgggaggaacagtttaacggcacgtaccgcgttgtgagtgtcttgccaattgggcatcaggactggctgaagggaaaacagtttacctgcaaggtgaataacaaagcactaccgagccccatcgaacgaacaatatccaaggctagaggtcaagcccaccagccttctgtatatgttctcccacccagcagggaggaactgagcaaaaatactgtgagtcttacctgtctgatcaaggatttcttccctccagacattgacgtcgagtggcagtccaacggccaacaggagcccgaaagcaaataccggacaactccgcctcagttggatgaggacgggtcttatttcctctactcaaagctgagtgtggataagagccgttggcagcgcggagacacctttatctgcgcggtcatgcatgaagccttacacaatcactatacacaaaaatccctgtctcattcgccaggcaag

SEQ ID NO: 23760 - RNA, 639 nt, synthetic construct
  misc_feature 1..639: note = derived and/or modified sequence opt3 from Tamtuvetmab_LightChain1
  source 1..639: mol_type = other RNA
gacatcaagatgacccagagcccctccttcctgtctgcctcagtgggcgatagagtcacactcaactgcaaagctagtcaaaatattgacaagtaccttaactggtatcagcagaaactgggggagagccctaagttgttaatatacaatactaacaatctgcagacgggaatcccatccaggttttctggttcgggctcagggaccgatttcacactaactattagcagtctccaaccggaagacgttgcaacctatttttgtctgcagcacatctcccggccccgcacattcggaggcggtacccatcttactgtgctggggcagcctaaagcctctccaagcgtaacattgtttcccccttcctcagaggaactcggagcgaacaaggctaccctggtgtgcctgattagtgatttctacccaagcggcgtcacggtggcctggaaggcagacggctctcccatcactcagggggttgagaccacaaaaccttccaagcaatcaaataacaaatatgccgctagcagttacctctctttaactccagataagtggaaatcccacagctcgttttcttgtctggtgacccatgaaggatccacagtcgagaagaaggtggcaccggccgagtgctca

SEQ ID NO: 23761 - RNA, 360 nt, synthetic construct
  misc_feature 1..360: note = derived and/or modified sequence opt3 from Tanezumab_HeavyChain
  source 1..360: mol_type = other RNA
caggtgcaactgcaggagagcggccccgggctcgtcaagccttccgaaaccctttctctgacatgcactgtttcaggattcagtttgatcggttacgacttaaactggattcggcagccaccgggcaaagggctggagtggataggaatcatttggggcgatggtacgaccgactataatagcgccgtgaagtccagggtaacaatctctaaagatacttcgaagaaccagttttcactaaaactcagcagtgtgaccgctgcagacacagccgtctactattgtgcgagagggggatactggtatgctacctcctactatttcgattactggggccaaggcactctggtgacagtttct

SEQ ID NO: 23762 - RNA, 327 nt, synthetic construct
  misc_feature 1..327: note = derived and/or modified sequence opt3 from Tanezumab_LightChain
  source 1..327: mol_type = other RNA
gacatccagatgacccaaagcccctcctctctgtcagccagtgtgggcgatagagtcacaattacttgcagggctagccagtccatatctaacaatctcaactggtaccagcagaagcctgggaaagcaccaaaacttctgatctattacacgtcgcggttccactcaggagttccgagccgctttagtggttccggctctgggaccgacttcacatttactattagctccttgcaacccgaggatatcgccacctattactgtcagcaggaacatacattaccttataccttcggacagggcactaagctggagattaagcgaaca

SEQ ID NO: 23763 - RNA, 1323 nt, synthetic construct
  misc_feature 1..1323: note = derived and/or modified sequence opt3 from Tarextumab_HeavyChain1
  source 1..1323: mol_type = other RNA
gaggtgcagctggtcgaaagcggcgggggactcgttcaacccggtggctcccttagactgtcttgcgccgcttcagggttcacctttagtagctccggaatgtcttgggtgaggcaggcacctggcaagggtttggagtgggtatcggtgatcgcctcaagcgggagtaacacatactatgcggactccgtcaaaggacggttcactatttctcgcgataatagcaagaacacgttatacctgcagatgaatagtctacgagctgaagacaccgccgtgtattactgtgcacgttcaatattttatacaacttggggccagggcaccctcgttacagtgagtagcgcctctaccaaagggccatccgtcttcccgctggctccctgctcaagaagcacttccgagtctacagcagcccttggatgtctggtgaaggattactttcctgaaccagtaaccgtttcctggaacagcggtgctttgacgtcgggcgtgcacactttccccgccgtcctccaatcttccgggctgtattcactgagtagcgtggtgaccgtcccttcctctaattttggaacacagacttatacctgcaacgttgaccataaaccaagcaatacaaaggtggataagaccgtagagaggaaatgttgcgtggagtgtcccccttgcccagcgccgcccgtcgcaggcccttcagtgttcctctttccacccaagcctaaagacacgttaatgatcagtcggactccagaagttacatgtgtggtcgtggatgtatcccacgaggaccccgaagttcagttcaactggtacgtggatggtgtcgaggtgcataatgccaagaccaaaccgcgcgaggaacagtttaacagcactttcagagtcgtgtctgttctgacagtggtacaccaagactggcttaatgggaaggagtacaagtgcaaagtctcaaacaagggattgcctgctcccattgagaaaaccatcagtaagacgaaaggccagccaagggaacctcaggtgtacaccctgcccccaagccgggaagagatgacaaagaatcaggtttccctaacttgtctcgtgaaaggcttttatccctctgatattgccgtcgagtgggaatcgaacgggcaacctgagaataactacaagaccacaccaccgatgctggacagcgatggatccttcttcctttattcaaagctgactgtggacaaaagtcgctggcagcagggtaacgtattttcttgcagcgtgatgcatgaagcattgcacaatcactacacccaaaagtccctctcactgagccccggcaaa

SEQ ID NO: 23764 - RNA, 645 nt, synthetic construct
  misc_feature 1..645: note = derived and/or modified sequence opt3 from Tarextumab_LightChain1
  source 1..645: mol_type = other RNA
gacatcgtgctgacccagagccccgccacactctccctttctcctggcgagagagctactctgtcatgcagggcaagtcaaagcgtccggtccaactacttggcctggtatcagcagaagccagggcaggcgccgcgcttactgatttacggagcttcttcgcgagccacgggtgttcccgcacgtttctcaggcagcgggagtggaaccgattttacactaactatatcctctctcgaacctgaggacttcgccgtgtattactgtcaacagtatagcaattttccaatcaccttcggccagggtacaaaagtagaaattaagagaaccgtggctgcaccctccgtctttatcttccctccatcagatgagcagctgaaaagtgggactgccagcgtggtttgccttctgaacaatttttaccccagggaagctaaggtgcaatggaaagtcgacaacgccttgcagtctggaaattcccaggagtcagtgacagagcaggatagcaaggacagtacctattctctctccagcacgctgactctgtcgaaggcggattacgaaaaacacaaggtatacgcatgtgaggttacccatcaaggcctctcttcccctgtgacaaaatcattcaaccggggcgaatgc

SEQ ID NO: 23765 - RNA, 363 nt, synthetic construct
  misc_feature 1..363: note = derived and/or modified sequence opt3 from Tefibazumab_HeavyChain1
  source 1..363: mol_type = other RNA
caggtgcaactgaaggagagcggccccgggctcgtcaaaccttcccagaccctttctatcacatgcactatttcaggattcagtctgagcagatactccgttcactgggtgaggcagccaccgggtaagggcttggaatggttagggatgatatggggaggcggtaacacggactataattctgccctgaaatcgcggctatcaatcagcaaggataacagtaaaaatcaggtatttctcaagatgaactccctgaccgctgcagacacagccgtgtactattgtgcgcgcaagggggagttctactatggatacgatggctttgtctattggggccaagggactcttgtgaccgtttctagc

SEQ ID NO: 23766 - RNA, 336 nt, synthetic construct
  misc_feature 1..336: note = derived and/or modified sequence opt3 from Tefibazumab_LightChain1
  source 1..336: mol_type = other RNA
gacatcgtgatgacccagagccccgattccctggccgtctctctcggcgagagagttacaatgaactgcaagtcaagtcaaagcgtgctttactcctctaatcagaaaaactatctggcttggtaccagcagaagcctgggcaatcgccaaaattgttaatttattgggcatcaactagggaaagcggagtaccggaccggttcagtggttccggctctgggacggattttaccctgacaataagctccgtgcaggccgaggacctagcggtctactattgtcaccagtacctctcaagttatactttcggaggcggtaccaagctggaaatcaaa

SEQ ID NO: 23767 - RNA, 1368 nt, synthetic construct
  misc_feature 1..1368: note = derived and/or modified sequence opt3 from Tenatumomab_HeavyChain1
  source 1..1368: mol_type = other RNA
gagatccagctgcaacagagcggccccgaactcgtgaagcctggggcctccgtcaaagtttcttgcaaggcttcaggatacgcattcaccagttataacatgtactgggtgaaacagagccacggtaagtcccttgagtggattggctatatagacccatacaatggggtaacatcttataaccagaaatttaagggaaaggccactctgacggtggataaatcgtcaagcaccgcgtacatgcatttgaatagtttaacatccgaagactctgctgtctattactgtgccagaggcggtgggagcatctactatgcaatggattactggggacaaggcacttccgtgaccgtttcaagtgccaagacaaccccgcccagcgtgtatcctctggctccaggctgcggggacactacaggatcttccgtcaccctaggttgtctcgtgaaaggctacttccccgagtcagtaacggttacttggaacagcgggagtctgtcttccagcgtgcacacctttcctgcacttctgcagtcgggattgtatacaatgtcttcctcagtcactgtgccaagtagcacctggccctcccagacagtgacctgctctgtcgcccatcctgctagctcaacgactgttgataagaaactcgaaccaagtggcccgatttccacaatcaatccctgtcctccatgcaaggagtgtcacaagtgccccgcccctaacctggagggtgggccaagcgtgttcatttttcccccgaatatcaaagacgtactgatgatatctctcacccctaaggtgacttgtgtcgtggttgatgtgtcagaagacgatcccgacgtccagatcagttggttcgtgaacaatgtagaggttcatacagcgcaaacccagacgcacagggaagattacaacagcaccattcgggtggtctccacattaccaatccagcaccaggactggatgtctggaaaagagtttaagtgcaaagtgaataacaaggatctgccttcgcccattgagcgcactatcagcaaaataaagggccttgtccgagcaccacaagtgtatattttgccccctccagccgaacagctgtcccgtaaggacgtttcactaacctgtctcgtggtaggcttcaatccgggggacatcagtgtcgagtggacatctaacggacatactgaagagaattacaaagataccgctcccgtgctggacagcgatggttcctactttatttattcaaaacttaacatgaaaacaagcaagtgggaaaagaccgactctttctcctgcaacgttagacacgagggcctgaagaattactatttgaagaaaactatcagtaggagccctgggaag

SEQ ID NO: 23768 - RNA, 657 nt, synthetic construct
  misc_feature 1..657: note = derived and/or modified sequence opt3 from Tenatumomab_LightChain1
  source 1..657: mol_type = other RNA
gacatcgtgatgacccaggccgctcccagcgtccctgttacaccaggcgagtccgtgtctatttcatgcagaagtagcaagtccctgctccactctaacgggaatacttacctttattggttcctgcaaaggccgggacagtcgccccagttgttaatataccggatgtcaaacctggcaagcggtgtacctgatcgctttagtggctccgggtctggaacggccttcaccctacgaatcagccgtgtggaagcggaggacgtcggcgtgtattactgtatgcagcatctcgaatatccactgacatttggtgctgggactaaacttgagctgaagagagccgatgcagcccccaccgtttccattttccctccatcaagtgaacaattgacaagcggaggcgcttctgtggtctgctttctcaataacttctaccccaaagacatcaatgtgaagtggaaaattgatggctccgagaggcagaacggggtactcaattcatggaccgaccaggatagcaaggacagtacttattctatgtccagcacactgaccctgacgaaggatgagtacgaacggcacaactcgtacacttgtgaggcaacccataaaacatctacttcccctatcgttaagtcatttaatcgcaacgaatgc

SEQ ID NO: 23769 - RNA, 1356 nt, synthetic construct
  misc_feature 1..1356: note = derived and/or modified sequence opt3 from Teneliximab_HeavyChain1
  source 1..1356: mol_type = other RNA
cagatccaactggtgcagagcggccccgagctcaagaaacctggggaaaccgtcagaatttcctgcaaggcctctggatacgctttcacaactacgggtatgcagtgggttcaggagatgccaggcaaagggcttaagtggataggatggatcaacacccactcaggcgtgccgaaatatgtagaagactttaagggtaggttcgcatttagtctggagacaagcgccaatactgcgtacttgcaaatttccaacttaaagaatgaagataccgctacatatttctgtgtgcggtctgggaacggaaattacgacctggcctattttgcatactggggccagggcaccctagtcactgtgtcggccgcttcaacaaaagggcccagcgttttccctctcgcaccaagttccaagtctaccagcggaggtacggccgctctgggctgccttgtgaaagattattttcccgagcctgtcactgtgtcctggaactcaggggccctgaccagtggagtacatacattcccagcggttttgcagagctctggcctctactccctgtcaagcgtggtcactgtgcccagttcttccctgggtacccagacatacatctgtaatgtgaaccacaagcctagcaataccaaagtcgacaagaaggttgagccaaaatcgtgcgataagacgcatacttgtccgccctgccctgcaccagaactcttagggggaccctctgtgtttctgttccctccaaaacccaaggacacacttatgatttcccgcaccccggaggtaacttgtgtggtcgtggatgtttcacacgaagaccctgaggtgaaatttaactggtatgtcgatggcgtggaggtacataatgccaagacaaaaccccgagaggaacaatacaacagtacctatcgtgttgtgagcgtcttgacggtgctgcaccaggactggctaaatggcaaggaatacaagtgcaaagtctccaacaaggctctcccagcccctatcgagaaaaccatatctaaggcaaaagggcagcccagagaaccacaggtgtatacactgccccctagcagggatgagcttactaagaatcaagtttcactgacctgtttggtgaagggattctacccaagtgacatcgctgtagagtgggaatccaacggtcagccggagaacaattataaaacaactccccctgtcctcgatagcgacggctcatttttcctgtactctaagttaaccgtggacaaaagtcggtggcagcaagggaacgttttcagctgctccgtgatgcacgaagccctgcataatcactacacacagaagtctctctcgcttagcccaggaaaa

SEQ ID NO: 23770 - RNA, 642 nt, synthetic construct
  misc_feature 1..642: note = derived and/or modified sequence opt3 from Teneliximab_LightChain1
  source 1..642: mol_type = other RNA
gacatcgtgctgacgcagagccccgccacactctccgtcactcctggcgatagagtttctctttcatgcagggctagtcaaagcatttccgactacctgcactggtatcagcagaagtctcatgagtcgccacggttgttaataaaatacgcatcacacagcatcagtgggattccgtcccgcttctctggaagcggttccggctcagattttacgctgagtatcaacagcgtggaacccgaggacgtagggatttattactgtcagcatggacactctttcccttggacctttggcggtgggacaaagctagaaatcaaacgaactgtggccgcgccatccgtcttcatatttcccccttcagatgagcaactcaagagcggaaccgctagtgtggtttgcctgcttaataacttctatccacgtgaagccaaagtgcagtggaaggtcgacaatgcactgcagtctggcaactcccaggagagcgtgacagagcaagattcgaaggactctacctactccttgtcaagtactctcacactgagcaaagccgattatgaaaagcataaagtatacgcttgtgaggttacccaccagggcctgtcctctcccgtgaccaagagctttaatagaggggaatgc

SEQ ID NO: 23771 - RNA, 1347 nt, synthetic construct
  misc_feature 1..1347: note = derived and/or modified sequence opt3 from Teplizumab_HeavyChain1
  source 1..1347: mol_type = other RNA
caggtgcaactggtccagagcggcgggggagttgtgcagcccggtagatccctcaggctttcttgcaaggcctcaggctacaccttcacacggtatactatgcactgggtacgccaggctcctgggaaaggactggagtggatcggctacattaacccaagtcgaggttatacgaattacaaccaaaaggtgaaagaccgttttaccataagcagagataattccaagaacacagcattcttgcagatggactctttaaggccggaagatactggggtctatttttgtgcccggtactatgacgatcattactgcctggactactggggacagggcacccccgtgacagtttcgtcagcgagcaccaaaggccctagtgtgttcccactagctccctcctctaagagcacttccgggggaacagccgcactcggttgtctggtcaaggattattttcctgagccagtgaccgtatcatggaatagtggcgcccttacgagcggggttcacactttccccgctgtgctgcagtcttccggattgtactcactcagcagtgtcgtgaccgtgccttcttccagcctgggcacacaaacttatatctgcaacgtcaatcataaaccatcgaacaccaaggttgacaaaaaggtggaaccgaaatcttgtgataagacacacacctgtcccccttgcccagcacccgaggccgctggtgggccttccgtatttctgttcccacccaagccgaaagacacgctcatgatttcacgcactcctgaagtgacatgcgtcgtggttgatgtgagtcatgaggaccccgaggtcaagtttaattggtacgtggatggagtagaagttcacaacgccaaaaccaagccaagagaggaacagtataatagcacttacagggtggtctccgtgttaacagtcctgcaccaggactggcttaacggcaaagagtataagtgtaaagtgtctaataaggcgttgcctgcacccatcgagaagaccattagcaaagccaagggccagccacgggaaccccaagtttacacgctgcctccatcacgcgacgagctaaccaaaaaccaggtgagtctcacatgcctggtaaaggggttctacccgtccgatatcgctgtcgaatgggagagcaatggacagcccgaaaacaactataaaactacccctccagtgcttgactctgatggttcatttttcctgtacagtaagttgacagttgacaagagccgatggcaacagggcaatgtgttttcctgttctgtcatgcatgaggccctccacaaccattatactcagaaatcgctgagcttatcccccgggaag

SEQ ID NO: 23772 - RNA, 639 nt, synthetic construct
  misc_feature 1..639: note = derived and/or modified sequence opt3 from Teplizumab_LightChain1
  source 1..639: mol_type = other RNA
gacatccagatgacccaaagcccctcctctctgtcagccagtgtgggcgatagagtcacaattacttgcagcgcttcctcttcggtttcatacatgaactggtatcagcagacgcctgggaaggcaccaaaaaggtggatatacgacaccagcaagctcgccagtggagtgccgtcccggttctctggtagcggctccgggacagattatacttttaccatctcaagtcttcagcccgaggacattgcgacatactattgtcaacagtggagctctaatcctttcacctttggacagggcactaaactgcagatcacacgcaccgtagctgccccatccgtgttcatttttcccccttcagatgaacaattgaagtccggtacggcaagtgtcgtgtgcttactgaacaatttctacccacgagaggccaaagttcagtggaaggtggacaacgctctacagtctgggaatagccaggaaagcgtcactgagcaagattcgaaggactctacctattccctctcaagtacactgactcttagcaaagcagattacgaaaagcacaaagtgtacgcctgtgaggtaacccatcagggactgtcctctcccgttacaaagagctttaaccgtggcgagtgc

SEQ ID NO: 23773 - RNA, 1344 nt, synthetic construct
  misc_feature 1..1344: note = derived and/or modified sequence opt3 from Teprotumumab_HeavyChain1
  source 1..1344: mol_type = other RNA
caggtggagctggtcgaaagcggcgggggagttgtgcaacccggtagatcccagaggctctcttgcgccgcttcaggcttcacctttagtagctacgggatgcactgggtacggcaggcacctggaaagggccttgagtgggtggccatcatttggttcgacggttcctctacatattacgcggattcggtccgcgggcgatttactatatcacgtgacaacagcaaaaatacgctgtatttgcagatgaacagtttaagagctgaagataccgccgtgtacttctgtgcaagggagctgggacggcgctattttgacctatggggcagaggcacactcgtttccgtgtctagcgcctccactaaggggccatcagtcttcccgctggctcccagtagcaaatctacctccggaggtacagcagcccttggctgcctggtgaaggattactttcctgaaccagtaaccgtttcatggaatagcggggctttgacaagtggagtgcatactttccccgccgtcctccaatcttccggcctgtatagcctgtcgtctgtggtgaccgtcccttcctcaagtctcggtacgcagacttacatctgtaacgttaatcacaaaccaagcaacaccaaggtggacaagaaagtagagcccaagtcctgcgataaaacacatacttgtcctccatgcccggcgcccgagttacttgggggaccttctgtgtttctgttcccacccaagcctaaagacaccttgatgattagcaggacaccagaagtcacctgtgtggttgtggatgtctcacacgaggaccccgaagtgaagtttaattggtacgtagatggcgttgaggtgcataacgcaaagacgaaaccgcgggaggaacagtataatagtacttaccgcgtcgtgtccgtcctgacagtgctacaccaggactggctcaacggcaaggagtataaatgcaaggttagcaataaagccctgcctgctcccatcgaaaagaccatttctaaagccaaggggcaaccacgagagcctcaggtgtacactcttcccccatcaagagatgaactgacaaagaaccaggtaagtttgacctgtctcgtcaaaggattctatcccagcgacatcgcagtggagtgggagtccaatggtcagcctgaaaacaattacaagacgaccccaccggttctggactctgatggctcgtttttcttatatagcaaactgacagtggacaagtccaggtggcaacaggggaacgtcttctcatgcagtgtgatgcacgaggctctccataaccactacactcagaaatctcttagcctgtcccccggaaag

SEQ ID NO: 23774 - RNA, 645 nt, synthetic construct
  misc_feature 1..645: note = derived and/or modified sequence opt3 from Teprotumumab_LightChain1
  source 1..645: mol_type = other RNA
gagatcgtgctgacccagagccccgccacactctccctttctcctggcgaaagagctactctgtcatgcagggcaagtcaaagcgtctcctcttacttggcctggtatcagcagaagccagggcaggcgccgcggttactgatttacgacgcttcgaaacgcgccacgggaatacccgcacgattctcaggtagcggcagtgggaccgattttacactaactatctcctctctcgagcctgaagacttcgccgtttattactgtcaacagcgtagcaagtggccaccctggacctttggacagggcacaaaagtggagtccaagagaaccgtagctgcaccttcagtgttcatttttccacccagtgatgaacagctgaaaagcggtactgcctctgtcgtgtgccttctgaacaatttctatcctagggaggctaaggttcaatggaaggtggacaacgccttgcagtccggaaattcacaggagagcgtcacagaacaggatagtaaagactctacctactccctcagctcgacgctgactctgtctaaggcggattatgagaaacacaaggtgtacgcatgtgaagtaacccatcaagggctctcctcaccagttacaaaaagttttaaccggggcgagtgc

SEQ ID NO: 23775 - RNA, 1338 nt, synthetic construct
  misc_feature 1..1338: note = derived and/or modified sequence opt3 from Tesidolumab_HeavyChain1
  source 1..1338: mol_type = other RNA
gaggtgcagctggtccaaagcggcgccgaagttaagaaacccgggtcctctgtgaaggtatcatgcaaagctagtggaggtaccttcagctcctacgcaatctcttgggtgagacaggcccctggccaggggctcgagtggatgggaggcattggtccatttttcgggacagcgaactatgctcagaagtttcaaggaagggtcactataacggccgacgaatcgacctcaacagcatacatggagcttagcagtctgcggtccgaagatactgccgtgtattactgtgctcgcgacaccccgtatttcgattactggggccagggcacattggttaccgtgtctagcgcatccactaaagggccctcagtctttcctttagccccaagtagcaagtctacatccggaggtaccgctgccctgggctgcctagtgaaggactatttccccgagcctgtaacggtttcatggaatagcggggcgctcaccagtggagtgcacacttttccagcagtcctgcagtcttccggcctttacagcctgtcgtctgtggtgacagtcccctcctcaagtttgggtactcagacctacatctgtaacgttaatcataaacctagcaacacaaaggtggataaacgagtagagccaaagtcctgcgacaaaacccacacgtgtccgccctgccctgccccagaagctgccgggggaccctctgtgttcctctttcctccaaagcccaaggatactctgatgattagccgtacaccggaggtcacctgtgtggttgtggacgtctcacatgaagatcctgaggtgaaattcaattggtatgtagacggcgttgaggtgcacaacgcaaagactaaacccagagaggaacaatacaatagtacatatagggtcgtgtccgtcctgaccgtgctccatcaggattggttaaacggcaaggaatacaaatgcaaggttagcaataaagctctgccagcccctatcgagaagacgatttctaaggcgaaagggcagccccgggaaccacaggtgtatacccttcccccttcacgcgaggagatgacaaagaaccaagtaagtttgacttgtctggtcaaaggattttacccaagcgacatcgccgtggaatgggagtccaatggtcagccggaaaacaattataagaccacaccccctgttctagattctgacggctcgttctttctctacagcaaactgactgtggacaagtccagatggcagcaagggaacgtcttctcatgcagtgtgatgcacgaggcacttcacaatcattacacccagaagtctctgagcttgtccccaggaaaa

SEQ ID NO: 23776 - RNA, 642 nt, synthetic construct
  misc_feature 1..642: note = derived and/or modified sequence opt3 from Tesidolumab_LightChain1
  source 1..642: mol_type = other RNA
agctacgagctgacccagcccctctccgtgtctgtcgcccttggccaaacagctagaatcacttgctcaggggacagtattcctaactattacgtttattggtaccagcagaagccaggacaggcaccggtgctggtaatatatgatgacagcaataggccctccggtatccctgaacggttctctggctcgaactcagggaatacggccaccttgacaattagccgcgcgcaagctggagatgaggccgactactattgtcagagttttgattcctctttaaacgcagaagtgttcggcggtgggactaaactgaccgtcctaggacagccaaaggccgctcccagcgtgacactctttcctccatcctcagaggaactgcaggcaaataaagccacccttgtttgcctgatcagtgacttctaccccggcgctgtgactgtcgcctggaaggcggatagctctcctgtgaaagcaggcgtagagacaaccacgccatccaagcaatcaaacaataagtacgccgctagcagttatttgtctctcactccggagcagtggaaatcccaccgaagctactcgtgtcaggttacccatgaagggtctacagtggagaagactgtcgcccccaccgaatgctcc

SEQ ID NO: 23777 - RNA, 1344 nt, synthetic construct
  misc_feature 1..1344: note = derived and/or modified sequence opt3 from Tezepelumab_HeavyChain1
  source 1..1344: mol_type = other RNA
cagatgcaactggtggagagcggcgggggagtcgttcagcccggtagatccctcaggctttcttgcgccgcttcaggcttcacctttcggacatacgggatgcactgggtgcgccaggcacctggaaagggcctggaatgggtagccgtgatctggtatgacggtagtaacaaacattacgcggatagcgtcaaggggcgattcactattacgcgtgacaattccaaaaacaccttgaatttacagatgaactctctgagagctgaggatacagccgtgtattactgtgcaagggccccacaatgggagctagttcacgaggcttttgacatatggggacagggcactatggtgaccgtctcgtcagcaagcacaaagggcccgagtgtgttccccctcgccccttgctcccggtctaccagcgaatccactgctgccctggggtgtcttgtaaaagattattttccagagcccgttacagtgtcatggaatagtggagcgctgaccagcggtgtccatacgttccctgcagtgttgcagtcttccggcctctactcactgagcagtgtggtcactgttccatcttccaactttgggacccagacatatacttgcaatgtggaccacaagcccagcaacaccaaggtagataaaacagtggagcgcaagtgttgcgtcgaatgtcctccatgcccggctccccctgtggccggaccatcggttttcctgtttccccctaaaccaaaggacaccctcatgatctctagaacgcccgaggtgacttgtgtcgtggtagatgtttcccatgaagacccggaggtgcaattcaattggtacgtcgatggcgtggaggtccacaacgccaaaacaaagcctagggaagaacagtttaattcaaccttccgggtggttagtgtgttaactgtagtccaccaggactggctgaacggtaaggaatacaaatgcaaggtgagcaataaagggcttcccgcaccaattgagaagacaatctccaaaaccaagggacagcctcgcgaaccccaagtttatacgttgccaccctctcgagaggagatgaccaaaaaccaggtgagcctgacatgtctagtcaagggcttttacccttcagatattgctgtggaatgggagagtaatggccagccagaaaacaactataagactaccccgcccatgctcgactccgacgggagcttcttcctgtactctaaacttacagtagataagtcaagatggcaacagggaaatgtgtttagttgcagcgttatgcatgaggccctgcacaaccattatactcagaaatccttgtctctctcgcctggtaag

SEQ ID NO: 23778 - RNA, 642 nt, synthetic construct
  misc_feature 1..642: note = derived and/or modified sequence opt3 from Tezepelumab_LightChain1
  source 1..642: mol_type = other RNA
agctacgtgctgacccagcccccttccgtctctgttgccccaggccaaacagctagaatcacttgcgggggaaacaatctcggttcaaagagtgtgcactggtatcagcagaaaccgggccaggcacccgtacttgtggtctacgacgatagcgacaggccttcctggattccagagcggttctctgggtcgaactcaggaaatacggccaccctgacaataagccgcggcgaagcgggtgatgaggctgactattactgtcaagtgtgggatagttcctctgaccatgttgtgtttgggggaggcactaagttgaccgtcttaggccagcccaaagccgcacctagcgtgacactgttcccaccctcctcagaagaactacaggccaacaaggctaccctcgtatgcctgatcagtgatttttatcctggggcagttactgtggcctggaaagctgacagctctccagtcaaggccggagtggaaacaaccacgccgtccaagcagtcaaataacaaatacgcggcaagcagttatctttctctgactcccgagcaatggaagtcccaccgaagctactcgtgtcaggtgacccatgagggttctacagtcgagaaaactgttgcccctaccgagtgctcc

SEQ ID NO: 23779 - RNA, 1338 nt, synthetic construct
  misc_feature 1..1338: note = derived and/or modified sequence opt3 from ThioMAb-chMA79b-HC(A118C)_HeavyChain
  source 1..1338: mol_type = other RNA
gaggtgcagctgcaacagagcggcgccgaactcatgaagcccggggcttccgtcaaaatctcttgcaaggcaaccggatacacattctcaagttattggattgagtgggttaaacagagacctggtcacggccttgaatggataggggagatcctgccaggaggcggtgacactaactacaatgaaatttttaaggggaaagccacgttcaccgcggatacaagctccaacactgcttatatgcagttgtcttcgttaacctcagaggacagcgccgtgtactattgtacaaggcgggtaccggtgtactttgattattggggacaaggcaccagtgtcactgtgtcctcttgcagcacaaagggcccctccgttttccctctggcaccatcaagtaagagcacctctgggggaacggccgctctaggttgtctcgtgaaagactactttcccgagcctgtcactgtgtcctggaactcaggcgcactgaccagcggggtacatacattcccagccgttcttcagagttctggactgtactccttgagctcggtggtcactgtgccctcttcctcactcggcacccagacatatatctgcaatgtgaatcacaagcctagtaacaccaaagtcgataagaaagttgaaccaaagagctgtgacaagacgcatacttgcccgccctgtcctgctccagagctgctgggtgggccctccgtgtttctcttccctccaaaacccaaggatacattaatgatttctcgcaccccggaagtaacttgcgtggtcgtggacgttagccacgaggatcctgaggtgaaatttaattggtacgtcgacggagtggaagtacataacgccaagacaaaaccccgagaggaacagtataattcaacctaccgtgttgtgagtgtcctgacggtgcttcaccaagattggttgaacggcaaggagtataaatgtaaggtctccaataaggcgctgccagcacctatcgagaaaaccataagcaaggccaaaggccagcccagagaaccacaggtgtacacactacccccttctagggaggaaatgactaagaaccaggtttcactgacctgcctcgtgaaagggttctatccaagtgacatcgctgtagagtgggaaagcaatggacaaccggagaacaattacaagacaactccccctgtccttgattccgacggttcgtttttcctgtactctaagttgaccgtggacaaaagccggtggcagcagggcaacgtgttttcctgttcagttatgcacgaagccctccataaccactatacacaaaagagtctgtctttaagcccaggg

SEQ ID NO: 23780 - RNA, 1347 nt, synthetic construct
  misc_feature 1..1347: note = derived and/or modified sequence opt3 from ThioMab-hu10A8.v1-HC(A118C)_HeavyChain
  source 1..1347: mol_type = other RNA
gaggtgcagctggtcgaaagcggcgggggactcgttcaacccggtggctcccttagactgtcttgcgccgcttcagggttcacctttagtagctacgcagtgtcctgggtaaggcaggcccctggaaagggcttggagtgggtggcgacaatctcttcgggtgggtcattaactttctatctggacagcgtccggggacgctttacgattagtcgagataactccaaaaataccctatacctccagatgaactctctgcgtgctgaagacacagccgtgtattactgtgcaagaccaataccggattattacgcccttgactattggggccagggcactctggttaccgtgagctcctgctcaacaaaggggcccagtgtcttccctttggctccaagctctaaatccacctcaggaggtactgcagccctcggctgtctggtgaaggattactttcccgagcctgtaacagttagctggaatagtggggctctgacctctggagtgcacacgttcccagccgtcctccaatccagcggcttatactcgctgtcttccgtggtgactgtcccctcaagtagccttggtacccagacatatatctgcaacgttaatcataaaccttccaacactaaggtggacaagaaagtagaaccaaagtcttgtgataaaacccacacatgcccgccctgtcctgcgccagagttgctcgggggacccagcgtgtttctattccctccaaagcccaaagacaccctcatgatttcaaggacgccggaggtcacttgcgtggttgtggatgtcagtcatgaagaccctgaggtgaagtttaattggtacgtagatggcgttgaagtgcacaacgcaaagacaaaaccccgggaggagcagtataattccacctaccgcgtcgtgagcgtcctgactgtgcttcatcaggactggctgaacggcaaggaatataaatgtaaggtttctaataaagccttgccagctcctatcgagaagacaatttcaaaagccaaggggcaacccagagaaccacaggtgtacaccctgccccctagtagggaggaaatgacgaagaaccaggtaagcctgacctgcttagtcaaaggattctatccatccgatatcgcagtggagtgggagtctaatggtcagccggaaaacaattacaagacaactccccctgttctggactcggacggcagctttttcctctactccaaacttaccgtggataagtcacggtggcaacaggggaacgtctttagttgttctgtgatgcacgaggctctgcacaaccattatacacagaaatccttgagcctatcaccaggaaag

SEQ ID NO: 23781 - RNA, 1347 nt, synthetic construct
  misc_feature 1..1347: note = derived and/or modified sequence opt3 from ThioMab-hu10A8.v1-HC(V205C)_HeavyChain
  source 1..1347: mol_type = other RNA
gaggtgcagctggtcgaaagcggcgggggactcgttcaacccggtggctcccttagactgtcttgcgccgcttcagggttcacctttagtagctacgcagtgtcctgggtaaggcaggcccctggaaagggcttggagtgggtggcgacaatctcttcgggtgggtcattaactttctatctggacagcgtccggggacgctttacgattagtcgagataactccaaaaataccctatacctccagatgaactctctgcgtgctgaagacacagccgtgtattactgtgcaagaccaataccggattattacgcccttgactattggggccagggcactctggttaccgtgagctccgcttcaacaaaggggcccagtgtcttccctttggcaccaagctctaaatccacctcaggaggtactgccgctctcggctgcctggtgaaggattactttcccgagcctgtaacagttagctggaatagtggggccctgacctctggagtgcacacgttcccagcggtcctccaatccagcggcttatactcgctgtcttccgtggtgactgtcccctcaagtagccttggtacccagacatatatctgtaacgttaatcataaaccttccaacactaaggtggacaagaaagtagaaccaaagtcttgcgataaaacccacacatgtccgccctgccctgcaccagagttgctcgggggacccagcgtgtttctattccctccaaagcccaaagacaccctcatgatttcaaggacgccggaggtcacttgtgtggttgtggatgtcagtcatgaagaccctgaggtgaagtttaattggtacgtagatggcgttgaagtgcacaacgccaagacaaaaccccgggaggagcagtataattccacctaccgcgtcgtgagcgtcctgactgtgcttcatcaggactggctgaacggcaaggaatataaatgcaaggtttctaataaggctttgccagcccctatcgagaaaacaatttcaaaagcaaaggggcaacccagagaaccacaggtgtacaccctgccccctagtagggaggaaatgacgaagaaccaggtaagcctgacctgtttagtcaaaggattctatccatccgatatcgctgtggagtgggagtctaatggtcagccggaaaacaattacaagacaactccccctgttctggactcggacggcagctttttcctctactccaaacttaccgtggataagtcacggtggcaacaggggaacgtctttagttgctctgtgatgcacgaggccctgcacaaccattatacacagaaatccttgagcctatcaccaggaaag

SEQ ID NO: 23782 - RNA, 642 nt, synthetic construct
  misc_feature 1..642: note = derived and/or modified sequence opt3 from ThioMab-hu10A8.v1-LC(A118C)_LightChain
  source 1..642: mol_type = other RNA
gacatccagatgacccaaagcccctcctctctgtcagccagtgtgggcgatagagtcacaattacttgcaaggctagccaggacgtttccacggcagtggcctggtaccagcagaaacctgggaaggcgccaaaactccttatatattctgcttcgtacaggtataccggagtaccgtcacggttcagcggtagtggctccgggacagattttactctgaccatctctagcttgcaacccgaggacttcgccacatactattgtcagcagcacttttcctcacctcgcaccttcggacagggcactaaggtggaaattaaacgaacagtcgcagccccaagtgtgtttatctttccccctagcgatgagcaattaaagtctggtaccgcttccgttgtgtgcctgctaaacaatttctacccacgtgaagcaaaggtccagtggaaagtggacaacgccctccagtcagggaatagccaggagagtgtaacggaacaagattctaaggactccacttatagcctgtcgtctacccttacactgtccaaagctgattacgagaagcataaagtttacgcctgtgaggtgactcaccagggattgtcaagtcccgtcaccaagagcttcaacagaggcgaatgc

SEQ ID NO: 23783 - RNA, 642 nt, synthetic construct
  misc_feature 1..642: note = derived and/or modified sequence opt3 from ThioMab-hu10A8.v1-LC(V205C)_LightChain
  source 1..642: mol_type = other RNA
gacatccagatgacccaaagcccctcctctctgtcagccagtgtgggcgatagagtcacaattacttgcaaggctagccaggacgtttccacggcagtggcctggtaccagcagaaacctgggaaggcgccaaaactccttatatattctgcttcgtacaggtataccggagtaccgtcacggttcagcggtagtggctccgggacagattttactctgaccatctctagcttgcaacccgaggacttcgccacatactattgtcagcagcacttttcctcacctcgcaccttcggacagggcactaaggtggaaattaaacgaacagtcgcagccccaagtgtgtttatctttccccctagcgatgagcaattaaagtctggtaccgcttccgttgtgtgcctgctaaacaatttctacccacgtgaagcaaaggtccagtggaaagtggacaacgccctccagtcagggaatagccaggagagtgtaacggaacaagattctaaggactccacttatagcctgtcgtctacccttacactgtccaaagctgattacgagaagcataaagtttacgcctgtgaggtgactcaccagggattgtcaagtccctgcaccaagagcttcaacagaggcgaatgt

SEQ ID NO: 23784 - RNA, 1338 nt, synthetic construct
  misc_feature 1..1338: note = derived and/or modified sequence opt3 from ThioMAb-huMA79b.v17-HC(A118C)_HeavyChain
  source 1..1338: mol_type = other RNA
gaggtgcagctggtcgaaagcggcgggggactcgttcaacccggtggctcccttagactgtcttgcgccgcttcagggtacaccttcagtagctattggatcgagtgggtgaggcaggcacctggaaagggcttggaatggattggtgagatattaccagggggaggcgacacaaactacaatgaaatctttaaaggccgggccactttctccgcggatacgtctaagaacaccgcttatctgcagatgaatagtctacgcgccgaggacacagcagtatactattgtactcgacgtgtgccggtctactttgattattgggggcagggaaccctcgtgacagtttcaagctgcagtaccaaaggtccctccgtgttccctctggccccatctagcaagtccacttcaggcgggacagctgcacttggatgtctggtcaaagactactttcccgagcctgtgaccgtaagttggaacagcggcgccttgacgtctggtgttcacactttcccagctgtgctccaatcctcagggctgtacagcctgagttctgtcgtgaccgtgccctccagctcgctcggaacacagacttatatttgcaatgtcaaccataagccttctaataccaaggttgataaaaaggtggaaccaaaatcctgtgacaagacacatacctgcccgccctgtcctgccccagagttactgggcggcccctcagtatttcttttccctccaaaacccaaggatacgttgatgatcagtagaactccggaagtgacatgcgtcgtggttgacgtgagccacgaggatcctgaggtcaagtttaactggtacgtggacggggtagaagttcacaatgcgaaaaccaagcccagggaggaacagtataactccacttaccgggtggtctctgtgctgacagtcctacatcaggattggctcaatggaaaagagtataagtgtaaagtgagcaacaaggcactgccagcccctattgaaaagaccatctcaaaggctaagggtcaaccccgcgagccacaggtttacacgcttccccctagtagagaggaaatgaccaaaaatcaggtgtccctgacatgcttggtaaagggcttctatccaagcgacatagccgtcgagtgggaatctaacgggcagccggagaataactacaaaactacaccccctgtgctcgattcagacggatcgtttttcctgtacagcaagttaaccgttgacaaatccaggtggcaacagggcaacgtgttttcttgttcggtcatgcacgaagcactgcacaatcattatactcagaaaagcctctccctttcaccaggt

SEQ ID NO: 23785 - RNA, 654 nt, synthetic construct
  misc_feature 1..654: note = derived and/or modified sequence opt3 from ThioMAb-huMA79b.v17-HC(A118C)_LightChain
  source 1..654: mol_type = other RNA
gacatccagctgacccaaagcccctcctctctctcagccagtgtgggcgatagagtcacaattacttgcaaggctagccagtccgttgactacgatggggactctttccttaactggtatcagcagaaacctggaaaggcaccaaaactgttgatatacgccgcgtcgaatttagagtcaggtgtgccgagcaggtttagtggctccgggtctggaacggatttcaccctgacaatcagctccctacaacccgaagactttgctacttattactgtcagcagtcaaacgaggatcctctcaccttcggccagggtacaaaggtagaaattaaacggaccgtggccgcaccaagtgtctttatctttccccctagcgacgagcaactgaagtctgggactgcctccgtggtttgccttctgaataacttctatccacgcgaagctaaggtgcagtggaaagtcgataatgcattgcagtcaggaaacagccaggagagtgtgacagagcaagactctaaggattccacctacagcctctcgtctacgctgactctgtccaaagccgactatgaaaagcacaaagtatacgcttgtgaggttacccatcagggcctctcaagtcccgtgacaaagagcttcaatcgaggcgaatgc

SEQ ID NO: 23786 - RNA, 1338 nt, synthetic construct
  misc_feature 1..1338: note = derived and/or modified sequence opt3 from ThioMAb-huMA79b.v18-HC(A118C)_HeavyChain
  source 1..1338: mol_type = other RNA
gaggtgcagctggtcgaaagcggcgggggactcgttcaacccggtggctcccttagactgtcttgcgccgcttcagggtacaccttcagtagctattggatcgagtgggtgaggcaggcacctggaaagggcttggaatggattggtgagatattaccagggggaggcgacacaaactacaatgaaatctttaaaggccgggccactttctccgcggatacgtctaagaacaccgcttatctgcagatgaactcgctacgcgccgaggacacagcagtatactattgtactcgacgtgtgccgattagactcgattactgggggcagggaaccctggtcacagtgtcaagctgcagtaccaaaggtccctccgtttttcctcttgccccatctagcaagtccacttcaggcgggacagctgcactgggatgtttggtgaaagactatttccccgagcctgtcaccgtgagttggaatagcggcgccctcacgtctggtgtacacacttttccagctgttctgcaatcctcagggctgtacagcctcagttctgtggtcaccgtgccctccagctcgttaggaacacagacttacatctgcaatgtgaaccataagccttctaataccaaggtcgataaaaaggttgaaccaaaatcctgtgacaagacacatacctgcccgccctgtcctgccccagagctgcttggcggcccctcagtgttcttgtttcctccaaaacccaaggatacgctgatgattagtaggactccggaagtaacatgcgtggtcgtggacgttagccacgaggatcctgaggtgaagttcaactggtatgtcgacggggtggaagtacacaatgcgaaaaccaagccccgggaggaacagtacaactccacttatcgcgttgtgtctgtcctaacagtgctccatcaggattggctgaatggaaaagagtacaagtgtaaagtcagcaacaaggcacttccagcccctatcgaaaagaccatatcaaaggctaagggtcaacccagagagccacaggtgtatacgctgccccctagtagggaggaaatgaccaaaaatcaggtttccttgacatgcctcgtgaagggcttttacccaagcgacatcgccgtagagtgggaatctaacgggcagccggagaataactataaaactacaccccctgtcctggattcagacggaagtttctttttatacagcaagctgaccgtggacaaatcccggtggcaacagggcaacgttttctcttgttcggtgatgcacgaagcactccacaatcattacactcagaaaagcctttccctgtcaccaggt

SEQ ID NO: 23787 - RNA, 654 nt, synthetic construct; identical to SEQ ID NO: 23631
  misc_feature 1..654: note = derived and/or modified sequence opt3 from ThioMAb-huMA79b.v28-HC(A118C)_LightChain
  source 1..654: mol_type = other RNA

SEQ ID NO: 23788 - RNA, 654 nt, synthetic construct
  misc_feature 1..654: note = derived and/or modified sequence opt3 from ThioMAb-huMA79b.v28-LC(V205C)_LightChain
  source 1..654: mol_type = other RNA
gacatcgtgctgacccagagccccgcctccctcgctgtctctcttggccaaagagcaacaatttcatgcaaggccagtcagagcgttgattacgacggggattccttcctgaactggtatcagcagaaacctggacaaccaccgaagttgtttatatacgcggcttctaatttagagtcgggtatccccgccaggttctcaggcagcgggagtggaactgactttacgctgaacattcaccctgtggaagaggaagatgcagccacctattactgtcagcagtccaatgaggacccactaacattcggcgctggtactgaactcgagctgaaacggaccgtagcagccccctctgtgtttatcttccctccaagcgatgagcagcttaagtccgggacagcttcagtcgtgtgcctgttgaacaatttttatccccgcgaagccaaagttcaatggaaggtggacaacgcgctccagagtggaaatagccaggagtctgtcaccgaacaggattccaaggactcaacttacagcctgagttctacactgaccctctccaaagcagattatgagaagcataaagtgtacgcctgtgaggtaacgcaccaaggcttaagctcgccttgcactaagtctttcaaccgaggcgaatgt

SEQ ID NO: 23789 - RNA, 1332 nt, synthetic construct
  misc_feature 1..1332: note = derived and/or modified sequence opt3 from Ticiliuab_HeavyChain1
  source 1..1332: mol_type = other RNA
caggtgcaactggtcgagagcggcgggggagttgtgcagcccggtagatccctcaggctttcttgcgccgcttcaggcttcacctttagtagctacgggcactgggtacggcaggcacctggaaagggcctggaatgggtggccgtcatctggtatgacggttccaacaaatactatgcggattctgtgaaggggcgcttcacaatttcgcgagacaatagcaaaaacactttgtacttacagaatagcctgcgtgctgaggatacggccgtttattactgtgcaagagacccaaggggagccaccctatattactactattacggcgatgtgtggggccaagggacaactgtcaccgtgagttccgcttctacaaagggaccgagcgtatttcccctcgcaccttgctcccggtcaaccagtgaaagcactgccgctctgggttgtcttgttaaagactatttcccagagcccgtgacagtctcttggaactccggcgccctgacctcaggggtgcatacgtttcctgcggtgttgcagagcagtggactctactctctgtccagcgtcgttactgtgccatcgtctaatttcggcacccagacatatacttgcaacgtagatcacaagccctccaataccaaggtggacaaaacagtcgaacgcaagtgttgcgtggagtgtcctccatgcccggcaccccctgttgccggtccatcagtgtttctgtttccccctaaaccaaaggataccctcataagtagaacgcccgaggtcacttgtgtggtagttgacgtgagccatgaagatccggaggtccagtttaactggtacgtggacggggtcgaagtgcacaatgctaaaacaaagcctagggaggagcaattcaactccacctttcgggttgtgtctgtattaactgtcgtgcatcaggattggctgaatggaaaggaatataaatgcaaggttagcaacaaaggccttcccgccccaatcgagaagacaatttcaaaaaccaagggccagcctcgcgaaccccaggtgtacacgttgccacccagtcgagaggaaaccaaaaatcaagtctccctgacatgtctagtgaaggggttctaccctagcgacatcgcagtagagtgggagtctaacggacagccagaaaataactataagactaccccgcccctcgactcagatggtagtttcttcctgtacagcaaacttacagtggacaagtccagatggcagcaaggcaacgttttctcttgctcggtccacgaggctctgcacaatcattatactcagaaatcattgtccctctcacctgggaag

SEQ ID NO: 23790 - RNA, 639 nt, synthetic construct
  misc_feature 1..639: note = derived and/or modified sequence opt3 from Ticiliuab_LightChain1
  source 1..639: mol_type = other RNA
gacatccagacccaaagcccctcctctctgtcagccagtgtgggcgatagagtcacaattacttgcagggctagccagtccataaactcttacctcgactggtatcagcagaagcctgggaaagcaccaaaacttctgatctacgccgcgtcgtcattgcaaagcggagttccgagtcggttctccggttctggcagcgggacggattttaccttaacaatttcctcactgcagcccgaggacttcgctacttattactgtcagcagtattacagtaccccttttacattcggaccaggcaccaaggtggaaatcaagcgcactgtagccgcacccagcgtgtttattttccctccatctgatgagcaactaaaatccggtacagcctcagtcgtgtgcctcctgaataacttttatccccgagaagctaaggttcagtggaaggtggacaatgcacttcagagcgggaacagtcaggagtctgtcaccgaacaagattccaaagacagcacgtactcgctgtcttccactttgaccctctcaaaggccgattacgagaaacacaaggtgtatgcttgtgaggtaacacatcagggactgagtagccctgttactaaatccttcaatcgtggcgaatgc

SEQ ID NO: 23791 - RNA, 1347 nt, synthetic construct
  misc_feature 1..1347: note = derived and/or modified sequence opt3 from Tigatuzumab_HeavyChain1
  source 1..1347: mol_type = other RNA
gaggtgcagctggtcgaaagcggcgggggactcgttcaacccggtggctcccttagactgtcttgcgccgcttcagggttcacctttagtagctacgtgatgtcctgggtaaggcaggcacctggaaagggcttggagtgggtggccacaatctcttcgggtgggtcatatacttactatccagacagcgtcaaaggacggttcacgattagtcgcgataacgcgaagaataccttatacctgcagatgaactccctacgagctgaagacacagccgtgtattactgtgcacgtagaggcgattctatgataactaccgactattggggccaggggacactcgttaccgtgagctccgcctcaactaaaggaccgagtgtctttcccctggctcctagctctaagtccacatcaggtggcaccgcagcccttgggtgcctggtgaaagattacttcccagagcccgtaacggttagctggaatagtggagctttgacttctggcgtgcacacctttcctgccgtcctccaatccagcggtctgtactcgctgtcttccgtggtgacagtcccatcaagtagcctcgggactcagacctatatctgtaacgttaatcataagccctccaacacaaaggtggacaaaagggtagaacctaagtcttgcgataaaacccacacgtgtccaccgtgccccgcgcctgagttactgggaggcccaagcgtgttcctttttccccctaagccaaaagacactttgatgatttcacggacacccgaggtcacctgtgtggttgtggatgtcagtcatgaagacccggaggtgaagttcaattggtacgtagatggcgttgaagtgcacaacgcaaagactaaacctcgcgaggagcagtataattccacatacagagtcgtgagcgtcctgaccgtgctacatcaggactggctcaacgggaaggaatataaatgcaaggtttctaataaagccctgcccgctccaatcgagaagacgatttcaaaagccaagggacaacctagggaaccccaggtgtacacccttccacccagtcgggaggaaatgacaaagaaccaggtaagcctgacttgtttggtcaaaggtttttatccttccgatatcgcagtggagtgggagtctaatggccagccagaaaacaattacaagaccacaccgcccgttctcgactcggacgggagcttctttctgtactccaaattaactgtggataagtcacgctggcaacagggaaacgtcttcagttgctctgtgatgcacgaggctctgcacaaccattatacccagaaaagcctctccctttcacctggcaag

SEQ ID NO: 23792 - RNA, 1347 nt, synthetic construct; identical to SEQ ID NO: 23791
  misc_feature 1..1347: note = derived and/or modified sequence opt3 from Tigatuzumab_HeavyChain
  source 1..1347: mol_type = other RNA

SEQ ID NO: 23793 - RNA, 639 nt, synthetic construct
  misc_feature 1..639: note = derived and/or modified sequence opt3 from Tigatuzumab_LightChain1
  source 1..639: mol_type = other RNA
gacatccagatgacccaaagcccctcctctctgtcagccagtgtgggcgatagagtcacaattacttgcaaggctagccaggacgttgggacggcagtggcctggtaccagcagaaacctggaaaggcgccaaaactccttatatattgggcttccaccaggcacacaggtgtaccgtctcggttctcgggctcagggagcggaactgattttaccctgacaatcagttccttgcaacccgaggacttcgccacctactattgtcagcagtactctagctatcgcacttttggccagggtacaaaggtggaaattaaacgaaccgtcgcagccccttccgtgttcatctttccaccctcagatgagcaattaaagagtgggacggctagcgttgtgtgcctgctaaacaatttctaccctcgtgaagcaaaggtccagtggaaagtggacaacgccctccagtctggaaattcccaggagtcagtaactgaacaagatagcaaggacagtacctattctctgtccagcacacttactctgtcgaaagctgattacgagaagcataaagtttacgcctgtgaggtgacccaccagggcttgtcttccccagtcacaaagtcatttaacagaggcgaatgc

SEQ ID NO: 23794 - RNA, 639 nt, synthetic construct; identical to SEQ ID NO: 23793
  misc_feature 1..639: note = derived and/or modified sequence opt3 from Tigatuzumab_LightChain
  source 1..639: mol_type = other RNA

SEQ ID NO: 23795 - RNA, 1338 nt, synthetic construct
  misc_feature 1..1338: note = derived and/or modified sequence opt3 from Tildrakizumab_HeavyChain1
  source 1..1338: mol_type = other RNA
caggtgcaactggtccagagcggcgccgaggttaagaaacccggggcttccgtgaaggtatcttgcaaagcatcaggatacatcttcattacctattggatgacatgggtgagacaggcccctggtcagggcctcgaatggatggggcaaatatttccagcgagtggaagcgctgactacaacgagaagttcgaaggcagggtcactatgacgaccgatacatccacttctaccgcctatatggagcttcggtcgctgcgctcagacgatacagcagtgtactattgtgcccgaggtgggggaggctttgcttactggggccaggggaccttggttactgtgagcagtgcatccacaaaaggaccgtctgtcttccccttagcccctagctccaagtcaaccagtggtggcacggctgccctggggtgcctagtgaaggactattttccagaacccgtaactgttagctggaactctggagcgctcacctccggcgtgcacacattccctgcagtcctgcagtcaagcggtctttacagtctgtcttccgtggtgactgtcccaagctcgtctttggggacccagacatacatctgtaatgttaatcataaaccctccaacaccaaggtggataaaaaggtagagcctaaatcatgcgacaagacgcacacttgtccaccgtgccccgcccctgagctcctgggaggcccaagtgtgtttctgtttccccctaagccaaaagatacactcatgattagccgtacccccgaagtcacttgtgtggttgtggacgtctcccatgaggatccggaagtgaagttcaattggtatgtagacggcgttgaggtgcacaacgctaaaacaaagcctagagaggaacaatacaattctacctatagggtcgtgagcgtcttaacggtgctgcatcaggattggcttaacgggaaagagtacaagtgcaaagtttcaaataaggccttgcccgcaccaatcgaaaagaccattagtaaagctaagggacagcctcgggagccccaggtgtatacactgccaccctcccgcgacgaactaactaaaaaccaagtaagcctcacctgtctggtcaagggtttctacccttctgatatcgccgtggagtgggagtcaaatggccagccagaaaacaattataaaacaactccgcccgttcttgacagtgacgggagctttttcctgtactccaagttgaccgtggataagtctagatggcagcaaggaaacgtcttttcgtgcagcgtgatgcacgaggcgctccacaatcattacacacagaaatccctgtcattaagtcctggcaag

SEQ ID NO: 23796 - RNA, 642 nt, synthetic construct
  misc_feature 1..642: note = derived and/or modified sequence opt3 from Tildrakizumab_LightChain1
  source 1..642: mol_type = other RNA
gacatccagatgacccaaagcccctcctctctgtcagccagtgtgggcgatagagtcacaattacttgcaggacgagcgagaacatatactcctatctcgcttggtaccagcagaagcctgggaaagcaccaaaacttctgatctataatgccaagaccttggcggaaggagttccgtctcggttctcgggttcaggcagcgggacagactttactttaaccattagttccctgcagcccgaggatttcgctacatactattgtcaacaccattacggaatcccttttaccttcggccagggtactaaggtggaaattaaacgcacagtagccgcaccatctgtgtttatctttccccctagcgacgagcagctaaagtccgggaccgcctcagtcgtgtgcctcctgaacaatttctatccacgagaagctaaggttcagtggaaagtggataacgcacttcaaagtggaaatagccaggagtctgtcacggagcaggactccaaggattcaacttacagcctgagttctaccttgacactctccaaagccgactacgaaaagcacaaagtgtatgcttgtgaggtaactcatcagggcctgagctcgcccgttaccaagtctttcaaccgtggcgaatgc

SEQ ID NO: 23797 - RNA, 1344 nt, synthetic construct
  misc_feature 1..1344: note = derived and/or modified sequence opt3 from Tisotumab_vedotin_HeavyChain1
  source 1..1344: mol_type = other RNA
gaggtgcagctgctcgaaagcggcgggggacttgtccaacccggtggctccctgagattgtcttgcgccgcttcagggttcacctttagtaactacgcaatgagctgggttaggcaggcccctggaaagggcttagagtgggtgtcctctatctcgggttcaggggactatacatactatactgatagcgtaaaaggacggttcacgattagtcgcgacaattccaagaacaccctgtacctacagatgaatagcctccgagcggaagatacagctgtgtattactgtgcccgttctccatggggctattacctggactcctggggccaggggactcttgtcaccgtgtcaagtgcaagcacaaaaggaccgtctgtttttcccctggccccttcctcaaagagcaccagtggtggcactgctgcattggggtgcctcgtgaaagattacttcccagagcccgtcacagtgtcttggaactccggagccctgaccagcggcgtacacacgtttcctgctgttctgcaatcgtctggtctctattccttatcaagtgtggtcactgtgccaagctcctctctggggacccagacatacatatgtaatgtgaaccataagcccagcaatactaaggtcgacaaaagagttgaacctaagtcatgcgataaaacccacacatgtccaccgtgccccgcccctgagcttttgggaggcccaagtgtgttcctgtttccccctaagccaaaagacaccctaatgatctccaggacgcccgaggtaacttgtgtggtcgtggatgttagccatgaagacccggaggtgaagttcaactggtatgtcgatggcgtggaagtacacaatgcgaagacaaaacctcgggaggagcagtacaactctacctatcgcgttgtgtcagtcctcactgtgctgcatcaggactggcttaatgggaaggaatacaaatgcaaggtcagtaacaaagcactgcccgccccaattgagaagacaatcagcaaagctaagggacaacctagagaaccccaggtgtataccttgccaccctccagggaggaaatgacgaagaatcaggtttctctcacctgtctggtgaaaggtttttacccttcggatattgccgtagagtgggagagcaacggccagccagaaaataactacaagacaactccgcccgtcttagactccgacgggtcattctttctgtatagtaaactcaccgtggataagtctcggtggcaacagggaaacgttttcagctgctccgtgatgcacgaggcacttcacaatcattacacacagaaatcactgagcttgtctcctggcaag

SEQ ID NO: 23798 - RNA, 642 nt, synthetic construct
  misc_feature 1..642: note = derived and/or modified sequence opt3 from Tisotumab_vedotin_LightChain1
  source 1..642: mol_type = other RNA
gacatccagatgacccaaagccctccctccctgtctgcctcagctggcgatagagtgacaattacttgcagggcaagtcaggggataagctcccggctcgcctggtaccagcagaagccagagaaagcgccgaagtctcttatctatgctgcctcgtcactgcaaagcggagtccccagtcgcttctccggttctggcagcgggacggactttaccttgacaatttcctcattacagcctgaagatttcgcaacttactattgtcagcagtacaacagttatccatacacctttggacaaggcacaaaactggagatcaagcgaaccgttgccgctcccagcgtgttcatttttcctccatctgacgaacagctaaaatccggtactgcatcagtagtgtgcctcctgaataacttctatccccgtgaggccaaggtccagtggaaggtggataatgcccttcagagcgggaacagtcaagaatctgttacagagcaggactccaaagatagcacctactcgctgtcttccacgttgactctctcaaaggctgactacgagaaacacaaggtgtatgcgtgtgaagtcacccatcagggactgagtagccctgtgacaaaatcctttaatagaggcgagtgc

SEQ ID NO: 23799 - RNA, 1341 nt, synthetic construct
  misc_feature 1..1341: note = derived and/or modified sequence opt3 from Tocilizumab_HeavyChain1
  source 1..1341: mol_type = other RNA
gtgcagctgcaagagagcggccccgggctcgtcagaccttcccagaccctttctctgacatgcactgtttcaggatacagtatcacgagcgaccacgcctggtcctgggtgaggcagccaccgggtcggggcttggaatggattgggtatatatcttactcgggaatcaccacatataacccctcattaaaaagccgcgtaactatgctgcgagataccagtaaaaatcagttctccctacgtctctctagcgtgacagctgcagacaccgccgtctactattgtgcgagatccctggctaggactacagccatggattactggggccaaggttcacttgtgaccgttagtagcgcatctacgaaggggccttccgtgtttccactggccccctcaagcaaaagtacttctggaggcaccgctgcattgggctgcctcgtcaaggactatttccctgagccagtgacagtatcctggaacagcggggccctgacttcgggagttcatacctttcccgctgtgctgcagtcttccggtctctactcattaagtagcgtcgtgacagtgccttcctctagcctgggcacccagacgtacatttgtaatgtcaaccacaaaccatcaaatactaaggttgataagaaagtggaaccgaagagttgcgacaaaacacatacctgtcccccttgcccagcccccgagcttttgggagggccttccgtattcctgtttccacccaagccgaaagatactctaatgatcagccggacacctgaagtgacctgtgtcgtggttgacgtgtctcacgaggatcccgaggtcaagttcaactggtatgtggacggcgtagaagttcataatgcgaagacgaaaccacgcgaggaacagtacaactcaacctatagagtggtcagtgtgctcacagtcctgcaccaagattggcttaatggtaaggagtacaaatgcaaggtgagcaacaaagcactgcctgcccccattgagaagactatctccaaagctaaggggcagccaagggaaccccaggtttataccttgcctccatctcgggacgagctcacaaagaatcaggtgtcgctgacttgtttagtaaaaggattttacccgagcgatatagccgtcgaatgggagtccaacggccaacccgaaaataactataagaccacacctccagtgctggactcagacggcagtttctttctctactctaaacttaccgttgataagagccgctggcagcaggggaatgtgttctcctgctcagtcatgcacgaggcactgcataaccactacactcaaaagagcttgtctctatcccccgga

SEQ ID NO: 23800 - RNA, 642 nt, synthetic construct
  misc_feature 1..642: note = derived and/or modified sequence opt3 from Tocilizumab_LightChain1
  source 1..642: mol_type = other RNA
gacatccagatgacccaaagcccctcctctctgtcagccagtgtgggcgatagagtcacaattacttgcagggctagccaggacatatcctcttacctcaactggtatcagcagaagcctgggaaagcaccaaaacttctgatctactatacgtcgcggttgcactcaggagttccgagccgcttcagtggttccggctctgggaccgattttacattcactattagctccttacaacccgaggacatcgccacctactattgtcagcagggaaatacactgccttacacctttggccagggtactaaggtggaaattaagcgaacagtagcggctccatcagtgttcatctttccccctagtgatgagcaactaaaaagcgggaccgcctctgtcgtgtgcctcctgaacaatttctatccacgtgaagcaaaggttcagtggaaggtggacaacgcccttcagtccggaaattcacaggagagcgtcacggaacaagatagtaaagactctacttactccctgagctcgaccttgacactctctaaggctgattacgagaaacataaggtgtatgcatgtgaggtaactcaccagggcctgtcctcacccgttaccaaaagttttaacagaggcgaatgc

SEQ ID NO: 23801 - RNA, 1353 nt, synthetic construct
  misc_feature 1..1353: note = derived and/or modified sequence opt3 from Tosatoxumab_HeavyChain1
  source 1..1353: mol_type = other RNA
gaagtgcagatggtccaaagcggcgccgaagttaagaaacccggggagcctctgaagatctcctgcaaaggatctggttacaagttcggcacccactggattgggtgggtgagacagaggccaggaaaaggcctcgaatggatgggtataatccatccggctgactcagagacaaagtatagtcccagctttcaggggcaggtatccttctctgcagataagtcgtcaaacactgcctaccttcactggagcacgctgcgggcgagtgacaccgctatgtattactgtgcccgccgatccggatctagctcctggtatgcattggatttttggggccaaggcacaatggtgactgtctcaagtgccagcaccaaagggccttctgtgttcccattagctccctcctcaaagagcacaagtggaggtaccgcagccctgggctgcctagttaaagactactttcctgaaccagtgactgtctcttggaactccggggctctcacaagcggagtgcataccttccccgccgtactgcagtcgtctggcctttattccctgtcaagtgttgtgacggtccctagctcctctttgggtactcagacctacatttgtaatgtgaatcacaagccaagcaacacaaaagtggataagcgtgtcgagccgaagtcatgcgacaaaactcatacctgtcccccttgcccagcgcccgagctcctcgggggacctagtgtttttctgttcccacccaagccgaaagatacactgatgatctccagaacccctgaagtgacgtgtgtagtggtcgacgtgagccacgaggatcccgaagttaagtttaattggtacgtggacggcgtcgaggtgcacaacgcaaaaactaagccaagggaggaacagtataattctacataccgggtagtttcagtgttaaccgtcctgcatcaagattggcttaacggcaaagagtataagtgcaaggtgagtaataaagccttgcctgctcccattgaaaagactatcagcaaagccaaggggcagccacgcgagccccaggtctacacactgcctccatccagagaagagatgaccaaaaaccaggtgtctctaacgtgtctcgttaagggattctatccgtcggacatagcagtggagtgggaaagcaatggtcaacccgagaacaattacaagaccacacctccagtactggattccgacggctcatttttcctttatagtaaactgactgtcgacaagtctaggtggcagcaggggaacgtgtttagctgctccgttatgcacgaggctttgcataatcactacacccaaaaatcactcagcctgtctcccggaaag

SEQ ID NO: 23802 - RNA, 651 nt, synthetic construct
  misc_feature 1..651: note = derived and/or modified sequence opt3 from Tosatoxumab_LightChain1
  source 1..651: mol_type = other RNA
cagagcgtgctgacccaatccccctctgcctcaggcacacctgggcagagagtcactatcagttgcagcggaggttcctctaacattggctcgaatacggttaactggtaccagcagttcccaggggctgcaccgaagctccttatatataccaataaccaaaggccctcaggagtgcctgaccggtttagcggcagtaaatccggtacatctgccagcctggcgatctccgggttgcagtcagaggatgaagctgactactattgtgccacttgggatgacagtttaaatggactgtacgtattcggcaccggcacaaaggtgaccgtcctagggcagccaaaagcaaaccccactgtgacactctttcctccaagctctgaggaactgcaggccaataaggctacccttgtttgcctgatttccgatttctatcccggagcagtgacggtcgcctggaaagctgacggttcacctgtgaaggccggcgtagagactaccaagccaagcaaacaaagtaacaataagtacgcggcatcttcctatttgagcctcacaccggaacagtggaaatcgcaccgctcttactcctgtcaggttactcatgaggggtcaaccgtggagaagacagtcgcccccaccgaatgcagt

SEQ ID NO: 23803 - RNA, 1341 nt, synthetic construct
  misc_feature 1..1341: note = derived and/or modified sequence opt3 from Tositumomab_HeavyChain
  source 1..1341: mol_type = other RNA
caggcctacctgcaacagagcggcgctgagctcgtgagacccggggcatccgtcaagatgtcttgcaaagcctcaggatataccttcacaagttacaacatgcactgggttaagcagactcctaggcagggtcttgaatggatcggcgcgatttatccagggaatggagacacgagctacaaccaaaaatttaagggcaaagctaccctgacagtggataagtcctcttcgactgcctatatgcagttgagctcattaaccagtgaggactccgcagtatacttctgtgcccgggtggtctattactctaatagctactggtattttgatgtgtggggtacagggaccactgttacagtgtccggaccgtcagtcttccccctggctcctagtagcaagtctacctccggcggcacggcagccctagggtgcctcgtgaaagactactttccagaacccgtaactgtttcatggaacagcggagctctgaccagtggtgtgcatacattccctgccgtccttcagtcttccggcctgtatagcttgtcgtctgtggtgactgtcccatcctcaagtctcgggacccagacatacatatgtaatgttaaccacaagcccagcaataccaaagtggataagaaagcggagcctaagtcctgcgacaagacgcatacttgtccaccgtgccccgcacctgaactgctgggaggcccatctgtatttctctttccccctaaaccaaaggatacattaatgatcagccgcacccccgaggtgacttgtgtcgtggttgacgtgtcacacgaggatccggaagtcaaattcaactggtatgtggacggtgtagaggttcataatgccaagacaaaacctcgagaagaacaatacaacagtacctatcgtgtggtctccgtgctgacggtccttcaccaggattggttgaatgggaaggagtacaaatgcaaggtgagcaacaaggctctgcccgccccaattgagaaaaccatctctaaggcaaaaggacagcctagagagccccaggtttacacactaccaccctcaagggacgaactcactaagaatcaagtgagtctgacctgtcttgtaaaaggcttctatcctagcgatattgctgtcgagtgggaatccaacggccagccagagaataactacaagacaactccgcccgtgctggactctgacgggtcgtttttcttgtatagcaagctcaccgttgataaatcccggtggcagcaaggaaacgtgttttcatgcagtgtcatgcacgaggccctgcataatcactacacacagaagtctttaagcctgtcccctggtaaa

SEQ ID NO: 23804 - RNA, 630 nt, synthetic construct
  misc_feature 1..630: note = derived and/or modified sequence opt3 from Tositumomab_LightChain
  source 1..630: mol_type = other RNA
cagatcgtgctgagccaatcccccgccattctctctgcttcacctggcgagaaggtcaccatgacatgcagagcaagtagctccgtttcttacatgcactggtatcagcagaaaccagggtcgtcaccgaagccctggatatacgcccctagcaaccttgcgagtggagtgccagctaggttctccggttctggcagcgggacttcctattcactgacgatcagtcgggtagaagccgaggacgcagccacctactattgtcagcaatggagctttaatccccctacattcggagctggcactaaattggaattaaagcgcaccgtggcagccccatctgtctttatttttcccccttccgatgagcagctgaaatcaggtacagctagcgtggtttgcctactcaacaatttctacccacgagaagccaaggtgcagtggaaggtcgacaacgcgctgcagagtggaaattctcaagagtccgtgaccgagcaggatagcaaagactcgacttattctctttcctcaacactgaccttgagtaaggcagattacgaaaaacataaggtatacgcctgtgaggttacgcaccaggggctcagctccccggtgactaaatctttcaaccgt

SEQ ID NO: 23805 - RNA, 1338 nt, synthetic construct
  misc_feature 1..1338: note = derived and/or modified sequence opt3 from Tovetumab_HeavyChain1
  source 1..1338: mol_type = other RNA
caggtgcaactggtcgagagcggcgggggactcgttaagcccggtggctcccttagactgtcttgcgccgcttcagggttcacctttagtgactactatatgaactggatcaggcaggcacctggaaaaggcttggaatgggtgagctacatttcctcttcgggttcaataatctattacgccgatagcgtaaaggggcggttcacaattagtcgcgacaatgcgaaaaactccttatatctgcagatgaatagtctacgagctgaggatactgccgtgtactattgtgcacgtgaaggaagaatcgccgctaggggcatggacgtctggggccaggggacgaccgtgacagttagctccgcatcaactaagggaccaagtgtgtttccgctcgccccctgcagccggtctacctccgagtcaacagctgccctgggttgtcttgtcaaagattacttccctgaaccagtgaccgtaagctggaacagtggcgcgctgacttctggggttcacacatttcccgcagtgttgcaatccagcggactctactcgctgtcttccgtcgtgaccgtgccttcaagtaatttcggcacgcagacttatacctgcaacgtcgaccataagccaagcaatacaaaggttgataaaactgtggagcgcaagtgttgcgtagagtgtcccccttgcccagccccgcccgtggctggtccttccgtctttctgttcccacccaaacctaaggacaccctcatgatttctagaacaccagaagtgacctgtgttgtggtcgatgtgagccacgaggaccccgaagtacagtttaactggtacgttgatggggtggaggtccataatgccaaaacgaagccgagggaggaacagttcaactcaacttttcgggtggtcagtgtgttaacagttgtgcaccaagactggctgaatggaaaggagtataaatgcaaggtatccaacaaaggccttcctgcacccatcgaaaagaccataagcaaaactaagggccagccacgcgagcctcaggtctacacattgcccccatctcgagaagagatgaccaaaaatcaggtgtcactgacgtgtctagttaaggggttctatcccagtgatatcgctgtggagtgggaaagcaacggacaacctgagaataactacaagaccacaccaccgatgctcgactccgacggttcgtttttcctgtattctaaacttactgtcgataagagcagatggcagcagggcaacgtgttctcctgctcagtaatgcatgaagccctgcacaatcactacacccaaaaatctttgtctctcagccccgggaag

SEQ ID NO: 23806 - RNA, 645 nt, synthetic construct
  misc_feature 1..645: note = derived and/or modified sequence opt3 from Tovetumab_LightChain1
  source 1..645: mol_type = other RNA
gacatccagatgacccaaagcccctcctctctgtcagccagtgtgggcgatagagtcagcattacatgcaggccttcccagtctttctcgcggtacataaactggtatcagcagaagccagggaaagctccgaagctccttatccacgcagcctcaagcctggttggaggtgtgcccagtcgcttttccggctctgggagcggaactgacttcacgttgaccatttcctcattacaacctgaggattttgcgacatactattgtcagcagacttacagtaatccacccatcaccttcggccagggtacacgactggaaatgaaacgtaccgtagctgcccctagcgtgtttattttcccaccctctgacgagcaactaaagtccgggactgcatcagtcgtgtgcctcctgaacaatttttatcctagagaagccaaagttcagtggaaggtggataacgcacttcagagcggaaatagtcaggagtctgtcacagaacaagactccaaggatagcacctactcgctgtcttccacgttgactctctcaaaagctgactatgagaagcataaagtgtacgcctgtgaggtaacccaccagggcctgagtagcccagttacaaagtccttcaacaggggcgaatgc

SEQ ID NO: 23807 - RNA, 1347 nt, synthetic construct
  misc_feature 1..1347: note = derived and/or modified sequence opt3 from Tralokinumab_HeavyChain1
  source 1..1347: mol_type = other RNA
caggtgcaactggtccagagcggcgccgaggttaagaaacccggggcttccgtgaaggtatcttgcaaagcatcaggatacaccttcacaaactatggtctcagttgggtgagacaggcccctggccaggggcttgaatggatgggatggatcagcgcgaataacggcgacactaattacggtcaagagtttcaggggagggtcacgatgaccacagatacttccacctctacagcttatatggaactgcggtcgttgcgctcagacgataccgccgtgtactattgtgcacgagacagcagttcctcttgggcccgttggttctttgatttatggggaagaggcactctggttacagtgagctccgcttcaaccaagggcccaagtgtcttcccgctagcaccctgcagcaggtctacgtccgagtcaactgccgctctcgggtgtctggtgaaagactactttcctgaaccagtaaccgttagctggaacagtggagcccttacatctggtgtgcacactttccccgcggtcctgcagtccagcggcttgtattcgctctcttccgtggtgaccgtcccttcaagtagcctggggacaaagacctacacgtgcaatgttgatcataagccatccaacactaaagtggacaagcgggtagagtctaaatacggacccccttgtccaagctgcccggcacccgagtttctgggcggtccttcagtgttcctctttccacccaagcctaaagatacattaatgattagtcgcaccccagaagtcacttgtgtggttgtggacgtctcccaggaggatcccgaagtgcaattcaattggtatgtagacggggttgaggtgcacaacgccaagacaaagccgagagaggaacagtttaatagcacctacagggtcgtgtctgtcctgacggtgcttcatcaggattggttgaacggaaaagagtataagtgcaaagtttcaaataagggcctgcctagtagcatagagaaaaccatctccaaggctaaaggccagccccgggaaccacaagtgtacacactacctccctctcaggaagagatgactaagaaccaggtatcgctcacctgtctggtcaaggggttctatccaagcgacattgccgtggagtgggaatccaatggacaacccgagaacaattacaaaacaactcctccagttcttgactcagatggtagtttctttctgtattctcgcttgaccgtggacaagagccgatggcaggaaggcaacgtcttctcctgctcagtgatgcacgaggcactccataaccactacacacagaaaagcctgtctttatccctggggaag

SEQ ID NO: 23808 - RNA, 642 nt, synthetic construct
  misc_feature 1..642: note = derived and/or modified sequence opt3 from Tralokinumab_LightChain1
  source 1..642: mol_type = other RNA
agctacgtgctgacccagcccccttccgtctctgttgccccaggcaagacagctagaatcacttgcgggggaaacattataggttcaaaactcgtgcactggtatcaacagaagccgggccaggcacccgtacttgtgatctacgacgatggggacaggcctagtggcattccagagcggttcagcggatccaattctggtaacacggccaccctgacaatctcgcgcgtcgaagcgggggatgaggctgactattactgtcaggtgtgggatactggatcagaccccgttgtgtttggcggcgggaccaaattgacagtcttaggacaacctaaggccgcaccaagcgtgaccctgtttccccctagttccgaggaactacaggccaataaagctactctcgtatgcctgatttctgatttctatccaggtgcagttacagtggcctggaaggctgacagctccccggtcaaggccggcgtggaaaccacgactccctcaaaacagagtaacaataagtacgcggcaagctcttatctttccctgacccctgagcagtggaaatcacatcgaagctacagttgtcaagtgacacacgaggggtctactgtcgaaaagaccgttgccccaacagagtgctcc

SEQ ID NO: 23809 - RNA, 1332 nt, synthetic construct
  misc_feature 1..1332: note = derived and/or modified sequence opt3 from Trastuzuab_HeavyChain1
  source 1..1332: mol_type = other RNA
gaggtgcagctggtcgaaagcggcgggggactcgttcaacccggtggctcccttagactgtcttgcgccgcttcagggttcaacatcaaggacacctacattcactgggtgaggcaggcacctggaaaaggcttggagtgggtagcccggatatatccaacaaatggttacactcgctatgcggatagtgtgaaggggcgatttacgatcagcgctgacacctccaaaaacacagcctacttacagaatagcctgcgtgcagaagatactgccgtctattactgttcgagatggggaggcgacggcttctatgctgattactgggggcagggaaccctagtgacagtttcaagcgcaagtaccaagggtccgtccgtgtttcccctcgccccttctagcaaatccacttcaggcgggacagctgccctgggatgccttgtcaaggactacttcccagagcccgtgaccgtaagttggaacagcggcgcgctgacgtctggtgttcatacttttcctgcagtgttgcaatcctcagggctctatagcctgagttctgtcgtgaccgtgccatccagctcgctgggaacacagacttacatttgtaatgtcaaccacaagccctctaataccaaagttgataagaaagtggaacctaagtcctgcgacaaaacacatacctgtccaccgtgccccgcccctgagctcttaggcggcccatcagtattcctgtttccccctaagccaaaggatacgcttatcagtaggactcccgaggtgacatgtgtcgtggttgacgtgagccacgaagatccggaggtcaaattcaactggtatgtggacggggtagaagttcataatgctaagaccaaacctcgggaggagcagtacaactccacttatcgcgtggtctctgtgttgacagtcctgcaccaggattggctaaatggaaaggaatacaaatgcaaggtgagcaacaaagccctccccgcaccaattgagaagaccatctcaaaggctaaaggtcaacctagagaaccccaggtttatacgctgccacccagtagggaggaaaccaagaatcaggtgtcccttacatgtctggtaaaaggcttttaccctagcgacatagccgtcgagtgggagtctaacgggcagccagaaaataactacaagactaccccgcccgtgttggactcagatggaagtttctttctctatagcaaactgacagttgacaagtcccggtggcaacagggcaacgtgttctcttgctcggtccacgaggcgttacataatcactacactcagaagtctctgtccctctcacctggt

SEQ ID NO: 23810 - RNA, 639 nt, synthetic construct
  misc_feature 1..639: note = derived and/or modified sequence opt3 from Trastuzuab_LightChain1
  source 1..639: mol_type = other RNA
gacatccagacccaaagcccctcctctctgtcagccagtgtgggcgatagagtcacaattacttgcagggctagccaggacgttaacacggcagtggcctggtaccagcagaagcctgggaaagcgccaaagctccttatatattccgcttctttcctgtactcgggagtaccgtcacggtttagcggtagtcgctccggcaccgatttcacattgactatctctagcttacaacccgaggactttgccacctattactgtcagcagcactatacaacccctccaactttcgggcagggaacaaaagtggaaattaagcgaaccgtcgcagccccctccgtgtttatcttccctccatcagatgagcaactgaaaagtggcacggctagcgttgtgtgcctactcaataacttttacccccgtgaagcaaaggtccagtggaaggtggacaatgccctgcagtctggtaactcccaggagtcagtaactgaacaagatagcaaagacagtacctattctctttccagcacactgactttgtcgaaggctgattacgagaaacataaggtttacgcctgtgaggtgacccaccaggggctctcttcccctgtcacaaaatcattcaatagaggagaatgc

SEQ ID NO: 23811 - RNA, 1347 nt, synthetic construct
  misc_feature 1..1347: note = derived and/or modified sequence opt3 from Trastuzumab_emtansine_HeavyChain1
  source 1..1347: mol_type = other RNA
gaggtgcagctggtcgaaagcggcgggggactcgttcaacccggtggctcccttagactgtcttgcgccgcttcagggttcaacatcaaggacacctacattcactgggtgaggcaggcacctggaaaaggcttggagtgggtagcccggatatatccaacaaatggttacactcgctatgcggatagtgtgaaggggcgatttacgatcagcgctgacacctccaaaaacacagcctacttacagatgaatagcctgcgtgcagaagatactgccgtctattactgttcgagatggggaggcgacggcttctatgctatggattactgggggcagggaaccctagtgacagtttcaagcgcaagtaccaagggtccgtccgtgtttcccctcgccccttctagcaaatccacttcaggcgggacagctgccctgggatgccttgtcaaggactacttcccagagcccgtgaccgtaagttggaacagcggcgcgctgacgtctggtgttcatacttttcctgcagtgttgcaatcctcagggctctatagcctgagttctgtcgtgaccgtgccatccagctcgctgggaacacagacttacatttgtaatgtcaaccacaagccctctaataccaaagttgataagaaagtggaacctaagtcctgcgacaaaacacatacctgtccaccgtgccccgcccctgagctcttaggcggcccatcagtattcctgtttccccctaagccaaaggatacgcttatgatcagtaggactcccgaggtgacatgtgtcgtggttgacgtgagccacgaagatccggaggtcaaattcaactggtatgtggacggggtagaagttcataatgctaagaccaaacctcgggaggagcagtacaactccacttatcgcgtggtctctgtgttgacagtcctgcaccaggattggctaaatggaaaggaatacaaatgcaaggtgagcaacaaagccctccccgcaccaattgagaagaccatctcaaaggctaaaggtcaacctagagaaccccaggtttatacgctgccacccagtagggaggaaatgaccaagaatcaggtgtcccttacatgtctggtaaaaggcttttaccctagcgacatagccgtcgagtgggagtctaacgggcagccagaaaataactacaagactaccccgcccgtgttggactcagatggaagtttctttctctatagcaaactgacagttgacaagtcccggtggcaacagggcaacgtgttctcttgctcggtcatgcacgaggcgttacataatcactacactcagaagtctctgtccctctcacctggt

SEQ ID NO: 23812 - RNA, 642 nt, synthetic construct; identical to SEQ ID NO: 23668
  misc_feature 1..642: note = derived and/or modified sequence opt3 from Trastuzumab_emtansine_LightChain1
  source 1..642: mol_type = other RNA

SEQ ID NO: 23813 - RNA, 1347 nt, synthetic construct; identical to SEQ ID NO: 23811
  misc_feature 1..1347: note = derived and/or modified sequence opt3 from Trastuzumab_HeavyChain1
  source 1..1347: mol_type = other RNA

SEQ ID NO: 23814 - RNA, 1353 nt, synthetic construct
  misc_feature 1..1353: note = derived and/or modified sequence opt3 from Trastuzumab_HeavyChain
  source 1..1353: mol_type = other RNA
gaggtgcagctggtcgaaagcggcgggggactcgttcaacccggtggctcccttagactgtcttgcgccgcttcagggttcaacatcaaggacacctacattcactgggtgaggcaggcacctggaaaaggcttggagtgggtagcccggatatatccaacaaatggttacactcgctatgcggatagtgtgaaggggcgatttacgatcagcgctgacacctccaaaaacacagcctacttacagatgaatagcctgcgtgcagaagatactgccgtctattactgttcgagatggggaggcgacggcttctatgctatggattactgggggcagggaaccctagtgacagtttcaagcgcaagtaccaagggtccgtccgtgtttcccctcgccccttctagcaaatccacttcaggcgggacagctgccctgggatgccttgtcaaggactacttcccagagcccgtgaccgtaagttggaacagcggcgcgctgacgtctggtgttcatacttttcctgcagtgttgcaatcctcagggctctatagcctgagttctgtcgtgaccgtgccatccagctcgctgggaacacagacttacatttgtaatgtcaaccacaagccctctaataccaaagttgataagaaagtggaacctccaaagtcctgcgacaaaacacatacctgtccgccctgccctgccccagagctcttaggcggcccctcagtattcctgtttcctccaaagcccaaggatacgcttatgatcagtaggactccggaggtgacatgtgtcgtggttgacgtgagccacgaagatcctgaggtcaaattcaactggtatgtggacggggtagaagttcataatgctaagaccaaaccccgggaggagcagtacaactccacttatcgcgtggtctctgtgttgacagtcctgcaccaggattggctaaatggaaaggaatacaaatgcaaggtgagcaacaaagccctcccagcacctattgagaagaccatctcaaaggctaaaggtcaacccagagaaccacaggtttatacgctgccccctagtagggacgagcttaccaagaatcaggtgtccctgacatgtttggtaaaaggcttttacccaagcgacatagccgtcgaatgggagtctaacgggcagccggagaataactacaagactacaccccctgtgctcgattcagacggaagtttctttctgtatagcaaattaaccgttgataagtcccggtggcaacagggcaacgtgttctcttgctcggtcatgcacgaagcgctgcataatcactacactcagaagtctctctccctttcaccaggtaaa

SEQ ID NO: 23815 - RNA, 660 nt, synthetic construct
  misc_feature 1..660: note = derived and/or modified sequence opt3 from Trastuzumab_HeavyChain_variant_1n8z_B
  source 1..660: mol_type = other RNA
gaggtgcagctggtcgaaagcggcgggggactcgttcaacccggtggctcccttagactgtcttgcgccgcttcagggttcaacatcaaggacacctacattcactgggtgaggcaggcacctggaaaaggcttggagtgggtagcccggatatatccaacaaatggttacactcgctatgcggatagtgtgaaggggcgatttacgatcagcgctgacacctccaaaaacacagcctacttacagatgaactctctgcgtgcagaagatactgccgtctattactgttcgagatggggaggcgacggcttctatgctatggattactgggggcagggaaccctagtgacagtttcaagcgcaagtaccaagggtccgtccgtgtttcccctcgccccttctagcaaatccacttcaggcgggacagctgccctgggatgccttgtcaaggactacttcccagagcccgtgaccgtaagttggaatagcggcgcgctgacgtctggtgttcatacttttcctgcagtgttgcaatcctcagggctctatagcctgagttctgtcgtgaccgtgccatccagctcgctgggaacacagacttacatttgtaatgtcaaccacaagccctctaataccaaagttgataagaaagtggaacct

SEQ ID NO: 23816 - RNA, 45 nt, synthetic construct
  misc_feature 1..45: note = derived and/or modified sequence opt3 from Trastuzumab_HeavyChain_variant_7637_H
  source 1..45: mol_type = other RNA
gagcccaagagctgcgacaaaacccacacatgtcctccatgcccg

SEQ ID NO: 23817 - RNA, 642 nt, synthetic construct; identical to SEQ ID NO: 23668
  misc_feature 1..642: note = derived and/or modified sequence opt3 from Trastuzumab_LightChain1
  source 1..642: mol_type = other RNA

SEQ ID NO: 23818 - RNA, 642 nt, synthetic construct; identical to SEQ ID NO: 23668
  misc_feature 1..642: note = derived and/or modified sequence opt3 from Trastuzumab_LightChain_variant_1n8z_A
  source 1..642: mol_type = other RNA

SEQ ID NO: 23819 - RNA, 642 nt, synthetic construct; identical to SEQ ID NO: 23668
  misc_feature 1..642: note = derived and/or modified sequence opt3 from Trastuzumab_LightChain_variant_7637_L
  source 1..642: mol_type = other RNA

SEQ ID NO: 23820 - RNA, 1344 nt, synthetic construct
  misc_feature 1..1344: note = derived and/or modified sequence opt3 from TRC-105_HeavyChain1
  source 1..1344: mol_type = other RNA
gaggtgaagctggaagagagcggcgggggactcgtccagcccggtggctccatgaaactttcttgcgccgcttcagggttcacctttagtgacgcatggatggattgggttagacaaagccctgaaaagggactggagtgggtggccgaaatcaggtccaaagcgtctaaccacgctacatactatgccgagtcggtaaagggccggttcactatttcacgcgacgatagcaaaagttccgtgtacttgcagatgaatagcttacgagcagaggacacgggtatatattactgtacccgttggagaaggtttttcgattcttgggggcagggaacaactctgaccgtctcctcagccagtacaaagggcccaagcgtgtttccgctagctccctcttccaagtcaaccagcggcgggactgcagccctcggatgcctggttaaagactatttccctgaaccagtgacagtcagttggaactctggtgctcttacctccggcgtgcatacgtttcccgccgtactgcagagctcggggttgtactctctctcctcagttgtgactgtccctagtagctccctgggaacccaaacatatatctgtaatgtgaaccacaagccatctaatactaaagtggataagaaagtcgagcccaagagctgcgacaagacccatacatgtcctccatgcccggcgcccgaactgctcggcggtccttcagttttcttatttccacccaaacctaaggataccctgatgattagtcggacgccagaggtgacttgtgtagtggtcgacgtgtcccacgaggatcccgaagttaaattcaactggtacgtggacggggtcgaggtgcataatgcaaagacaaaaccgcgcgaggaacagtacaacagcacctatagagtagtttctgtgcttactgtcttgcaccaggattggctgaatggaaaggaatacaaatgcaaggtgtcaaacaaggccctacctgctcccatcgagaaaacaattagtaaggccaaaggccagccaagggagcctcaagtctataccttacccccaagccgggacgaactgacgaagaatcaggtgtcccttacctgtctggttaaaggcttttacccctctgacatcgcagtggagtgggaatcgaacgggcagcctgagaataactataagacaactccaccggtattggatagcgacggatccttctttctctactcaaagctgaccgtcgataaaagtcgctggcagcaaggtaatgtgttctcttgcagcgttatgcacgaagctctccataaccactatacacagaagtccctgtcactcagccccggcaaa

SEQ ID NO: 23821 - RNA, 639 nt, synthetic construct
  misc_feature 1..639: note = derived and/or modified sequence opt3 from TRC-105_LightChain1
  source 1..639: mol_type = other RNA
cagatcgtgctgagccaatcccccgccattctctctgcttcacctggcgagaaggtcaccatgacatgcagagcaagtagctccgtttcttacatgcactggtatcagcagaaaccagggtcgtcaccgaagccctggatatacgccactagcaaccttgcgagtggagtgcctgtaaggttctccggttctggcagcgggacgtcctattcactgaccatcagtcgggtggaagctgaggacgccgcaacatactattgtcagcaatggagctctaatccattgacttttggagccggcaccaaattagaactgaagcgcacagtcgctgcaccctccgtgttcatttttcctccatcagatgagcagctaaaaagcggtaccgccagtgttgtgtgcctcctgaacaatttctacccccgagaagctaaggtccagtggaaggtggacaacgcccttcagtctgggaatagccaagagagcgtaactgagcaggattcgaaagactctacatattccctgtcaagtaccttgacgctcagcaaggcggattacgaaaaacataaggtttacgcatgtgaggtgactcaccagggactgtcctctcctgtcaccaaatcctttaaccgtggcgaatgc

SEQ ID NO: 23822 - RNA, 1362 nt, synthetic construct
  misc_feature 1..1362: note = derived and/or modified sequence opt3 from Tregalizumab_HeavyChain1
  source 1..1362: mol_type = other RNA
gaggaacagctggtggagagcggcgggggactcgtcaagcccggtggctcccttagactgtcttgcgccgcttcagggttcagttttagcgactgtaggatgtactggttgcggcaagcacctggaaaaggcttagaatggatcggtgttatttccgtgaagtctgagaactatggggccaattacgcggaatcggtacgcggacgattcaccatatcacgtgatgacagcaaaaacacagtgtatctgcagatgaatagtctaaagactgaggatacggctgtctactattgctccgcctcttactatagatacgacgtgggcgcatggtttgcctactggggccaggggaccctcgttacagtgagctccgcttcaactaaaggaccaagtgtcttcccgctggcacccagctctaagtccacctcaggtggcacagccgctcttgggtgtctggtgaaggattattttcctgagccagtaaccgttagctggaacagtggagccttgacttctggcgtgcacacattccccgcggtcctccagtccagcggtctgtactcgctgtcttccgtggtgaccgtcccttcaagtagcctcgggacgcaaacttatatctgcaatgttaaccataaaccatccaataccaaggtggacaaaaaggtagaacccaaatcttgtgataagacacacacttgccctccatgtccggcacccgagttactgggaggccctagcgtgtttcttttcccacccaagcctaaagacaccttgatgatttcaaggacaccagaagtaacctgcgtggttgtggatgtcagtcatgaggaccccgaggtgaagtttaactggtacgtagatggcgttgaagtgcacaatgccaaaacgaagccgcgggaggaacagtataactccacttaccgcgtcgtgagcgtcctgacagtgctacatcaggactggctcaatgggaaagagtataagtgtaaagtttctaacaaggctctgcctgcccccatcgaaaagaccatttcaaaagcaaagggacagccaagagagcctcaagtgtacactcttcccccaagtagggatgagctgaccaaaaatcaggtcagcttgacatgcctcgtcaagggtttctacccctccgacatcgctgtggaatgggagtctaacggccagcctgaaaataactataaaacgaccccaccggttctggactcggatgggagctttttcttatactccaagctgacagtggacaagtcacggtggcagcaaggaaacgtctttagttgttctgtgatgcacgaggccctccacaatcattatactcagaaaagcctttccctgtcacccggcaag

SEQ ID NO: 23823 - RNA, 654 nt, synthetic construct
  misc_feature 1..654: note = derived and/or modified sequence opt3 from Tregalizumab_LightChain1
  source 1..654: mol_type = other RNA
gacatcgtgatgacccagagccccgattccctggccgtctctctcggcgagagagctacaattaactgcagggcatcaaagagtgttagcacttccgggtactcttatatatactggtatcaacagaaacctggacagccaccgaaacttctgatctacttggcctcgattttagaatcaggtgtgcccgaccggttcagcggcagtgggtccggaacggattttaccctgacaatctctagcctacaggcggaggacgtagctgtgtattactgtcaacactcccgcgaactcccttggactttcggccagggtaccaaggtcgagattaagcgaacagtggccgcaccatcagtttttatctttccccctagtgatgaacagctgaaaagcgggaccgcctctgtggtctgccttctgaataacttctatccacgtgaggctaaggtgcagtggaaggtagacaatgcattgcaatccggaaactcacaggagagcgttactgaacaggatagtaaagactctacatactccctcagctcgaccctgacgctgtctaaggccgattacgagaaacataaggtgtatgcttgtgaagtcactcaccagggcctctcctcacccgtgaccaaaagtttcaatagaggcgagtgc

SEQ ID NO: 23824 - RNA, 1353 nt, synthetic construct
  misc_feature 1..1353: note = derived and/or modified sequence opt3 from Tremelimumab_HeavyChain1
  source 1..1353: mol_type = other RNA
caggtgcaactggtcgagagcggcgggggagttgtgcagcccggtagatccctcaggctttcttgcgccgcttcaggcttcacctttagtagctacgggatgcactgggtacggcaggcacctggaaagggcctggaatgggtggccgtcatctggtatgacggttccaacaaatactatgcggattctgtgaaggggcgcttcacaatttcgcgagacaatagcaaaaacactttgtacttacagatgaatagcctgcgtgctgaggatacggccgtttattactgtgcaagagacccaaggggagccaccctatattactactattacggcatggatgtgtggggccaagggacaactgtcaccgtgagttccgcttctacaaagggaccgagcgtatttcccctcgcaccttgctcccggtcaaccagtgaaagcactgccgctctgggttgtcttgttaaagactatttcccagagcccgtgacagtctcttggaactccggcgccctgacctcaggggtgcatacgtttcctgcggtgttgcagagcagtggactctactctctgtccagcgtcgttactgtgccatcgtctaatttcggcacccagacatatacttgcaacgtagatcacaagccctccaataccaaggtggacaaaacagtcgaacgcaagtgttgcgtggagtgtcctccatgcccggcaccccctgttgccggtccatcagtgtttctgtttccccctaaaccaaaggataccctcatgataagtagaacgcccgaggtcacttgtgtggtagttgacgtgagccatgaagatccggaggtccagtttaactggtacgtggacggggtcgaagtgcacaatgctaaaacaaagcctagggaggagcaattcaactccacctttcgggttgtgtctgtattaactgtcgtgcatcaggattggctgaatggaaaggaatataaatgcaaggttagcaacaaaggccttcccgccccaatcgagaagacaatttcaaaaaccaagggccagcctcgcgaaccccaggtgtacacgttgccacccagtcgagaggaaatgaccaaaaatcaagtctccctgacatgtctagtgaaggggttctaccctagcgacatcgcagtagagtgggagtctaacggacagccagaaaataactataagactaccccgcccatgctcgactcagatggtagtttcttcctgtacagcaaacttacagtggacaagtccagatggcagcaaggcaacgttttctcttgctcggtcatgcacgaggctctgcacaatcattatactcagaaatcattgtccctctcacctgggaag

SEQ ID NO: 23825 - RNA, 642 nt, synthetic construct
  misc_feature 1..642: note = derived and/or modified sequence opt3 from Tremelimumab_LightChain1
  source 1..642: mol_type = other RNA
gacatccagatgacccaaagcccctcctctctgtcagccagtgtgggcgatagagtcacaattacttgcagggctagccagtccataaactcttacctcgactggtatcagcagaagcctgggaaagcaccaaaacttctgatctacgccgcgtcgtcattgcaaagcggagttccgagtcggttctccggttctggcagcgggacggattttaccttaacaatttcctcactgcagcccgaggacttcgctacttattactgtcagcagtattacagtaccccttttacattcggaccaggcaccaaggtggaaatcaagcgcactgtagccgcacccagcgtgtttattttccctccatctgatgagcaactaaaatccggtacagcctcagtcgtgtgcctcctgaataacttttatccccgagaagctaaggttcagtggaaggtggacaatgcacttcagagcgggaacagtcaggagtctgtcaccgaacaagattccaaagacagcacgtactcgctgtcttccactttgaccctctcaaaggccgattacgagaaacacaaggtgtatgcttgtgaggtaacacatcagggactgagtagccctgttactaaatccttcaatcgtggcgaatgc

SEQ ID NO: 23826 - RNA, 1341 nt, synthetic construct
  misc_feature 1..1341: note = derived and/or modified sequence opt3 from Trevogrumab_HeavyChain1
  source 1..1341: mol_type = other RNA
gaggtgcaggtcctggaaagcggcggggacctcgttcaacccggaggttcccttagactgtcttgcgccgcttcaggcttcacctttagtgcatacgccatgacatgggtgaggcaggcgcctgggaagggattggagtgggtaagcgctatctccggctctggtgggtcggcctattacgcagattcagtgaaaggacggttcactattagccgcgacaacagtaagaatacggtctatttacagatgaactccctgcgagccgaagataccgctgtgtactattgtgcaaaagacggcgcctggaagatgtctggcctagatgtttgggggcagggaacaactgtgatagtcagctccgcttcaaccaaaggtccaagtgtgtttccgctcgccccctgcagccgttctacatccgagtcaaccgcggcactgggctgtcttgtaaaggactacttccctgaaccagttactgtgagctggaatagtggggccctgacatctggagtccacacctttcccgctgtgttgcaatccagcggcctctattcgctgtcttccgtggtcacggttccttcaagtagcctgggtactaagacctacacatgcaacgtggatcataaaccatccaatactaaggtagacaaaagagtggagtctaagtacgggcccccttgtccaccgtgccccgcccctgagttcctcggaggcccaagcgtctttttatttccccctaaaccaaaggataccctgatgatctcaaggacacccgaagtgacctgtgttgtggtcgacgtgagtcaggaggatccggaagtacagttcaactggtatgttgacggcgtggaggtccacaatgcaaagacgaaacctcgggaggaacagttcaactccacttaccgcgtggtcagcgtgcttacagttttgcatcaagattggctgaatgggaaggagtataaatgcaaggtgtctaacaaaggactaccctcaagtattgaaaagaccatcagcaaagctaagggtcagccaagagagcctcaggtatacactctgcccccatcccaggaagagatgacaaagaatcaagtctctctcacctgtcttgtgaaaggcttttatccctcggacattgccgttgagtgggaaagcaacgggcagcctgagaataactacaagacgaccccaccggtgctggactccgatggatcattctttttgtatagtaggctcacagtcgacaaatctcggtggcaggaaggcaatgtgttcagctgctccgtaatgcacgaggcgctgcataaccactacactcaaaagtcattaagcctgtctctcggtaaa

SEQ ID NO: 23827 - RNA, 642 nt, synthetic construct
  misc_feature 1..642: note = derived and/or modified sequence opt3 from Trevogrumab_LightChain1
  source 1..642: mol_type = other RNA
gacatccagatgacccaaagccccgcctccctgtctgcttcagtgggcgatagagtcacaattacttgcagggcaagtcaggacataagcgattacctcgcctggtatcagcagaagcctgggaaaatcccacggcttctgatttacacgacctccacattgcaatctggagttccgtcgcgcttccgaggttcaggcagcgggactgactttaccttaacaatcagttccctgcagcccgaggatgtggcgacctattactgtcagaagtatgactctgctcctctaactttcggaggcggtacaaaagtagaaattaagcgtaccgtggccgcaccaagcgtctttatctttcccccttccgatgagcagctcaaatcagggacggccagtgtggtttgcctgcttaacaatttctacccaagagaagctaaggtgcaatggaaggtcgacaacgcactgcagagcggaaattctcaggagtccgtgactgaacaggattcaaaagacagcacctatagtttgtcttccacactcactctgagcaaggccgattacgagaaacacaaggtatacgcttgtgaggttacccatcaaggcctgtcgtctcccgtgacaaaatccttcaacaggggcgaatgc

SEQ ID NO: 23828 - RNA, 1737 nt, synthetic construct
  misc_feature 1..1737: note = derived and/or modified sequence opt3 from Tucotuzumab_celmoleukin_HeavyChain1
  source 1..1737: mol_type = other RNA
cagatccaactggtgcagagcggcgccgaagtcaagaaacccggggaaaccgttaagatttcctgcaaggcttctggatacacattcactaactatggtatgaattgggtgaaacagacgcctggcaaagggctcaagtggatgggatggataaacacctacacaggcgagccaacttatgcagacgattttaagggtagattcgccttttcacttgaaaccagtacaagcaccgcgttcctgcagatcaataacttgaggtccgaggacactgctacatacttttgtgtacggttcatttctaaaggggattattggggacaaggcacctcggtgacggtctcaagcgccagtactaagggcccgtccgtgtttcccttagcaccttctagcaaatccacctcagggggaacagccgctctgggttgcctagttaaggactacttcccagaacccgtgactgtcagttggaatagcggcgcactcacctctggggtgcacacatttcctgccgtactgcagtcctcaggactttatagcctgagttctgttgtgaccgtcccatccagctcgttgggcacgcagacttacatctgtaacgtgaatcataaaccctctaacacaaaggtggataagcgcgtcgagcctaaatcctgcgacaagacccacacttgtccaccgtgccccgctcctgagctcctgggtgggccatcagttttcctgtttccccctaaaccaaaggatacactcatgattagtcgaacccccgaagtgacgtgtgtagtggtcgacgtgagccatgaggatccggaagttaaattcaattggtacgtggacggagtcgaggtgcacaacgccaagaccaaacctcgtgaggaacagtataattccacatacagagtagtttctgtgttaactgtcctgcatcaagattggcttaacggcaaggagtataagtgcaaagtgagcaataaggcgttgcccgcaccaatcgagaaaaccatatcaaaggccaaaggccagcctagggaaccccaggtctacacactgccacccagtcgggaagagatgactaagaaccaggtgtccctaacctgtctcgttaaggggttttatcctagcgacatcgctgtggagtgggaatctaatggacaaccagagaacaactacaaaacaaccccgcccgtactggattcagacggtagtttcttcctttatagcaagctgactgtcgacaaatcccgctggcagcagggcaatgtgttttcttgctcggttatgcacgaagccttgcacaaccattacacgcaaaagagcctctccctgtcacctgggaaagcaccaacaagttctagcaccaagaagactcagttacagctggagcacctccttctggatttgcagatgattctaaatggaatcaacaattacaaaaaccccaagctgaccagaatgctcacattcaaattttatatgcctaagaaagctaccgaactgaagcatcttcaatgtctggaggaggaattgaagccactcgaggaagtgctgaatttagcccagtccaaaaacttccacctgaggccccgggacctaatttcaaatatcaacgtcatagtgctcgagctgaagggcagcgaaactacatttatgtgcgagtacgcggatgagacggccaccattgtagagttccttaatcgctggatcactttttgccagtctattatctccacattgacc

SEQ ID NO: 23829 - RNA, 639 nt, synthetic construct
  misc_feature 1..639: note = derived and/or modified sequence opt3 from Tucotuzumab_celmoleukin_LightChain1
  source 1..639: mol_type = other RNA
gagatcgtgctgacccagagccccgccacactctccctttctcctggcgaaagagtcactctgacgtgctcagctagtagctccgtttcttacatgttgtggtatcaacagaagccagggtcgtcaccgaaaccctggattttcgacaccagcaacttagcaagtggatttcctgccaggttctccggttctggcagcgggacatcctactcactgataatcagtagcatggaggcggaagatgctgccacttattactgtcaccagcggtctggatatccatacacctttggcggtgggacaaagctagagattaaacgcaccgtggcagccccctccgtattcatctttcctccatcagacgaacagctcaagagcggaactgctagtgtggtctgcctgcttaataacttctatccccgagaggcaaaagtgcaatggaaggttgataatgccctgcagtctggcaactcccaggagagcgtgacagaacaggactcgaaggattctacctactccttgtcaagtacgctcactctgagcaaagctgactacgagaagcataaagtctatgcctgtgaagtgacccaccaaggcctgtcctctcctgtaacaaagagctttaatcgtggggagtgc

SEQ ID NO: 23830 - RNA, 1344 nt, synthetic construct
  misc_feature 1..1344: note = derived and/or modified sequence opt3 from Ublituximab_HeavyChain1
  source 1..1344: mol_type = other RNA
caggcctacctgcaacagagcggcgctgagctcgtgagacccggggcatccgtcaagatgtcttgcaaagcctcaggatataccttcacaagttacaacatgcactgggttaagcagactcctaggcagggtcttgaatggatcggcgggatttatccaggaaatggcgacacgagctacaaccaaaaatttaagggtaaagcgaccctgacagtggggaagtcctcttcgactgcttatatgcagttgagcagcttaaccagtgaggattccgccgtatacttctgtgcacggtatgactacaattacgccatggattattggggacagggcacatctgtgaccgtcagctccgcttcaactaagggcccgagtgtgtttcccctggcacctagctctaaatccacatcagggggaaccgccgctctaggttgcctcgttaaggactacttcccagaacccgtgacggtcagctggaacagtggcgccctgacttctggggtgcatacctttcctgcggtacttcagtccagcggactgtattcgttgtcttccgttgtgacagtcccatcaagtagcctcggcactcaaacctacatatgtaatgtgaaccacaaaccctccaatacaaaggtggataaaaaggtcgagcctaagtcttgcgacaaaacccatacgtgtccaccgtgccccgcacctgaactgctgggtgggccaagcgttttcctctttccccctaagccaaaagatactttaatgatctcacgcacacccgaggtgacctgtgtagtggtcgacgtgagtcacgaggatccggaagttaagttcaactggtatgtggacggagtcgaggtgcataatgccaaaactaagcctcgagaggaacagtacaactccacatatcgtgtagttagcgtgctgaccgtccttcaccaggattggttgaatggcaaagagtacaagtgcaaggtgtctaacaaagctctgcccgccccaattgaaaagacgatctcaaaagcaaagggccagcctagagagccccaagtctacaccctaccacccagtagggacgaactcactaaaaatcaggtgagcctgacatgtcttgttaaggggttttatccttccgatattgctgtggagtgggaatctaacggacagccagagaataactacaagaccacaccgcccgtactggactcggacggtagcttctttttgtattccaaactcactgtcgataagtcacggtggcaacagggcaacgtgttcagttgctctgttatgcacgaggccctgcataatcactacacccagaaatcattatccctgtcacctgggaag

SEQ ID NO: 23831 - RNA, 639 nt, synthetic construct
  misc_feature 1..639: note = derived and/or modified sequence opt3 from Ublituximab_LightChain1
  source 1..639: mol_type = other RNA
cagatcgtgctgagccaatcccccgccattctctctgcttcacctggcgagaaggtcaccatgacatgcagagcaagtagctccgtttcttacatgcactggtatcagcagaaaccagggtcgtcaccgaagccctggatatacgccactagcaaccttgcgagtggagtgcctgctaggttctccggttctggcagcgggacgtcctattcatttaccatcagtcgggtagaagccgaggacgcagccacatactattgtcagcaatggactttcaatccacccacctttggaggcggtacacgcctggaaattaaacgaaccgtggctgcacctagcgtcttcatctttccaccctctgatgagcagttgaagtccgggactgcctcagtggtttgcttactgaacaatttctaccctcgtgaagctaaagtgcagtggaaggtcgacaacgccctacagagcggaaatagtcaagagtctgtgacagagcaggattccaaggacagcacctattcgctctcttccacgctgactctttcaaaagcggattacgaaaagcataaagtatacgcatgtgaggttacccaccagggcctgagtagcccagtgacaaagtcctttaacagaggcgaatgc

SEQ ID NO: 23832 - RNA, 1353 nt, synthetic construct
  misc_feature 1..1353: note = derived and/or modified sequence opt3 from Ulocuplumab_HeavyChain1
  source 1..1353: mol_type = other RNA
gaggtgcagctggtcgaaagcggcgggggactcgttcaacccggtggctcccttagactgtcttgcgccgctgcagggttcaccttttcaagttacagcatgaactgggtgaggcaggcccctggaaagggcttggagtgggtatcctatatctcttcgcggtcacgcacaatttactatgcggacagcgtgaaaggtcgattcactataagtcgtgataatgctaagaactccttatacctgcagatgaactctctaagagacgaagatacggccgtctattactgtgcaagggactatgggggacagccaccgtactactattactatggcatggatgtgtggggccaagggaccacagttactgtgagctccgcctcaaccaaaggacccagtgtctttcctctcgctccatgcagccggtctacatccgagtcaaccgcagccctgggttgtcttgtgaaggactacttccccgaacctgtaactgttagctggaatagtggcgctctgacatctggggtgcacacctttccagccgtcttgcagtccagcggactctattcgctgtcttccgtggtgacggtcccctcaagtagcctgggcactaaaacctacacatgcaatgttgatcataagccttccaacactaaggtggacaaacgcgtagagtctaagtatggtccaccgtgtcccccttgcccagcgcccgagttcctcgggggacctagcgtgtttttattcccacccaaaccgaaggataccctgatgatctcaagaacacctgaagtcacctgtgtggttgtggacgtcagtcaggaggatcccgaagtgcagtttaattggtacgtagacggcgttgaggtgcacaacgcaaaaacgaagccaagggaggaacaattcaattccacttaccgggtcgtgagcgtccttacagtgttgcatcaggattggctgaacggcaaggagtataaatgcaaggtttctaataaagggctaccttcaagtattgaaaagaccatcagcaaagccaagggacagccccgcgagccacaggtgtacactctgcccccttcccaagaagagatgaccaaaaaccaggtatctctcacctgtcttgtcaagggtttttatccatcggacattgctgtggagtgggaaagcaatggccagccggagaacaattacaagacgacaccccctgttctggactccgatgggtcattctttttgtatagtcgactcacagtggacaaatctagatggcaagaaggaaacgtcttcagctgctccgtgatgcacgaggccctgcataaccactacactcagaagtcattaagcctgtctctcggc

SEQ ID NO: 23833 - RNA, 642 nt, synthetic construct
  misc_feature 1..642: note = derived and/or modified sequence opt3 from Ulocuplumab_LightChain1
  source 1..642: mol_type = other RNA
gacatccagatgacccaaagcccctcctctctgtcagccagtgtgggcgatagagtcacaattacttgcagggctagccaggggatatcctcttggctcgcatggtaccagcagaagcctgagaaagccccaaagtcgcttatctatgcggcttcaagcctgcaaagtggagttccgtcccggttctctggtagcggctccgggacggactttaccttgacaatttcaagtttacagcccgaagatttcgtgacttactattgtcagcagtacaacagctatcctcgcacctttggacaaggcacaaaagtagagatcaagcgaaccgtggccgcaccatctgtcttcatttttcccccttccgacgaacagctgaaatcaggtactgccagcgtggtttgcctactcaataacttctacccacgtgaggctaaggtgcagtggaaggtcgataatgcactgcagagtgggaactctcaagaatccgtgacagagcaggacagcaaagattcgacctattctctttcctcaacgctgactttgagtaaggccgactacgagaaacacaaggtatacgcttgtgaagttacccatcagggactcagctcccccgtgacaaaatcttttaatagaggcgagtgc

SEQ ID NO: 23834 - RNA, 1344 nt, synthetic construct
  misc_feature 1..1344: note = derived and/or modified sequence opt3 from Urelumab_HeavyChain1
  source 1..1344: mol_type = other RNA
caggtgcaactgcagcagtggggcgccgggctccttaagcccagcgagaccctgtccttgacatgcgctgtctacggaggttctttctcaggctattactggagttggatcagacagagccctgaaaaagggttagagtggattggagaaataaaccacggcggttatgttacttacaatccatccctggagtctagggtgacgatctcggtagacacctcaaagaaccaatttagcctaaaactcagttccgtgacagcagccgatactgcggtctattactgtgctcgggactatgggccgggaaattacgattggtacttcgacctgtggggccgcggcacccttgtgacagtttctagcgcctccaccaaggggccctcagtgtttcctctggcaccatgcagtcgaagcacttctgaatccacagccgctttgggatgtctcgtcaaagattatttccccgagcctgtgaccgtatcatggaacagcggtgcactgacgagtggcgttcatacttttccagccgtgctgcagtcttccgggctctacagcttatcgtctgtcgtgaccgtgccctcctcaagtctgggaacaaagacttatacctgcaatgtcgaccacaagcctagcaacacaaaagttgataagcgtgtggagtccaaatacggcccaccgtgtcccccttgcccagctcccgagttccttggtgggccttctgtatttttgttcccacccaagccgaaagacaccctgatgattagcagaacgcctgaggtgacttgtgtcgtggttgatgtgtcacaggaagaccccgaggtccagtttaattggtatgtggatggagtagaggttcataacgccaagacaaagccaagggaagaacaattcaatagtacctaccgggtggtctccgtgctaactgtcctccaccaggactggctgaacggcaaagaatataagtgcaaagtgagcaataagggccttccttcttcaatcgagaaaacaattagtaaggcgaaagggcagccccgcgaaccacaggtttacaccctgccccctagccaagaggagatgacgaagaaccaggtgtccttgacctgtctcgtaaagggattttacccatctgatatcgcagtcgaatgggagtcgaatggtcagccggaaaacaattataaaacaactccccctgtgctggacagcgacggctccttctttttatactcaagactgaccgttgataagagtaggtggcaagaggggaacgtgttctcttgcagcgtcatgcatgaagccctccacaaccactatacacagaaatccctttcactgagcttgggaaag

SEQ ID NO: 23835 - RNA, 648 nt, synthetic construct
  misc_feature 1..648: note = derived and/or modified sequence opt3 from Urelumab_LightChain1
  source 1..648: mol_type = other RNA
gagatcgtgctgacccagagccccgccacactctccctttctcctggcgaaagagctactctgtcatgcagggcaagtcaaagcgtctcctcttacttggcctggtatcagcagaagccagggcaggcgccgcggttactgatttacgacgcttcgaaccgcgccacgggaatacccgcacgattctcaggtagcggcagtgggaccgattttacactaactatctcctctctcgagcctgaagacttcgccgtttattactgtcaacagcgtagcaattggccacccgctctgaccttttgcggaggcacaaaagtggagattaagagaaccgtagcagccccttccgtgttcatctttccaccctcagatgaacagcttaaaagtggtactgctagcgtcgtgtgtctgttgaacaatttctatcctagggaggccaaggttcagtggaaagtggacaacgcgctccaatctggaaattcccaggagtcagtcacagaacaggatagcaaggacagtacctactctctgtccagcacgctgactctctcgaaggcagattatgagaaacacaaggtgtacgcctgcgaagtaacccatcaggggttatcttccccagttacaaaatcatttaaccggggcgagtgt

SEQ ID NO: 23836 - RNA, 1347 nt, synthetic construct
  misc_feature 1..1347: note = derived and/or modified sequence opt3 from Urtoxazumab_HeavyChain1
  source 1..1347: mol_type = other RNA
gaggtgcagctggtcgaaagcggcgggggactcgttcaacccggtggctcccttagactgtcttgcgccgcttcagggttcacctttagtagctacggaatgtcctgggtgaggcaggcacctggcaagggtttggagtgggtagccacaatctctactgggggatcgtatacgtactatccagactcagtgaaaggccggttcaccattagccgcgataacgcgaagaatacattatacctgcagatgaacagtctacgagctgaagacactgccgtctattactgtgcacgtagaggcgatgcctgggggaatctcgactattggggacagggtaccctggtgacagtttcctctgctagcaccaaaggcccgtccgtgtttccccttgcaccttcaagtaagagcacttctgggggaacagccgctctgggctgcttggtcaaagattacttcccagagcccgtgaccgtatcctggaactcaggtgccctcacgagcggggttcacacttttcctgcggtgctgcaaagttctggactgtactccctcagctcggtcgtgaccgtgccatcttcctcattaggcacacagacttatatatgtaatgtcaaccataagcccagtaataccaaggttgacaaaaaggtggaacctaaaagctgcgataagacacacacctgtccaccgtgccccgcacctgagctgcttggcgggccatccgtattcttgtttccccctaaaccaaaggacacgctgatgatctctaggactcccgaggtgacatgtgtcgtggttgatgtgagccatgaagacccggaggtcaagttcaactggtacgtggatggagtagaagttcacaatgccaaaaccaagcctcgggaggagcagtataactcaacttaccgcgtggtcagtgtgctaacagtcctccatcaggactggctgaatggtaaagaatataagtgcaaagtgtccaacaaggcccttcccgctccaattgagaaaaccatcagcaaggcaaagggccaacctagagaaccccaggtttacacgctgccaccctctagggatgagttgaccaaaaatcaggtgtcactcacatgtctggtaaaggggttttatcctagtgacattgctgtcgaatgggagagcaacggacagccagagaataactacaaaactaccccgcccgtgttagactccgatggctctttctttctgtactcgaagctcacagttgacaaaagccggtggcaacagggtaacgtgttctcctgctcagtcatgcacgaagcccttcacaatcattatactcagaagagtctgtctttgagccctgggaag

SEQ ID NO: 23837 - RNA, 642 nt, synthetic construct
  misc_feature 1..642: note = derived and/or modified sequence opt3 from Urtoxazumab_LightChain1
  source 1..642: mol_type = other RNA
gagatcgtgctgacccagagccccgccacactctccgtctctcctggcgaaagagctactctttcatgcagggcaagtcaaacgattagcaacaatctgcactggtaccagcagaagccagggcaggccccgcggttgttaataaaatccgcgtctcaatcgatctcaggtattcccgctcgcttcagcggaagtggctccgggaccgactttacactgactatctctagcctagagtccgaagatttcgccgtttattactgtcagcagtcatatagttggcctctcacctttggacagggcacaaaggtggagattaaacgaaccgtagcagccccaagcgtgttcatctttcccccttctgacgaacaactgaagtccggtactgcttcagtcgtgtgccttctgaacaatttctacccacgtgaggcaaaagttcagtggaaggtggataacgccttgcagagcgggaatagtcaggagtctgtcacagaacaagactccaaggatagcacctattcgctctcttccacgctgactctgtcaaaagctgactacgagaagcataaagtgtatgcctgtgaagtaacccaccagggactcagtagccccgttacaaagtcctttaacagaggcgagtgc

SEQ ID NO: 23838 - RNA, 1347 nt, synthetic construct
  misc_feature 1..1347: note = derived and/or modified sequence opt3 from Ustekinumab_HeavyChain1
  source 1..1347: mol_type = other RNA
gaggtgcagctggtccagagcggcgccgaagttaagaaacccggggagtccctcaagatctcttgcaaaggatcaggttacagtttcaccacatattggcttggctgggtgagacagatgcctgggaagggactggactggattggcataatgagcccagtagattccgacatcaggtactctccgtcgtttcagggtcaggtgactatgtcagtcgataaaagcattacgaccgcttatttgcaatggaacagtttaaaggcatccgacacagccatgtactattgtgcgcggcgccgacccgggcagggatacttcgatttttggggccagggcactctggtgaccgtttctagctcctcaacaaaggggcctagtgtgttcccactagctcccagctctaaatccacctcaggaggtactgccgcactcggctgcctggtcaaggactattttcctgaaccagtgacagtaagctggaatagtggggcccttacctctggagttcacacgttccccgctgtgctgcagtccagcggcttgtactcgctctcttccgtcgtgactgtgccttcaagtagcctgggtacccaaacatacatctgtaacgtcaatcataaaccatccaacactaaggttgataaacgtgtggagccgaagtcttgcgacaagacccacacatgtcccccttgcccagcacccgaactgctcgggggacctagcgtatttttattcccacccaaaccgaaggataccctgatgatttcaagaacgcctgaggtgacttgtgtcgtggttgacgtgagtcatgaggatcccgaagtcaaatttaattggtatgtggacggcgtagaggttcacaacgccaagacaaaaccaagggaagaacagtacaattccacctatcgggtggtcagcgtgcttactgtcttgcatcaggattggctgaacggcaaggagtacaaatgcaaggtgtctaataaggctctacctgcccccatcgagaaaacaatatcaaaggcgaaagggcagccacgcgagccccaagtttataccctccctccaagtagagacgaactgacgaagaaccaggtgagccttacctgtctggtaaaaggattctacccgtccgacatcgcagtcgagtgggaatctaatggtcagcccgagaacaattataagacaactcctccagtgttggattcggacggcagctttttcctctactccaagctgaccgttgataaatcaaggtggcaacaggggaacgtgtttagttgctctgtcatgcacgaggccttacacaatcattacacacaaaagagcctgtccctctcacccggaaaa

SEQ ID NO: 23839 - RNA, 642 nt, synthetic construct
  misc_feature 1..642: note = derived and/or modified sequence opt3 from Ustekinumab_LightChain1
  source 1..642: mol_type = other RNA
gacatccagatgacccaaagcccctcctctctgtcagccagtgtgggcgatagagtcacaattacttgcagggctagccaggggatatcctcttggctcgcatggtaccagcagaagcctgagaaagccccaaagtcgcttatctatgcggcttcaagcctgcaaagtggagttccgtcccggttctctggtagcggctccgggacggactttaccttgacaatttcaagtttacagcccgaagatttcgccacttactattgtcagcagtacaacatctatccttacacctttggacaaggcacaaaactggagattaagcgcaccgtggcagccccaagcgtattcatctttcccccttctgacgaacagctaaaatccggtactgcttcagtggtctgcctcctgaataacttctatccacgagaggcaaaggtgcagtggaaggttgataatgcccttcagagcgggaacagtcaagaatctgtgacagagcaggactccaaagatagcacctactcgctgtcttccacgttgactctctcaaaggctgactacgagaaacacaaggtctatgcctgtgaagtgacccatcagggactgagtagccccgtaacaaaatcctttaatcgtggcgagtgc

SEQ ID NO: 23840 - RNA, 1341 nt, synthetic construct
  misc_feature 1..1341: note = derived and/or modified sequence opt3 from Vadastuximab_talirine_HeavyChain1
  source 1..1341: mol_type = other RNA
caggtgcaactggtccagagcggcgccgaggttaagaaacccggggcttccgtgaaggtatcttgcaaagcatcaggatacaccttcacaaactatgacatcaattgggtgagacaggcccctggtcagggcctcgaatggattgggtggatatacccaggagatggcagtactaagtataacgagaaatttaaggcgaaggctacgcttaccgccgacacaagcacttccaccgcatacatggaactgaggtctttgcggtcggatgacacagccgtctattactgtgcttcaggttatgaggatgcaatggactactgggggcaaggaaccactgtgacagttagcagtgcctccaccaaaggcccgtctgtgttccccttagctcctagctccaagtcaacgagtggcgggactgccgcgctgggatgcctagtcaaagattactttccagaacccgtgaccgtaagctggaactctggtgcactcacatccggcgttcacactttccctgccgtgctgcagtcaagcgggctttatagtctgtcttccgtcgtgaccgtgccaagctcgtctttgggaacacagacctacatctgtaatgtcaatcataagccctccaacacgaaagttgacaagaaggtggagcctaaatcatgcgataagactcacacatgtccaccgtgccccgctcctgagctcctgggcggtccatgtgtatttctgtttccccctaaaccaaaggacaccctcatgattagtcgcactcccgaagtgacatgcgtcgtggttgatgtgagccatgaggacccggaagtcaaatttaattggtatgtggatggggtagaggttcacaacgccaagaccaaacctcgagaggaacagtacaattccacgtatcgtgtggtctctgtgttaaccgtcctgcatcaagactggcttaacggaaaggagtacaagtgtaaagtgagcaataaggcattgcccgctccaatcgagaaaacaatttcaaaggccaaaggccagcctagagaaccccaggtttatactctgccacccagtagggacgaactaaccaagaaccaggtgtccctcacatgcctggtaaagggcttctaccctagcgatatcgcggtcgagtgggagtctaatgggcaaccagaaaacaattacaaaactaccccgcccgtgcttgactcagatggaagtttcttcctgtatagcaagttgacagttgacaaatcccggtggcagcagggtaacgtgttttcttgttcggtcatgcacgaggccctccacaaccattacacccaaaagagcctgtccttatcacctggcaaa

SEQ ID NO: 23841 - RNA, 642 nt, synthetic construct
  misc_feature 1..642: note = derived and/or modified sequence opt3 from Vadastuximab_talirine_LightChain1
  source 1..642: mol_type = other RNA
gacatccagatgacccaaagcccctcctctctgtcagccagtgtgggcgatagagtcacaattaactgcaaggctagccaggacataaattcctacctctcttggttccagcagaaacctgggaaggcaccaaaaactcttatctatagggccaaccggctggttgatggagtgccgtcgcgcttttcaggtagcggcagtgggcaagactacacgttgaccatttcctctttacagcccgaggatttcgcgacatattactgtctgcagtatgacgaatttcctctaactttcggaggcggtaccaaggtagagatcaaacgaacagtggctgccccaagcgtctttatttttcccccttccgatgaacagctcaagtcagggaccgcaagtgtggtttgcctgcttaataacttctacccacgtgaggccaaggtgcaatggaaagtcgacaatgctctgcagagcggaaactctcaggaatccgtgactgagcaggattcaaaggacagcacatatagtttgtcttccaccctcacgctgagcaaagcagattacgagaagcacaaagtatacgcctgtgaagttactcatcaaggcctgtcgtctcccgtgaccaagtccttcaatagaggcgagtgc

SEQ ID NO: 23842 - RNA, 1362 nt, synthetic construct
  misc_feature 1..1362: note = derived and/or modified sequence opt3 from Vandortuzumab_vedotin_HeavyChain1
  source 1..1362: mol_type = other RNA
gaggtgcagctggtcgaaagcggcgggggactcgttcaacccggtggctcccttagactgtcttgcgccgtgtcagggtacagtatcaccagcgactatgcttggaactgggtaaggcaggcacctggaaagggcttggagtgggtgggttacatttccaattctgggtcgacatcatataacccgagcttaaaaagtcggttcactatatcccgcgatacgtctaagaataccctgtacctacagatgaacagcctccgagccgaagacacagcggtctattactgtgctcgtgagagaaattatgattacgacgattactattacgccatggactattggggacagggcactctggtgaccgtttcctcagcaagtacaaaaggcccaagcgtgtttccccttgccccttcttccaagtcaaccagcgggggaactgctgcactgggttgcttggtcaaagattacttcccagaacccgtgacagtaagttggaactctggcgccctcacctccggggttcacacgtttcctgctgtgctgcaaagctcgggactgtattctctctcctcagtcgtgactgtgccaagtagctccttaggcacccagacatacatctgtaatgtcaaccataagccctctaatactaaggttgacaaaaaggtggagcctaaaagctgcgataagacccacacatgtccaccgtgccccgcccctgagctgcttggtgggccatcagtattcttgtttccccctaaaccaaaggacaccctgatgattagtaggacgcccgaagtgacttgtgtcgtggttgatgtgtcccatgaggacccggaagtcaagttcaactggtatgtggatggagtagaggttcacaatgcgaaaacaaagcctcgggaggaacagtacaacagcacctaccgcgtggtctctgtgctaactgtcctccatcaggactggctgaatggcaaagagtataagtgcaaagtgtcaaacaaggcacttcccgccccaatcgagaaaacaattagtaaggctaagggccaacctagagaaccccaggtttacaccctgccacccagcagggaagagatgacgaaaaatcaggtgtccttgacctgtctcgtaaaggggttttatccttctgacatcgccgtcgagtgggaatcgaacggacagccagagaacaattacaaaacaactccgcccgtgctggatagcgacggttccttctttttatattcaaagctgaccgttgataaaagtcggtggcaacagggcaacgtgttctcttgcagcgtcatgcacgaagcactccacaatcattacacacagaagtccctttcactgagccctgggaag

SEQ ID NO: 23843 - RNA, 660 nt, synthetic construct
  misc_feature 1..660: note = derived and/or modified sequence opt3 from Vandortuzumab_vedotin_LightChain1
  source 1..660: mol_type = other RNA
gacatccagatgacccaaagcccctcctctctgtcagccagtgtgggcgatagagtcacaattacttgcaagagctcccagtctctcctttacaggtcgaaccagaaaaattatctggcttggtaccagcaaaagcctgggaaagcaccaaagttgttaatatattgggcctcaacgcgggagagcggagttccgagtcgcttctccggttctggcagcgggaccgactttacactgactatctcctcactacagcccgaagatttcgcgacctactattgtcagcagtactataactaccctcgaacatttggacaaggcaccaaagtggagattaagcgtactgtagctgccccaagtgtgttcatctttccccctagcgacgaacagctcaagtctggtacagcatccgtcgtgtgcctgcttaataacttctacccaagagaggccaaagttcagtggaaggtggataatgctctgcagtcagggaacagccaagaaagtgtcaccgagcaggactctaaagattccacgtatagcttgtcgtctactctcaccctgtccaaggcagactacgagaaacacaaggtgtatgcctgtgaagtaacacatcagggactgtcaagtcccgttactaagagctttaataggggcgagtgc

SEQ ID NO: 23844 - RNA, 1329 nt, synthetic construct
  misc_feature 1..1329: note = derived and/or modified sequence opt3 from Vantictumab_HeavyChain1
  source 1..1329: mol_type = other RNA
gaggtgcaactggtcgaaagcggcgggggactcgttcaacccggtggctcccttagactgtcttgcgccgcttcagggttcacctttagtcactacacattgagctgggtgaggcaggcacctggaaagggcttagagtgggtatccgtgatctctggtgacgggtcgtatacttactatgccgattcagtcaaaggacggttcacgattagcagtgacaactccaagaataccctgtacctacagatgaactctctccgcgcggaagatacagctgtgtattactgtgcccgaaattttataaaatatgttttcgcaaactggggccagggcactctggtgaccgtcagctccgcctcaacaaaggggccaagtgtgtttccgcttgctccctgcagccgttctacctccgagtcaactgcagccctgggatgtttggtaaaagactacttccctgaaccagttacagtgagctggaatagtggtgctctcacctctggcgtccatacgtttcccgccgtgctgcaatccagcgggctgtactcgctctcttccgtggtcactgttccttcaagtaacttcggaacccagacatatacttgcaatgtggatcacaagccaagcaacaccaaggtagacaaaacagtggagagaaagtgttgcgtcgagtgtcccccttgcccagcgccgcccgtggcaggcccttccgtgtttttattcccacccaaacctaaggataccctgatgatctctaggacgccagaagttacttgtgtcgtggtagacgttagccatgaggatcccgaagtgcagtttaattggtacgtcgacggtgtggaggtccacaacgccaaaacaaagccgcgggaggaacagttcaattcaacctttcgcgtggttagtgtgcttactgtagtccatcaagattggttgaacgggaaggagtataaatgcaaggtgtccaataaaggactgcctgctcccattgaaaagacaatcagcaaaaccaagggccagccaagagagcctcaggtttacacgctacccccatctagggaagagatgaccaaaaaccaggtgtcactcacatgtctggtcaagggcttctatcccagtgacattgccgtggagtgggaaagcaatgggcaacctgagaacaactacaagactaccccaccgatgcttgattccgacggatctttctttctgtattcgaaattgacagtagacaagagccggtggcagcagggtaatgtgttctcctgctcagttatgcacgaagcactccacaaccattacactcagaaaagtctgtctttaagccccggc

SEQ ID NO: 23845 - RNA, 639 nt, synthetic construct
  misc_feature 1..639: note = derived and/or modified sequence opt3 from Vantictumab_LightChain1
  source 1..639: mol_type = other RNA
gacatcgagctgacccagccccctagcgtgtccgtcgccccaggccaaacagctagaatttcttgctcaggggataacataggaagtttctacgttcactggtatcagcagaagccgggtcaggcacccgtgctcgtaatctacgacaaaagcaataggccttccggcattccagaacggttttctgggtcgaactcaggaaatactgccacgcttaccatcagcggcacacaagcggaggatgaagctgactattactgtcagagttatgccaacactctgtccttggtgttcggtgggggaaccaagttaacagtcctgggccagcccaaagcagccccttctgtgaccctatttccacccagctccgaggaactccaggctaataaggcaactctggtttgccttatttcagatttctaccctggcgccgtgacagtcgcttggaaagccgacagtagcccagtgaaggcgggggtagagaccacgactccgtctaagcaatccaacaataaatatgcagcctcaagctacctgagtttgacccccgagcagtggaagtctcatcgctcctacagctgtcaggttacacacgaaggatcgactgtggagaaaaccgtcgctcctacagaatgctct

SEQ ID NO: 23846 - RNA, 1389 nt, synthetic construct
  misc_feature 1..1389: note = derived and/or modified sequence opt3 from Vanucizumab_HeavyChain1
  source 1..1389: mol_type = other RNA
caggtgcaactggtccagagcggcgccgaggttaagaaacccggggcttccgtgaaggtatcttgcaaagcatcaggatacaccttcacaggttattacatgcactgggtgagacaggcccctggccaggggctcgaatggatgggatggatcaacccaaatagtggcggtactaactatgcgcaaaagtttcaggggagggtcacgatgacccgggacacaagcatttccactgcttacatggagctttctcgcctgcgatcggatgacaccgccgtgtattactgtgcacgttcaccgaatccctattactacgatagcagtggatattactatcctggcgccttcgacatatggggccaggggacaatggttaccgtgtcctctgctagcgtcgcagccccatccgtgtttatctttcccccttcagatgaacagttgaaaagtggaactgctagcgtagtttgcttactgaacaatttctacccaagagaggccaaggtgcaatggaaggtcgacaacgcgctacagtctggtaattcccaggaatcagtgacagagcaggatagcaaagacagtacctattctctctccagcacgctgactctttcgaaggcagattacgagaaacataaggtgtatgcctgtgaagtcacccaccaaggcctgtcttcccccgttacaaaatcattcaacaggggagagtgcgacaagactcatacctgtcctccatgcccggctcccgaattgctcgggggccctagtgtgtttctgttcccacccaagcctaaagatacactgatgattagccggaccccagaggtaacgtgtgtggtcgtggacgtttcccacgaggatcccgaagtgaagtttaattggtacgtcgacggtgtggaggtacataacgccaaaactaagccgcgcgaggaacagtacaattctacatatagagttgtgagcgtcctcaccgtgttacaccaggactggctgaacgggaaagaatacaagtgcaaagtctcaaataaggcacttcctgctcccatcgagaagactattagtaaagccaagggacaaccaagggagcctcaggtgtgtacattgcccccatcccgggatgaactgaccaaaaaccaggttagcctatcttgcgcggtgaagggcttctatccctcagacatcgccgtagagtgggaaagtaatggccagcctgagaacaactacaaaacgaccccaccggtcctcgatagcgacgggtcctttttcctggtgtctaaacttacagttgataagtcgcgctggcaacagggaaatgtgtttagctgttccgtcatgcacgaagcactgcataaccactatactcagaagtcattgagtctctctcccggtaag

SEQ ID NO: 23847 - RNA, 1359 nt, synthetic construct
  misc_feature 1..1359: note = derived and/or modified sequence opt3 from Vanucizumab_HeavyChain2
  source 1..1359: mol_type = other RNA
gaggtgcagctggtcgaaagcggcgggggactcgttcaacccggtggctcccttagactgtcttgcgccgcttcagggtacaccttcacaaactatggaatgaattgggtgaggcaggcacctggcaagggtttggagtgggtagggtggatcaacacttacacgggagaaccaacctatgccgcggactttaaacggcgcttcacatttagtttagatactagcaagtccaccgcttacctgcagatgaatagcctacgagccgaggacacagcagtgtattactgtgccaaatatccgcactactacggctcgtcacattggtatttcgatgtctggggccaggggaccctcgtgactgttagcagtgcttccacaaagggaccctctgtgtttcctctggcaccaagctccaaatcaaccagtggtggcacggccgctcttgggtgcctggtcaaggactacttccccgaacctgtgactgtaagctggaactctggagccttgacctccggcgttcacacatttccagcggtgctccaatcaagcggtctgtatagtctgtcttccgtcgtgactgtgcccagctcgtctctcgggacccagacatacatttgtaatgtcaaccataagccttccaataccaaagttgataagaaagtggagccaaagtcatgcgacaaaacgcacacttgtccgccctgccctgcaccagagttactgggaggccccagtgtattcctttttcctccaaagcccaaggatacattgatgataagccgtaccccggaagtgacttgtgtcgtggttgacgtgtcccatgaggatcctgaagtcaaattcaactggtatgtggacggcgtagaggttcacaatgccaagacaaaacccagagaggaacagtacaactctacctatagggtggtcagcgtgctgacggtcctacaccaggattggctcaatgggaaggagtacaaatgcaaggtgtcaaacaaagctctgccagcccctatcgaaaagaccattagtaaggcaaaaggacaaccccgggagccacaggtttacacacttcccccttgtcgcgacgaactgactaagaatcaggtgtccttgtggtgcctcgtaaaaggtttttatccaagcgatatcgctgtcgagtgggagtctaacggccagccggaaaataactacaagaccacaccccctgtgctggactcagacgggagtttctttttatatagcaaactgactgttgataagtccagatggcaacagggaaacgtgttctcttgttcggtcatgcatgaggccctccacaatcattacacccagaagtctctttccctgtcaccaggcaaa

SEQ ID NO: 23848 - RNA, 639 nt, synthetic construct
  misc_feature 1..639: note = derived and/or modified sequence opt3 from Vanucizumab_LightChain1
  source 1..639: mol_type = other RNA
cagcccggcctgacccaacctccaagcgtgtccgtcgccccggggcagacagctagaatcacttgcggaggtaacaatattggctctaagtcagttcactggtaccagcagaaacccgggcaagcacctgtgctcgtagtgtatgacgatagtgacaggccaagcggaatacccgagcggttctccggctctaactcgggtaatacggccacccttacaatctcacgcgtcgaagcgggggatgaggctgactactattgtcaggtgtgggatagcagttccgaccattacgtttttggaactggcaccaaggtgacagtcctgtctagcgcctccaccaaaggcccttcagtgttcccattggcacccagtagcaagtctacttccgggggaacagccgctttaggttgcctggtaaaagattattttcctgaaccagttaccgtgtcatggaacagcggcgcactaacgagtggggtccacactttcccggccgtgctccagtcttccggactgtacagcctttcgtctgtggtcaccgttccctcctcaagtctgggcacacagacttatatttgtaatgtgaaccataagcctagcaataccaaggtagacaaaaaggtggagccaaaatcctgc

SEQ ID NO: 23849 - RNA, 642 nt, synthetic construct; identical to SEQ ID NO: 23010
  misc_feature 1..642: note = derived and/or modified sequence opt3 from Vanucizumab_LightChain2
  source 1..642: mol_type = other RNA

SEQ ID NO: 23850 - RNA, 1356 nt, synthetic construct
  misc_feature 1..1356: note = derived and/or modified sequence opt3 from Varlilumab_HeavyChain1
  source 1..1356: mol_type = other RNA
caggtgcaactggtcgagagcggcgggggagttgtgcagcccggtagatccctcaggctttcttgcgccgcttcaggcttcacctttagtagctacgacatgcactgggtacggcaggcacctgggaagggactggaatgggtggccgtcatctggtatgatggctccaacaaatactatgcggactctgtgaagggtcgcttcacaatttcgcgagataattcaaagaacactttgtacttacagatgaatagcctgcgtgctgaggacacggccgtttattactgtgcaagagggagtggaaactggggctttttcgattattggggccaagggaccctagtgacagtctcctctgccagcactaaaggaccatccgtgtttccgctcgctccctcaagtaaaagcacctctggtggcacagcagccctggggtgccttgtaaaggactacttccctgaaccagttaccgtgtcctggaactcaggagctctgactagcggcgtccatacatttcccgccgtgttgcagagttctggtctctactccctgagctcggtggtcaccgttccttcttcctcactggggacgcagacttatatatgtaatgtgaatcacaagccaagtaacaccaaagtagataagaaagtggagcccaagagctgcgacaaaacacatacttgtcctccatgcccggcgcccgaactcttaggaggcccttccgtcttcctgtttccacccaagcctaaggatacccttatgatctctaggacaccagaggtgacctgtgttgtggtcgacgtgagccacgaggatcccgaagtaaaattcaattggtacgttgacggcgtggaggtccataacgcaaagacgaaaccgcgggaggaacagtataattcaacttaccgcgtggtcagtgtgttgacagttctgcaccaagattggctaaacgggaaggagtataaatgcaaggtgtccaataaagccctccctgctcccattgaaaagaccatcagcaaggccaaaggacagccaagagagcctcaggtatacactctgcccccatctagggacgaacttacaaagaaccaggtctcactgacctgtttggtgaaaggtttttatcccagtgacattgcagttgagtgggaaagcaatggccaacctgagaacaactacaagacgaccccaccggtgctcgattccgacgggtctttctttctgtactcgaaattaacagtcgataagagccggtggcagcagggaaatgtgttctcctgctcagtaatgcacgaggctctgcataaccactatactcaaaagagtctctctcttagccccggcaaaggttcctca

SEQ ID NO: 23851 - RNA, 642 nt, synthetic construct
  misc_feature 1..642: note = derived and/or modified sequence opt3 from Varlilumab_LightChain1
  source 1..642: mol_type = other RNA
gacatccagatgacccaaagcccctcctctctgtcagccagtgtgggcgatagagtcacaattacttgcagggctagccaggggatatcccggtggctcgcatggtaccagcagaaacctgagaaagccccaaagtctcttatctatgcggcttcgtcactgcaaagcggagttccgagtcgcttctccggttctggcagcgggacggactttaccttgacaatttcctcattacagcccgaagatttcgccacttactattgtcagcagtacaacacctatcctcgaacatttggacaaggcaccaaagtggagatcaagcgtactgtagcagccccaagtgtgttcatttttccccctagcgacgaacagctgaaatctggtacagcttccgtcgtgtgcctactcaataacttctacccaagagaggcaaaggttcagtggaaggtggataatgccctgcagtcagggaacagccaagaaagtgtcaccgagcaggactctaaagattccacgtatagcctttcgtctactctgaccttgtccaaggctgactacgagaaacacaaggtgtacgcctgtgaagtaacacatcagggactctcaagtcccgttactaagagctttaataggggcgagtgc

SEQ ID NO: 23852 - RNA, 1338 nt, synthetic construct
  misc_feature 1..1338: note = derived and/or modified sequence opt3 from Vatelizumab_HeavyChain1
  source 1..1338: mol_type = other RNA
caggtgcaactgcaggagagcggccccgggctcgtcaagccttccgaaaccctttctctgacatgcactgtttcaggattcagtttgacgaactacggtatccactggattagacagccaccgggcaaagggttagagtggctgggagtgatatgggccaggggctttaccaattataacagcgctctaatgtcccggctcacaatctctaaggacaattcgaaaaaccaggtatcactgaaacttagcagtgtgactgcagccgataccgcggtctactattgtgctcgcgccaatgacggtgtgtactatgcaatggattactgggggcaaggaacactggttaccgtgtcctctgccagcactaagggcccctccgtcttccctttggctccatgctcacgaagtacaagcgaatctaccgcagccctcggctgtctggtgaaggactattttcccgagcctgtaacggtttcctggaactcaggggctctgactagcggagtgcataccttcccagccgtcctccagagttctggtttatactccctgagctcggtggtgacagtcccctcttcctcacttggcactaagacctacacatgcaatgttgatcacaaacctagtaacaccaaggtggacaaacgtgtagaaagcaagtatgggccaccgtgtccctcctgccctgcgccagagtttttgggaggcccctctgtgttcctgtttcctccaaaacccaaggatacgctaatgattagcagaactccggaggtcacatgtgtggttgtggacgtctcacaggaagatcctgaggtgcagttcaattggtacgtagacggtgttgaagtgcataacgcaaagaccaaacccagggaggagcaatttaatagtacttatcgggtcgtgtccgtcctcacagtgctgcaccaggattggcttaacgggaaggaatacaaatgcaaggttagcaataaaggactgccatcttcaatcgagaagaccattagtaaagccaagggccagcctcgcgaaccccaggtgtatacgttgccacccagccaagaggaaatgaccaagaaccaggtatccctcacatgtctggtcaaaggcttctacccttctgacatcgctgtggagtgggagtcgaatgggcagccagaaaacaactataagactaccccgcccgttttagatagcgacggatcctttttcctgtactcaagactcacagtggacaaaagtaggtggcaagagggtaatgtcttttcttgcagcgtgatgcatgaagcccttcacaaccactacactcagaagtccctgtcattgagcctaggcaaa

SEQ ID NO: 23853 - RNA, 639 nt, synthetic construct
  misc_feature 1..639: note = derived and/or modified sequence opt3 from Vatelizumab_LightChain1
  source 1..639: mol_type = other RNA
gacttcgtgatgacccagagccccgcctttctgtccgtcacacctggcgagaaggttactatcacgtgctctgctcaatcaagtgtgaactacattcactggtatcagcagaaaccagatcaggcaccgaagaaactcatatacgacaccagcaaacttgcctccggggtaccctctagattctcgggatcaggtagcggcacagattatacttttaccatcagttccctggaagcggaggacgctgccacatactattgtcaacagtggaccactaatcctttgacattcgggcagggaaccaaggtggaaattaagaggacggtcgcagccccatctgtgtttatctttccccctagcgatgagcagttaaagtccggcactgcttcagttgtgtgcctgctaaacaatttctacccacgggaagcaaaagtccaatggaaggtggacaacgccctccagagtggtaatagccaggagtctgtaaccgagcaggattccaaagactcaacatatagcctgagttctactcttaccctgtccaaggctgattacgaaaaacataaggtttacgcctgtgaggtgacacaccaagggttgagctcgcccgtcaccaagtctttcaaccgcggagaatgc

SEQ ID NO: 23854 - RNA, 1353 nt, synthetic construct
  misc_feature 1..1353: note = derived and/or modified sequence opt3 from Vedolizumab_HeavyChain1
  source 1..1353: mol_type = other RNA
caggtgcaactggtccagagcggcgccgaggttaagaaacccggggcttccgtgaaggtatcttgcaaaggatcaggttacaccttcacaagttattggatgcactgggtgagacaggcacctggccagaggctcgaatggatcggggagattgacccaagcgaatccaacactaattacaaccaaaagtttaaaggacgggtcacgcttaccgtggatatatctgcctcgacagcgtatatggagctgtcatcattgcgcagtgaagacactgctgtttactattgtgcccgaggcggttacgatgggtgggactatgcaatcgattactggggacagggcaccttagtgacagtctcctctgccagcaccaagggcccgtccgtgttccccctggctccttcaagtaagagcacttctgggggaacagcagccctaggttgcctcgtaaaagactactttccagagcccgttaccgtgtcctggaatagcggcgctctgacgagcggggtccatactttccctgccgtgcttcagagttctggactgtattccttgagctcggtggtcaccgttccatcttcctcactcggcacacagacttacatttgtaacgtgaatcacaagcccagtaacaccaaagtagataagaaagtggagcctaagagctgcgacaagacacatacctgtccaccgtgccccgcgcctgaactggccggtgcaccatccgtctttctgtttccccctaaaccaaaggatacgctcatgatctctcgtactcccgaggtgacatgtgttgtggtcgacgtgagccacgaagatccggaggtaaaatttaattggtatgttgacggggtggaggtccataacgctaagaccaaacctagagaggaacaatacaattcaacttatagggtggtcagtgtgttaacagttctgcaccaggattggcttaacggaaaggaatacaaatgcaaggtgtccaataaggccttgcccgcaccaattgagaaaaccatcagcaaggctaaaggccagcctcgggaaccccaggtatatacgctgccaccctctcgcgacgagctaaccaagaaccaagtctcactcacatgtctggtgaaaggcttctaccctagtgacatagccgttgagtgggaaagcaatgggcagccagagaacaattacaagactaccccgcccgtgcttgattccgacggatctttcttcctgtattcgaagttgacagtcgataaaagcagatggcagcaaggtaacgtgttttcctgctcagtaatgcacgaagcgctccataaccactacactcagaagagtctgtctttaagccctggcaaa

SEQ ID NO: 23855 - RNA, 657 nt, synthetic construct
  misc_feature 1..657: note = derived and/or modified sequence opt3 from Vedolizumab_LightChain1
  source 1..657: mol_type = other RNA
gacgtggtcatgacccagagccccctgtccctccctgttacaccaggcgagccggcctctatctcatgcagaagtagccaatcccttgctaagtcttacgggaacacttatctgtcgtggtacttgcagaaacccggacagtcacctcagttactgatttatggtataagcaataggttcagtggcgtgccagatcggttttccgggtctggaagcggcacggacttcaccctaaagatctcccgcgtagaagcagaggatgtgggtgtctactattgtctccaagggacacaccagccctacacttttggacagggcaccaaagtggaaattaagcgaacagttgccgcgccttcagtgttcatctttccacccagtgacgagcagctgaaaagcggcaccgcttctgtcgtgtgccttctgaacaatttctatcctcgtgaagccaaggtacaatggaaggttgataacgcattgcagtccggaaattcacaggagagcgtgactgagcaggacagtaaagattctacatactccctcagctcgaccctgacgctgtctaaggccgactacgaaaaacataaggtctatgcttgtgaggtgactcaccaagggctctcctcaccagtgaccaaaagttttaacagaggtgaatgc

SEQ ID NO: 23856 - RNA, 1353 nt, synthetic construct
  misc_feature 1..1353: note = derived and/or modified sequence opt3 from Veltuzumab_HeavyChain1
  source 1..1353: mol_type = other RNA
caggtgcaactgcagcagagcggcgccgaggtcaagaaacccgggtcctctgttaaggtgtcatgcaaagctagtggatacaccttcacaagctataacatgcactgggtaaagcaggcacctggtcaaggcctcgaatggatcggggccatttacccaggaatgggcgacacttcctataatcagaaatttaagggtaaggcgacgcttaccgctgatgagtctacaaacactgcctacatggaactgtcgtcattgagaagcgaggacaccgcattctattactgtgccaggagtacatattacgggggagattggtactttgacgtgtggggccagggcaccactgtcacagtgtcctctgctagcaccaaagggccgtccgttttccccttagcaccttcaagtaagagcacgtctggaggtactgccgctctgggctgcctagtgaaagattattttccagaacccgtcaccgtgtcctggaactcaggggccctcacaagcggagtacatactttccctgcggttctgcagagttctggcctttactccctgagctcggtggtcaccgtgccatcttcctcattgggtacacaaacctatatatgtaatgtgaatcacaagcccagtaacacgaaagtcgacaagcgggttgagcctaagagctgcgataaaactcatacatgtccaccgtgccccgcacctgagctcctcgggggaccatccgtgtttctgtttccccctaagccaaaagacaccctgatgatctctcgcactcccgaagtaacatgtgtggtcgtggatgttagccacgaggacccggaagtgaagtttaattggtacgtcgatggcgtggaggtacataacgccaaaaccaagcctcgagaggaacagtataattcaacgtaccgtgttgtgagtgtcttaaccgtgctgcaccaggactggcttaacggcaaagagtataagtgcaaggtctccaataaagccttgcccgctccaattgaaaagacaatcagcaaagcaaaggggcagcctagagagccccaagtgtacactctgccaccctctagggaagagatgaccaaaaaccaggtttcactaacatgtctcgtgaagggattctaccctagtgatattgctgtagagtgggaaagcaatggtcagccagagaacaattataagactaccccgcccgtcctggactccgacggctctttcttcctttactcgaaactgacagtggataagagccggtggcaacaggggaacgtgttttcctgctcagttatgcacgaagccttgcataaccactatacccagaaaagtctctctctgagccctggaaag

SEQ ID NO: 23857 - RNA, 639 nt, synthetic construct
  misc_feature 1..639: note = derived and/or modified sequence opt3 from Veltuzumab_LightChain1
  source 1..639: mol_type = other RNA
gacatccagctgacccaaagcccctcctctctctcagccagtgtgggcgatagagtcacaatgacttgcagggctagctcctctgtttcgtacattcactggttccagcagaaacctgggaaagcaccaaagccgtggatatatgccacgtcaaaccttgcgagcggagtgcccgtacggtttagtggttccggctctgggaccgactacacattcactatcagctccctgcagcctgaggatattgctacctattactgtcaacagtggacatcaaatccacccacctttggaggcggtactaaattggaaatcaagcgcacagtggccgcacctagtgtcttcatttttccacccagcgacgagcagttaaaatctgggaccgcctccgtggtttgcctgctaaacaatttctatcctcgagaagctaaggtgcagtggaaggtcgataacgcactccaatcaggaaatagccaggagagtgtgacggaacaggactctaaagattccacttacagcctgtcgtctacccttacactgtccaaggccgactatgagaaacataaggtatacgcttgtgaggttactcaccagggcttgtcaagtccagtgaccaagagctttaaccgtggcgaatgc

SEQ ID NO: 23858 - RNA, 1359 nt, synthetic construct
  misc_feature 1..1359: note = derived and/or modified sequence opt3 from Vesencumab_HeavyChain1
  source 1..1359: mol_type = other RNA
gaggtgcagctggtcgaaagcggcgggggactcgttcaacccggtggctcccttagactgtcttgcgccgcttcagggttcacctttagtagctacgcaatgtcctgggtgaggcaggcccctggaaagggcttggagtgggtatctcagatctcgccagcgggtgggtatacaaactacgctgactcagtgaaaggacggttcactattagcgccgatacgagtaagaataccgcatatttacagatgaactccctgcgcgccgaagacacagctgtctactattgtgcacgaggcgagctaccgtactatcgtatgtctaaagtgatggatgtttggggccaagggactctcgtgaccgtcagctccgcctcaacaaagggacccagtgtgtttcctctggctccaagctctaaatccacctcaggtggcactgccgcgcttgggtgcctggtaaaggactacttccccgaacctgttacagtgagctggaatagtggagcattgacctctggcgtccacacgtttccagccgtgctccagtccagcggtctgtactcgctgtcttccgtggtcactgttccctcaagtagcctcgggacccagacatatatatgtaacgtgaatcataagccttccaacactaaagtagataagaaagtggagccaaagtcttgcgacaaaacccacacatgtccgccctgccctgctccagagttactgggaggccccagcgtcttcctttttcctccaaagcccaaggataccttgatgatctcaagaacgccggaagtgacttgtgttgtggtcgacgtgagtcatgaggatcctgaagtaaaattcaattggtacgttgacggcgtggaggtccacaacgccaagacaaaacccagggaggaacagtataattccacctaccgggtggtcagcgtgctgactgttctacatcaagattggctcaacgggaaggagtataaatgcaaggtgtctaataaagcactgccagctcctattgaaaagacaatctcaaaggccaaaggacagccccgcgagccacaggtatacacccttccccctagtagagaagagatgacgaagaaccaggtcagcctgacctgtttggtgaaaggtttttatccatccgacattgcggttgagtgggaatctaatggccaaccggagaacaattacaagacaactccccctgtgctcgattcggacgggagcttctttctgtactccaaattaaccgtcgacaagtcaaggtggcagcagggaaacgtgttcagttgctctgtaatgcacgaagccctgcacaaccattatacacaaaagagcctctccctttcaccaggcaaa

SEQ ID NO: 23859 - RNA, 642 nt, synthetic construct
  misc_feature 1..642: note = derived and/or modified sequence opt3 from Vesencumab_LightChain1
  source 1..642: mol_type = other RNA
gacatccagatgacccaaagcccctcctctctgtcagccagtgtgggcgatagagtcacaattacttgcagggctagccagtacttctcctcttatctcgcatggtaccagcagaagcctgggaaagccccaaaacttctgatatatggagcgtcgtcacgggctagcggtgttccgagtcgcttttccggctctgggagcggaacggacttcaccttgacaatctcctcattacaacccgaggattttgccacttactattgtcagcagtacctgggcagtcctccaaccttcggtcaggggacaaaggtggaaattaagcgaaccgtagcagcccccagcgtgtttatcttccctccatctgacgagcaactaaaatccggaactgcttcagtcgtgtgcctcctgaacaatttttatccccgtgaagcaaaggttcagtggaaggtggataacgcccttcagagcggcaatagtcaggagtctgtcacagaacaagactccaaagatagcacctactcgctgtcttccacgttgactctctcaaaggctgactacgagaaacacaaggtgtatgcctgtgaggtaacccatcagggcctgagtagccctgttacaaaatccttcaacagaggggaatgc

SEQ ID NO: 23860 - RNA, 1338 nt, synthetic construct
  misc_feature 1..1338: note = derived and/or modified sequence opt3 from Visilizumab_HeavyChain1
  source 1..1338: mol_type = other RNA
caggtgcaactggtccagagcggcgccgaggttaagaaacccggggcttccgtgaaggtatcttgcaaagcatcaggatacaccttcatcagttatacaatgcactgggtgagacaggcccctggtcagggcctcgaatggatggggtacattaacccaaggagcggatatactcattacaatcaaaaacttaaggacaaggcgacgctgaccgctgataagtccgcctctacagcatatatggagttgtcgtcattacggagcgaagacactgccgtctactattgtgctcgcagtgcatactacgattatgacggctttgcctactggggtcaggggaccctggtgacagtttcctctgctagcaccaaaggaccgtccgtgttccccctagccccttgctcacgaagtactagcgagtctacagcggcactcggctgtctggtcaaggattattttccagaacccgtgaccgtatcctggaactcaggcgcccttacgagcggggttcacactttccctgctgtgctgcagagttctggattgtactccctcagctcggtcgtgaccgtgccatcttccaattttggtacacagacttatacctgcaacgtcgaccataaaccctcaaatacaaaggttgataaaaccgtggagcgtaagtgttgcgtagagtgtcctccatgcccggctccccctgcagctgccccaagtgtgttcctgtttccccctaagccaaaagacacgctgatgataagcagaactcccgaagtcacatgtgtggttgtggatgtctcccacgaggacccggaagtgcaattcaactggtacgtagatggcgttgaggtgcataatgcgaagaccaaacctagggaggaacagtttaactctactttccgggtcgtgagcgtcctcacagtggttcaccaggactggttaaatgggaaggagtataaatgcaaggtgtcaaacaaaggactgcccgccccaatcgaaaagaccattagtaagacgaaaggccagcctcgcgagccccaagtatacacccttccaccctccagagaagagatgacaaagaatcaggtcagcttgacttgtctggtgaaaggtttttacccttctgatatcgcagttgagtgggaatcaaacgggcagccagagaataactataagaccacaccgcccatgctagacagtgacggcagcttctttctctactccaaactgactgtggataagtctaggtggcaacagggaaatgtcttctcgtgcagcgtgatgcacgaagcccttcataaccactatacccagaagtccctgtcattgagtccttctaaa

SEQ ID NO: 23861 - RNA, 639 nt, synthetic construct
  misc_feature 1..639: note = derived and/or modified sequence opt3 from Visilizumab_LightChain1
  source 1..639: mol_type = other RNA
gacatccagatgacccaaagcccctcctctctgtcagccagtgtgggcgatagagtcacaattacttgcagcgcttcctcttcggtttcatacatgaactggtatcagcagaagcctgggaaagcaccaaagaggctcatatacgacacgagcaaacttgccagtggagtgccgtcccggttctctggtagcggctccgggaccgattttacactgactatctcaagtttgcagcccgaggacttcgcgacctattactgtcaacagtggagctctaatcctccaacatttggaggcggtaccaaggtagaaattaaacgcactgtggctgccccctccgtcttcatctttcctccatcagatgagcagttaaagagcgggacagcaagtgtggtttgcctgctaaacaatttctatccccgagaagccaaggtgcagtggaaagtcgacaacgctctccaatctggaaattcccaggagagcgtgaccgaacaggattcgaaggactctacgtactccctgtcaagtactcttaccctgagcaaagcagattatgagaagcacaaagtatacgcctgtgaggttacacatcagggcttgtcctctcctgtgactaagagctttaaccgtggcgaatgc

SEQ ID NO: 23862 - RNA, 1353 nt, synthetic construct
  misc_feature 1..1353: note = derived and/or modified sequence opt3 from Volociximab_HeavyChain
  source 1..1353: mol_type = other RNA
caggtgcaactgaaggagagcggccccgggctcgtcgccccttcccagtctctttcaattacctgcacaatcagtggattcagcctgactgactacggtgttcactgggtgagacagccaccgggcaaagggttggaatggttagtagtgatatggtccgatggatcttcgacgtataactcagctctgaagtccaggatgaccatccggaaagacaatagtaagtcccaggtctttctaattatgaactctctccaaacagatgacagcgcaatgtactattgtgcccgccatggcacttactatggtatgaccacaaccggggatgcgctggactactggggacagggcacttccgtgacagtttcaagtgctagcaccaaaggcccctctgtgttccctcttgccccatgctcccgatcaacgagcgagagtactgcagccctggggtgtttggtcaaggattattttcccgaacctgtgaccgtatcttggaatagcggagctctcacaagcggtgttcacactttcccagcagtgctgcagtcgtctggcctgtactccctctcaagtgtcgtgaccgtgcccagctcctctttagggacaaagacctacacgtgcaacgtcgaccataaacctagcaatactaaggttgataaacgtgtggagtcaaagtatggaccaccgtgtcccagttgccctgccccagaatttctgggcggtccctccgtattcctttttcctccaaaacccaaggacacattgatgatcagcagaaccccggaggtgacttgtgtcgtggttgatgtgtctcaggaggaccctgaagtccaattcaactggtacgtggatggggtagaggttcacaatgctaagacaaaacccagggaggaacagtttaactcaacctatcgggtggtcagtgtgctgacggtcctacatcaggactggctcaatggaaaggagtacaaatgcaaggtgagcaacaaaggcctgccatcctctattgaaaagaccatctcgaaagccaagggccagcctcgcgagccccaagtttatacacttccacccagccaggaagagatgactaagaatcaggtgtccctgacctgtttggtaaaagggttctacccttcagacatagcggtcgaatgggagagtaacggacaaccagagaataactataagacaactccgcccgtgctcgattctgacggtagctttttcctgtactccagattaaccgttgataaatcaaggtggcaggaaggcaatgtgtttagctgctctgtcatgcacgaggcactgcacaaccattacacacagaagtccctcagtcttagcctggggaaa

SEQ ID NO: 23863 - RNA, 645 nt, synthetic construct
  misc_feature 1..645: note = derived and/or modified sequence opt3 from Volociximab_LightChain
  source 1..645: mol_type = other RNA
cagatcgtgctgacccaaagccccgccattatgtccgcttctctcggcgagagagtcacaatgacttgcacggcatcaagtagcgtttcctctaactaccttcactggtatcagcagaaacctgggtcggccccaaatctgtggatatactcaaccagcaacttggcgagtggagtgccggctaggttctccggttctggcagcgggacatcctattcattaactatcagtagcatggaagccgaggacgcagccacctactattgtcatcagtacctgcggtctccccctacatttggaggcggtaccaaactagaaattaagcgcactgtagctgcaccatccgtgttcatctttcccccttcagatgagcaactcaaaagcgggacagccagtgtcgtgtgcctgcttaataacttctatccacgagaagctaaggttcagtggaaagtggacaatgccctgcagtctggaaactcccaggagagcgtcaccgagcaagattcgaaggactctacgtactccttgtcaagtactctcaccctgagcaaggcggattacgaaaaacacaaggtgtatgcatgtgaggtaacacatcagggcctgtcctctcccgttactaagagctttaatcgtggcgaatgc

SEQ ID NO: 23864 - RNA, 1344 nt, synthetic construct
  misc_feature 1..1344: note = derived and/or modified sequence opt3 from Vorsetuzumab_HeavyChain1
  source 1..1344: mol_type = other RNA
caggtgcaactggtccagagcggcgccgaggttaagaaacccggggcttccgtgaaggtatcttgcaaagcatcaggatacaccttcacaaactatggtatgaattgggtgagacaggcccctggccaggggctcaagtggatgggatggatcaacacttacacgggcgaaccaacctatgcggacgcttttaaaggtagggtcacaatgactcgggataccagtattagcacagcctacatggagctttcccgcctgcgatctgacgataccgcagtgtattactgtgcccgtgactatggggattacggaatggactactggggccaaggcactacagttaccgtgtcgtcagctagcacgaaggggccgagtgtcttccccttggcaccttcctctaagagcacttccggaggtaccgccgctttaggctgcctggtgaaagattattttccagaacccgtaacagtttcatggaatagtggggccctaactagcggagtgcacaccttccctgcggtcctccagtcttccggcctgtactcacttagcagtgtggtgacagtcccatcttccagcctgggtacccagacgtatatatgtaacgttaatcataagccctcgaacactaaagtggacaagaaagtagagcctaagtcttgcgataagacacacacctgtccaccgtgccccgcacctgaattgctcgggggaccatccgtgtttctgtttccccctaaaccaaaggacactctgatgatctcaagaacacccgaggtcacctgtgtggttgtggatgtcagtcatgaggacccggaagtgaaattcaattggtacgtagatggcgttgaggtgcacaacgccaagacgaaacctagggaagaacagtataatagcacctaccgggtcgtgtccgtcctcacagtgttacatcaagactggctgaacggcaaggagtataaatgcaaggtttctaataaggcccttcccgctccaattgagaaaactatcagcaaggcaaaagggcagcctcgcgagccccaggtgtacaccttgccaccctcaagagacgaactgacaaagaaccaggtaagtctaacttgtctcgtcaaaggattctacccttccgatattgctgtggagtgggaaagcaatggtcaaccagagaacaattataagaccacaccgcccgttctggactctgatggctcatttttcctttacagtaagctgaccgtggacaaatccaggtggcagcaggggaacgtctttagctgctctgtgatgcacgaggccttgcacaaccattatactcaaaagtcgctcagcctgtcccctggaaaa

SEQ ID NO: 23865 - RNA, 654 nt, synthetic construct
  misc_feature 1..654: note = derived and/or modified sequence opt3 from Vorsetuzumab_LightChain1
  source 1..654: mol_type = other RNA
gacatcgtgatgacccagagccccgattccctggccgtctctctcggcgagagagctacaattaactgcagggcatcaaagagtgttagcacttccgggtactctttcatgcactggtatcaacagaaacctggacagccaccgaaacttctgatatacttggcctcgaatttagaatcaggtgtgcccgaccggtttagcggcagtgggtccggaacggatttcaccctgacaatctctagcctacaggcggaggacgtagctgtgtattactgtcaacattcccgcgaagtcccttggacttttggccagggtaccaaggtggagattaagcgaacagttgccgcaccatcagtgttcatctttccccctagtgatgaacagctcaaaagcgggaccgcctctgtcgtgtgcctgcttaacaatttctatccacgtgaggctaaggtacagtggaaggttgacaacgcactgcaatccggaaattcacaggagagcgtgactgaacaggatagtaaagactctacatactccttgagctcgaccctcacgctgtctaaggccgattatgagaaacacaaggtctacgcttgtgaagtgactcatcagggcctgtcctcacccgtgaccaaaagttttaacagaggcgagtgc

SEQ ID NO: 23866 - RNA, 1344 nt, synthetic construct; identical to SEQ ID NO: 23864
  misc_feature 1..1344: note = derived and/or modified sequence opt3 from Vorsetuzumab_mafodotin_HeavyChain1
  source 1..1344: mol_type = other RNA

SEQ ID NO: 23867 - RNA, 654 nt, synthetic construct; identical to SEQ ID NO: 23865
  misc_feature 1..654: note = derived and/or modified sequence opt3 from Vorsetuzumab_mafodotin_LightChain1
  source 1..654: mol_type = other RNA

SEQ ID NO: 23868 - RNA, 1347 nt, synthetic construct; identical to SEQ ID NO: 23090
  misc_feature 1..1347: note = derived and/or modified sequence opt3 from Yttrium_(90Y)_clivatuzumab_tetraxetan_HeavyChain1
  source 1..1347: mol_type = other RNA

SEQ ID NO: 23869 - RNA, 645 nt, synthetic construct; identical to SEQ ID NO: 23091
  misc_feature 1..645: note = derived and/or modified sequence opt3 from Yttrium_(90Y)_clivatuzumab_tetraxetan_LightChain1
  source 1..645: mol_type = other RNA

SEQ ID NO: 23870 - RNA, 1338 nt, synthetic construct
  misc_feature 1..1338: note = derived and/or modified sequence opt3 from Yttrium_Y_90_epratuzumab_tetraxetan_HeavyChain1
  source 1..1338: mol_type = other RNA
caggtgcaactggtccagagcggcgccgaggttaagaaacccgggtcctctgtgaaggtatcatgcaaagctagtggatacaccttcacaagctattggctccactgggtgagacaggcacctggtcagggccttgaatggatcgggtacattaacccaaggaatgactatactgagtacaaccaaaattttaaggataaagccacgataaccgcggacgaatccacaaacactgcttatatggagctgtcttcgttgcggtcagaagataccgccttctacttttgtgcacgccgagacatcacaaccttctattggggacagggcactacagtcaccgtgagcagtgcctccacgaagggtccgtctgtttttcccttagctcctagctccaagtcaacaagtgggggaaccgcagccctgggctgcctagtgaaagattacttcccagagcccgtcacagtgagctggaactctggcgctctcacttccggggtacatacctttcctgccgttctgcagtcaagcggactttacagtctgtcttccgtggtcacagtgccaagctcgtctttgggtacccagacgtatatttgtaatgtgaatcacaagccctccaacactaaagtcgacaagcgtgttgagcctaaatcatgcgataagacacatacctgtccaccgtgccccgcgcctgaactcctgggcgggccaagtgtgttcctgtttccccctaagccaaaagacactctcatgatcagcagaacacccgaggtaacctgtgtggtcgtggatgtttcccacgaagacccggaggtgaagttcaattggtacgtcgatggagtggaggtacataacgcaaaaacgaagcctagggaggaacaatataattctacctaccgggttgtgagcgtcttaacagtgctgcaccaggactggcttaacggcaaagaatataagtgcaaagtctcaaataaggccttgcccgctccaattgagaagactatcagtaaagccaagggtcagcctcgcgaaccccaggtgtacaccctgccaccctccagagaggagatgactaaaaaccaagttagcctaacttgtctcgtgaaggggttttatccttctgatatagcagtagaatgggagtcaaatggacagccagaaaacaactacaaaaccacaccgcccgtcctggacagtgacggcagcttctttctttactccaagctgaccgtggataagtctaggtggcagcaaggcaatgttttctcgtgcagcgtgatgcacgaggctttgcataaccactatactcagaaatccctctcactgagtcctgggaag

SEQ ID NO: 23871 - RNA, 657 nt, synthetic construct
  misc_feature 1..657: note = derived and/or modified sequence opt3 from Yttrium_Y_90_epratuzumab_tetraxetan_LightChain1
  source 1..657: mol_type = other RNA
gacatccagctgacccaaagcccctcctctctctcagccagtgtgggcgatagagtcacaatgagctgcaagtcctctcagtcggttctttactcagctaaccacaaaaattatctggcatggtaccagcagaagcctgggaaagccccaaagttgttaatttattgggcgagcactagggagagtggagtgccgtcccggttctctggtagcggctccgggacggactttaccttcacaatatcaagtctgcaacccgaagatatcgctacttactattgtcatcagtacctaagctcttggacctttggaggcggtacaaaagtacagattaagcgcaccgtggccgcaccttccgtcttcatctttccaccctcagacgagcagctcaagagcgggactgccagtgtggtttgcctgcttaacaatttctatcctcgagaagctaaagtgcaatggaaggtcgataacgcactgcagtctggaaattcccaggagagcgtgacagaacaggactcgaaagattctacctactccttgtcaagtacgctcactctgagcaaggccgactacgagaaacacaaggtatatgcttgtgaggttacccatcaaggcctgtcctctccagtgacaaagagctttaaccgtggcgaatgc

SEQ ID NO: 23872 - RNA, 1326 nt, synthetic construct
  misc_feature 1..1326: note = derived and/or modified sequence opt3 from Yttrium_Y_90_epratuzumab_HeavyChain1
  source 1..1326: mol_type = other RNA
caggtgcaactggtccagagcggcgccgaggttaagaaacccgggtcctctgtgaaggtatcatgcaaagctagtggatacaccttcacaagctattggctccactgggtgagacaggcacctggtcagggccttgaatggatcgggtacattaacccaaggaatgactatactgagtacaaccaaaattttaaggataaagccacgataaccgcggacgaatccacaaacactgcttatgagctgtcttcgttgcggtcagaagataccgccttctacttttgtgcacgccgagacatcacaaccttctattggggacagggcactacagtcaccgtgagcagtgcctccacgaagggtccgtctgtttttcccttagctcctagctccaagtcaacaagtgggggaaccgcagccctgggctgcctagtgaaagattacttcccagagcccgtcacagtgagctggaactctggcgctctcacttccggggtacatacctttcctgccgttctgcagtcaagcggactttacagtctgtcttccgtggtcacagtgccaagctcgtctttgggtacccagacgtatatttgtaatgtgaatcacaagccctccaacactaaagtcgacaagcgtgttgagcctaaatcatgcgataagacacatacctgtccaccgtgccccgcgcctgaactcctgggcgggccaagtgtgttcctgtttccccctaagccaaaagacactctcatcagcagaacacccgaggtaacctgtgtggtcgtggatgtttcccacgaagacccggaggtgaagttcaattggtacgtcgatggagtggaggtacataacgcaaaaacgaagcctagggaggaacaatataattctacctaccgggttgtgagcgtcttaacagtgctgcaccaggactggcttaacggcaaagaatataagtgcaaagtctcaaataaggccttgcccgctccaattgagaagactatcagtaaagccaagggtcagcctcgcgaaccccaggtgtacaccctgccaccctccagagaggagactaaaaaccaagttagcctaacttgtctcgtgaaggggttttatccttctgatatagcagtagaatgggagtcaaatggacagccagaaaacaactacaaaaccacaccgcccgtcctggacagtgacggcagcttctttctttactccaagctgaccgtggataagtctaggtggcagcaaggcaatgttttctcgtgcagcgtgcacgaggctttgcataaccactatactcagaaatccctctcactgagtcctgggaag

SEQ ID NO: 23873 - RNA, 654 nt, synthetic construct
  misc_feature 1..654: note = derived and/or modified sequence opt3 from Yttrium_Y_90_epratuzumab_LightChain1
  source 1..654: mol_type = other RNA
gacatccagctgacccaaagcccctcctctctctcagccagtgtgggcgatagagtcacaagctgcaagtcctctcagtcggttctttactcagctaaccacaaaaattatctggcatggtaccagcagaagcctgggaaagccccaaagttgttaatttattgggcgagcactagggagagtggagtgccgtcccggttctctggtagcggctccgggacggactttaccttcacaatatcaagtctgcaacccgaagatatcgctacttactattgtcatcagtacctaagctcttggacctttggaggcggtacaaaagtacagattaagcgcaccgtggccgcaccttccgtcttcatctttccaccctcagacgagcagctcaagagcgggactgccagtgtggtttgcctgcttaacaatttctatcctcgagaagctaaagtgcaatggaaggtcgataacgcactgcagtctggaaattcccaggagagcgtgacagaacaggactcgaaagattctacctactccttgtcaagtacgctcactctgagcaaggccgactacgagaaacacaaggtatatgcttgtgaggttacccatcaaggcctgtcctctccagtgacaaagagctttaaccgtggcgaatgc

SEQ ID NO: 23874 - RNA, 1365 nt, synthetic construct
  misc_feature 1..1365: note = derived and/or modified sequence opt3 from Zalutumumab_HeavyChain1
  source 1..1365: mol_type = other RNA
caggtgcaactggtcgagagcggcgggggagttgtgcagcccggtagatccctcaggctttcttgcgccgcttcaggcttcacctttagtacatacgggatgcactgggtacggcaggcacctggaaagggcctggaatgggtggccgtcatctgggacgatggtagctataaatactatggggactccgtgaagggacgcttcactatttctcgagataactcgaaaaatacgttgtacttacagatgaactcactgcgtgcggaggacaccgctgtttattactgtgccagagatggcataacaatggtgaggggcgtcatgaaggactattttgattactgggggcaaggaactctagtgaccgtaagcagtgcatccacaaaaggtccatctgttttcccgctcgcccccagctccaagtcaaccagtggcgggactgctgcactgggatgccttgtgaaggactactttcctgaaccagtcacagtgagctggaactctggcgccctgacctccggtgtgcatacgttccccgctgtcttgcagtcaagcgggctctatagtctgtcttccgttgtgactgtacctagctcgtctctgggaacccagacatacatctgtaatgtgaatcacaaaccatccaacactaaggtcgataaacgggtggagcccaagtcatgcgacaaaacccatacatgtcctccatgcccggcccccgaactcttaggcggccctagtgtttttctgttcccacccaagcctaaggatacccttatgattagccgcacgccagaggtgacttgtgtcgtggtagacgtttcccacgaggatcccgaagtgaaatttaattggtatgtcgacggggtggaggtccataacgcgaagacaaaaccgagagaggaacagtacaattctacctatagggtggttagcgtgttgactgtactgcaccaagactggctaaacggaaaggagtacaaatgcaaggtctcaaataaagcactccctgcccccatcgaaaagacaattagtaaggctaaaggtcagccacgggagcctcaggtgtataccctgcccccatcccgcgaagagatgacgaagaaccaggttagccttacctgtctggtgaaaggcttctacccctctgatatcgccgtcgaatgggagtcaaatgggcaacctgagaacaattacaagacaactccaccggtgttggacagtgatggcagctttttcctctattccaaactgaccgtagacaagtctcgatggcagcagggaaacgtgttttcgtgcagcgttatgcacgaagcattacataaccactacacacaaaagtccctgtcactcagtcccggtaaa

SEQ ID NO: 23875 - RNA, 642 nt, synthetic construct
  misc_feature 1..642: note = derived and/or modified sequence opt3 from Zalutumumab_LightChain1
  source 1..642: mol_type = other RNA
gccatccagctgacccaaagcccctcctctctctcagctagtgtgggcgacagagtcacaattacttgcagggcaagccaggatatatcctctgcccttgtttggtaccagcagaagcctgggaaagcgccaaagctgttgatctatgacgcttcgtcattagagagcggagtgccgagtcggttctccggttctgaaagcggcacggattttaccctgacaatttcctcactacaacccgaggacttcgccacttactattgtcagcagtttaacagttaccctctcaccttcgggggaggcacaaaagtagaaatcaagcgcaccgtggcagccccaagcgtctttatttttcccccttctgatgagcagctgaaatccggtactgcttcagtggtttgccttctgaataacttctatccacgagaagcaaaggtgcaatggaaggtcgacaatgccttgcagagcgggaacagtcaggagtctgtgacagagcaggattccaaagacagcacctactcgctctcttccacgctgactctgtcaaaggctgattatgaaaaacacaaggtatacgcctgtgaggttacccatcaaggactcagtagccccgtgacaaaatccttcaatcgtggcgaatgc

SEQ ID NO: 23876 - RNA, 1332 nt, synthetic construct
  misc_feature 1..1332: note = derived and/or modified sequence opt3 from Zanolimumab_H0_HeavyChain
  source 1..1332: mol_type = other RNA
caggtgcaactgcagcagtggggcgccgggctccttaagcccagcgagaccctgtccttgacatgcgctgtctacggaggttctttctcaggctattactggagttggatcagacagcctccagggaaaggattagaatggattggcgagataaaccacagcggttccactaattataacccgtctctgaagtcgagggttacgatctcagtggacaccagcaaaaatcaatttagtctaaagctctcctctgtaacagcagccgatactgcggtgtactattgtgctcgggtcattaactggttcgacccctgggggcagggaaccctggtgacagttagctccgcctcaaccaaaggccctagtgtgtttccacttgcacccagctctaagtccacttcaggcgggacagccgctctgggatgcttggtcaaggattacttccctgaaccagtgaccgtaagctggaatagtggtgcactcacgtctggcgttcatacttttcccgccgtgctgcagtccagcgggctgtattcgctctcttcctggaccgtcccttcaagtagcttaggaacacagacttacatctgtaacgtgaatttcattaaaccatccaacaccaaggtggacaaaaaggtcgagccgaaatcttgcgataagacacacacctgtcccccttgcccagctcccgaactgcttggcggtcctagcgtgtttttgttcccacccaagccgaaagacacgctgatgatctcacgcactcctgaggttacatgtgtatgggatgtgagtcatgaggaccccgaagtcaagtttaattggtacgtggatggggttgaggtgcacaacgccaaaaccaagccacgagaggaacaatataattccacttaccgtgtcgtgagcgtactaacagttctccatcaggactggctgaacggaaaagagtataagtgcaaagtgtctaataaggcgcttcctgcacccatagaaaagaccatctcaaaagccaagggccagccaagagagccccaggtctacacgctgcctccaagtagggaagagatgaccaaaaaccaagtgagcttgacatgtctcgtcaagggcttctatccgtccgatattgctgtggaatgggagtctaatgggcagcccgagaacaactacaaaactacccctccagttctggactcggatggtagctttttcttatattccaagctgacagtggacaagtcacggtggcagcaaggaaatgtatttagttgctctgtcatgcacgaagccctccacaaccattacactcagaaaagcctttccctgtcacccggcaag

SEQ ID NO: 23877 - RNA, 642 nt, synthetic construct
  misc_feature 1..642: note = derived and/or modified sequence opt3 from Zanolimumab_L0_LightChain
  source 1..642: mol_type = other RNA
gacatccagatgacccaaagcccctcctctgtgtcagccagtgtcggcgatagagttacaattacttgcagggctagccaggacatatcctcttggctggcagtggtataccagcacaagcctgggaaagccccaaagctccttatctatgcggcttcgtcactgcagagcggagtgccgagtcggttctccggttctggcagcgggacggattttaccttgacaatttcctcattacaacccgaggacttcgccacttactattgtcagcaggcaaacagttttccttacaccttcggaggcggtacaaaactggaaatcaagcgcaccgtcgccgctccaagcgtgtttatttttcccccttctgatgagcagctaaaatccgggactgcatcagttgtgtgcctcctgaataacttctatccacgagaagccaaggtccaatggaaggtggacaatgcccttcagagcggaaacagtcaggagtctgtaacagaacaggattccaaagacagcacctactcgctgtcttccacgttgactctctcaaaggctgattatgagaaacataaggtttacgcgtgtgaggtgacccaccaaggcctgagtagccccgtcacaaaattcaatcgtggcgaatgc

SEQ ID NO: 23878 - RNA, 1344 nt, synthetic construct; identical to SEQ ID NO: 23497
  misc_feature 1..1344: note = derived and/or modified sequence opt3 from Zatuximab_HeavyChain1
  source 1..1344: mol_type = other RNA

SEQ ID NO: 23879 - RNA, 657 nt, synthetic construct; identical to SEQ ID NO: 23498
  misc_feature 1..657: note = derived and/or modified sequence opt3 from Zatuximab_LightChain1
  source 1..657: mol_type = other RNA

SEQ ID NO: 23880 - RNA, 1356 nt, synthetic construct
  misc_feature 1..1356: note = derived and/or modified sequence opt3 from Actoxumab_HeavyChain
  source 1..1356: mol_type = other RNA
caggtgcaactggtcgagagcggcgggggagttgtgcagcccggtagatccctcaggctttcttgcgccgcttcaggcttcagttttagcaactacgggatgcactgggtacggcaggcacctggaaagggcctggaatgggtggccttgatctggtatgacggttccaatgaggattacaccgactctgtcaaagggcgcttcacaatttcgcgagataactcaaagaatactttatatctgcagatgaacagcctacgtgcggaagacacggctgtgtactattgtgccagatggggaatggttaggggcgtgatagatgtctttgacatctggggccaagggaccgtggtaacagttagttccgcatctactaaaggaccaagcgtgttcccgctcgccccctcctcaaagagtaccagcggtggcacagctgcactggggtgccttgtcaaagattactttcctgagccagtgaccgtgtcttggaactccggagccctgacttcaggcgtccatacattccccgctgttttgcagagcagtggtctctattctctgtccagcgtggtaaccgtgccttcgtcttccctggggacgcagacttacatttgtaatgtcaatcacaagccatcaaacaccaaggtggacaaacgggttgaacccaagagttgcgataaaacacatacttgtcctccatgcccggcccccgagctcttaggaggccctagcgtgtttctgttcccacccaagcctaaagacacccttatgatctcccgcacaccagaggtcacctgtgtggtagttgatgtgtctcacgaagaccccgaggtcaagtttaattggtacgtggatggcgtcgaagtgcataacgcgaagacgaaaccgagagaggagcagtataatagcacttacagggttgtgtcagtattgacagtcctgcaccaagactggctaaacgggaaggaatataaatgcaaggtgagtaataaagcactccctgcccccattgagaagaccatctccaaagctaagggacagccacgggaacctcaggtttacactctgcccccaagccgcgaggaaatgacaaagaaccaggtgtctcttacctgtctggtcaaaggtttctatccctcagacatagccgtggagtgggagagtaatggccaacctgaaaacaactacaagacgaccccaccggtattggatagcgacgggtcctttttcctctattctaaactgacagtggataagtcgcgatggcagcagggaaatgtttttagctgctccgtcatgcacgaggcattacataaccactacactcaaaaatcactgagtctctctcccggcaag

SEQ ID NO: 23881 - RNA, 642 nt, synthetic construct
  misc_feature 1..642: note = derived and/or modified sequence opt3 from Actoxumab_LightChain
  source 1..642: mol_type = other RNA
gacatccagatgacccaaagcccctcctctgtgtcagccagtgtcggcgatagagttacaattacttgcagggctagccaggggatatcctcttggctggcatggtaccagcacaagcctggaaaagccccaaagctccttatctatgcggcttcgtcactgcagagcggtgtgccgagtcggttctccggctctgggagcggaacggactttaccttgacaatttcctcattacaacccgaggatttcgccacttactattgtcagcaggcaaacagttttccttggaccttcggccagggtacaaaagtagaaatcaagcgcaccgtggccgctccaagcgtctttatttttcccccttctgacgagcaactgaaatccgggactgcatcagtggtttgcctactcaataacttctacccacgagaagccaaggtgcagtggaaggtcgataatgctctgcagagcggaaacagtcaggagtctgtgacagaacaagactccaaagatagcacctattcgctttcttccacgctgactttgtcaaaggccgactacgagaaacataaggtatatgcgtgtgaggttacccaccagggcctcagtagccccgtgacaaaatccttcaatcgtggcgaatgc

SEQ ID NO: 23882 - RNA, 1326 nt, synthetic construct
  misc_feature 1..1326: note = derived and/or modified sequence opt3 from Andecaliximab_HeavyChain
  source 1..1326: mol_type = other RNA
caggtgcaactgcaggagagcggccccgggctcgtcaagccttccgaaaccctttctctgacatgcactgtttcaggattcagtttgttaagctacggtgtgcactgggtaagacagccaccgggcaaagggctggagtggctaggagtgatctggacgggcggtaccacaaactataattccgccctcatgtctaggtttactatttcgaaggacgattcaaagaacaccgtctacctgaaaatgaatagccttaaaacagaagacaccgctatatattactgtgcacggtattactatgggatggattactggggacagggcactctggtgacagttagttccgcctctaccaagggccccagcgtgttccctttggcgccatgctcccgctcaacgagtgagagcactgctgccctcgggtgtctggtcaaggactactttcccgaacctgtgaccgtatcttggaactccggagcactgacatcaggtgttcatactttcccagccgtgctccaaagcagtggcttatattctctgtccagcgtcgtgaccgtgccctcgtcttcccttgggacaaaaacctacacgtgcaatgtcgatcacaagccttcaaacactaaagttgacaagcgagtggagagtaaatatggaccaccgtgtcccccttgcccagctcccgagtttttgggcggtcctagcgtattcctgtttccacccaagccgaaggatacactaatgatctcccgtacccctgaagtgacttgtgtcgtggttgacgtgtctcaggaggatcccgaagtccagttcaattggtacgtggacggggtagaggttcataacgcaaaaacaaagccaagagaggaacagtttaatagcacctatagggtggtctcagtgctcacggtcctgcaccaagattggcttaacggaaaagagtacaagtgcaaagtgagtaataagggcctgccttccagcattgagaaaaccatctctaaggccaagggccagccccgggaaccacaggtttatacattgcccccttcacaggaagagatgactaaaaaccaagtgagtctcacctgtctggtaaaggggttctacccaagcgacattgctgtcgagtgggaatccaatggacagccggagaacaattacaaaacaactccccctgtgttagattctgacggttcgtttttcctgtatagccgcctcaccgttgacaagtccagatggcaggaaggcaacgtgttttcatgcagtgtcatgcatgaggcccttcacaaccactacacacaaaaatctctgagcttgtccctagggaag

SEQ ID NO: 23883 - RNA, 642 nt, synthetic construct
  misc_feature 1..642: note = derived and/or modified sequence opt3 from Andecaliximab_LightChain
  source 1..642: mol_type = other RNA
gacatccagatgacccaaagcccctcctctctgtcagccagtgtgggcgatagagtcacaattacttgcaaggctagccaggacgttaggaacacggtggcatggtaccagcagaaacctgggaaggccccaaaactccttatatattcctcttcgtaccggaataccggagtaccggatcgcttctcaggtagcggcagtgggacagactttactctgaccatctcctctttgcaagcggaggatgtggctgtctattactgtcagcagcactatattacaccctacaccttcggaggcggtactaaggtggaaatcaaacgaacagttgccgcacctagcgtgtttattttcccaccctccgacgagcagttaaagtcagggaccgccagtgtcgtgtgcctgctaaacaatttttatcctcgtgaagctaaggtacaatggaaagttgataacgcactccagagcggaaattctcaggagtccgtgacggaacaggactcaaaggatagcacttacagtctgtcttccacccttacactgagcaaagccgactacgagaagcataaagtctatgcttgtgaggtgactcaccaaggcttgtcgtctccagtgaccaagtccttcaacagaggcgaatgc

SEQ ID NO: 23884 - RNA, 1353 nt, synthetic construct
  misc_feature 1..1353: note = derived and/or modified sequence opt3 from Aprutumab_HeavyChain
  source 1..1353: mol_type = other RNA
gaggtgcagctgctcgaaagcggcgggggacttgtccaacccggtggctccctgagattgtcttgcgccgcttcagggttcacctttagtagctacgcaatgtcctgggttaggcaggcccctggaaagggcttagagtgggtgtctgcgatctcgggttcagggacaagcacttattacgctgacagtgtaaaaggacggttcacgatttcccgcgataactctaagaataccctgtatctacagatgaacagcctccgagccgaagacacagcagtgtactattgtgcccgtgtcagatacaattggaaccacggcgattggtttgacccatggggccaggggactctggtgaccgtttcctcagctagtacaaaaggaccgagcgtgttcccccttgcaccttcttccaagtcaaccagcggtggcactgccgctctggggtgcttggtcaaagattattttccagagcccgtgacagtaagttggaactctggagccctcacctccggcgttcatacgttccctgcggtgctgcaaagctcgggtctgtactctctctcctcagtcgtgactgtgccaagtagctccttagggacccagacatacatatgtaatgtcaatcacaagccctctaacactaaggttgacaaaaaggtggaacctaaaagctgcgataagacccatacatgtccaccgtgccccgcacctgagctgcttggaggcccatcagtatttttgtttccccctaaaccaaaggacaccctgatgatcagtaggacgcccgaggtgacttgtgtcgtggttgatgtgtcccacgaagacccggaggtcaagttcaattggtatgtggatggcgtagaagttcataacgccaaaacaaagcctcgggaggagcagtacaatagcacctatcgcgtggtctctgtgctaactgtcctccaccaggactggctgaacgggaaagaatacaagtgcaaagtgtcaaataaggcccttcccgctccaattgagaaaacaatcagtaaggcaaagggacaacctagagaaccccaggtttataccctgccacccagcagggatgagttgacgaaaaaccaggtgtccctcacctgtctggtaaagggtttctacccttctgacattgctgtcgaatgggagtcgaatggccagccagagaacaactataaaacaactccgcccgtgttagacagcgatgggtcctttttcctgtactcaaagctcaccgttgacaaaagtcggtggcaacagggaaatgtgttttcttgcagcgtcatgcacgaagcccttcataaccactacacacagaagtccctgtcattgagccctggc

SEQ ID NO: 23885 - RNA, 648 nt, synthetic construct
  misc_feature 1..648: note = derived and/or modified sequence opt3 from Aprutumab_LightChain
  source 1..648: mol_type = other RNA
cagagcgtgctgacccaacccccttccgcctctggcacaccagggcagagagtcactatctcatgcagtggaagctcctctaacattggtaataactacgtttcgtggtatcagcagctcccgggcacggctcccaaacttctgatatacgagaattataacaggcctgcaggggtgccagaccggttctcaggaagcaaaagtggcacctccgcctctttggcgatcagcggtttacgctccgaagatgaggctgactactattgttcaagttgggatgacagcctgaattactgggtatttgggggaggcacaaagctaactgtgctcggccaacccaaagccgcaccttctgtcaccctgttcccaccctcctcagaggaacttcaggccaacaaggctacactggtgtgcttgattagcgatttttatcctggggcagttaccgtggcctggaaagctgacagttctccagtcaaggccggagtggaaactacaaccccgtccaagcagagcaataacaaatacgcggcatcgtcttacctctccctgacgcccgagcagtggaagtcacaccgaagttatagctgtcaagtaactcatgagggttccaccgttgaaaagacagtggcccctactgagtgctct

SEQ ID NO: 23886 - RNA, 1341 nt, synthetic construct
  misc_feature 1..1341: note = derived and/or modified sequence opt3 from Azintuxizumab_HeavyChain
  source 1..1341: mol_type = other RNA
gaggtgcagctggtcgaaagcggcgggggactcgttcaacccggtggctcccttagactgtcttgcgccgcttcagggttcacctttagtgactactatatggcatgggtgaggcaggcccctggaaagggcttggagtgggtagcgagcatcaactacgatggttcctctacatattacgtggactcggtcaaagggcggttcactatttcacgcgataatgctaagaacagcttatatctgcagatgaatagtctacgagccgaagacacggcagtgtactattgtgcccgtgatagaggatactactttgactattggggccagggcaccacagttactgtgtcctctgctagcaccaaagggccatccgtcttcccgctcgcaccctcaagtaagagcacatctggaggtaccgccgctctgggctgccttgtgaaagattactttcctgagccagtaactgtttcctggaactcaggggccctgacaagcggagtgcacaccttccccgcggtcttgcaaagttctggcctctattccctgagctcggtggtgacggtcccttcttcctcactgggtactcagacctacatatgtaatgttaaccataagccaagtaatacaaaggtggacaaaaaggtagaacccaaaagctgcgataagactcacacctgtcctccatgcccggcacccgagctcttagggggaccttccgtgtttctgttcccacccaaacctaaggacacacttatgatctctaggaccccagaggtcacgtgtgtggttgtggatgtcagccatgaagaccccgaggtgaagtttaactggtatgtagatggcgttgaagtgcacaatgccaaaactaagccgcgggaggagcagtacaactcaacatatcgcgtcgtgagtgtcttgaccgtgctgcatcaggactggctaaatggcaaagaatacaagtgcaaagtttccaacaaggctctccctgcccccattgagaaaactatcagcaaggcaaaggggcaaccaagagaacctcaggtgtacacactgcccccatctagggaggaaatgaccaaaaatcaggtatcacttacgtgtctggtcaagggattctatcccagtgacattgctgtggagtgggagagcaacggtcagcctgaaaataactacaaaaccacaccaccggttttggattccgacggctcgtttttcctctattctaagctgactgtggataaaagccggtggcaacaggggaacgtcttttcctgctcagtgatgcacgaggccttacacaatcattacacccagaagagtctgtctctcagccccggaaag

SEQ ID NO: 23887 - RNA, 660 nt, synthetic construct
  misc_feature 1..660: note = derived and/or modified sequence opt3 from Azintuxizumab_LightChain
  source 1..660: mol_type = other RNA
gacgtggtcatgacccagacacccctgagcctctccgttactcctggccaaccagcctctatctcatgcagaagtagccagtcccttgtgcactctaacgggaatacgtacctgcattggtatttgcagaaaccgggacagtcgccccaattactgatttacaaagtatcaaacaggttcagcggtgtgcctgatcggtttagtggctccgggtctggaaccgacttcacactaaagataagccgcgtcgaggctgaagatgtgggcgtttatttttgttcccagtcaactcacgtgccacccttcacctttggtgggggaacaaaagtcgagatcaagcgaaccgtggcagcccctagtgtattcatttttccacccagcgacgaacagctcaaatctggcactgcgtccgttgtgtgcctgcttaataacttctaccctcgtgaggctaaggtccagtggaaggtggataatgccctgcaatcaggcaacagccaggaaagtgtgacagagcaggactctaaagattccacctatagcttgtcgtctacgctcactctgtccaaggcagactacgagaaacataaggtctatgcctgtgaagttacccaccaggggctgtcaagtccagtgacaaagagctttaatagaggagagtgc

SEQ ID NO: 23888 - RNA, 366 nt, synthetic construct
  misc_feature 1..366: note = derived and/or modified sequence opt3 from Blinatumomab_HeavyChain1
  source 1..366: mol_type = other RNA
caggtgcaactgcagcagagcggcgccgagctcgtcagacccgggtcctctgttaagatctcatgcaaagctagtggatacgcattcagctcctattggatgaactgggtgaagcagaggcctggtcaaggccttgaatggattgggcagatatggccaggagacggcgataccaattacaacggtaaatttaaggggaaagccacactgactgcggacgagtcttcgtcaacggcttatatgcagttgagcagtttagcctccgaagattctgcagtatacttctgtgcccggcgcgagaccacaactgtgggacgatattactatgctatggactactggggccagggcaccacagtcaccgtg

SEQ ID NO: 23889 - RNA, 363 nt, synthetic construct
  misc_feature 1..363: note = derived and/or modified sequence opt3 from Blinatumomab_HeavyChain2
  source 1..363: mol_type = other RNA
gacatcaagctgcagcaaagcggcgccgagctcgctagacccggggcatccgtgaaaatgtcttgcaagacctcaggatacacattcactaggtatacgatgcactgggtcaaacagcggcctggtcagggccttgaatggattgggtacataaacccaagtcgcggatataccaattacaaccagaagtttaaagataaggccacactgactaccgacaagagctcctctacagcgtatatgcaattgtcgtcattaaccagcgaggatagtgctgtttactattgtgcccgatactacgacgatcattattgcctggactactggggccagggtactacactaaccgtgtcctctgtagaa

SEQ ID NO: 23890 - RNA, 1494 nt, synthetic construct
  misc_feature 1..1494: note = derived and/or modified sequence opt3 from Blinatumomab_LightChain_HeavyChain_HeavyChain_LightChain
  source 1..1494: mol_type = other RNA
gacatccagctgacccaaagccccgcctccctcgctgtgtctcttggccagagagcaacaatttcatgcaaggccagtcagagcgtcgattacgacggggattcctatctgaactggtaccagcaaatacctggacagccaccgaaattgttaatctatgacgcgtctaatctggtttcgggtattccccctaggttctcaggcagcgggagtggaactgattttacgctaaacatccacccagtggagaaggtagacgctgccacctaccattgtcagcagtccacagaagatccctggactttcggcggtgggaccaaactcgagattaagggaggcggcgggtctggaggtggcgggagcggaggcggtgggtcccaagtgcagctgcagcagtcaggagcagaacttgtccggcctggcagtagcgtgaaaatctcttgcaaggcctccggctatgctttttcaagctactggatgaattgggttaagcaacgcccagggcagggactggagtggataggtcagatctggcccggcgacggggatacaaactataatggaaaattcaagggcaaagcaaccttgactgccgacgaaagttcttccacagcttacatgcaactcagctcgctggcctctgaggattccgcggtgtacttttgtgcacgacgtgagaccacgactgtcggtagatattactatgccatggactactgggggcagggcaccacagtgactgtatcaagtggaggcgggggaagcgatattaagctgcagcagtccggtgctgaactcgccaggcctggcgcatctgttaaaatgagctgcaagacctcagggtatacattcacccggtacacgatgcactgggtgaagcaacgcccaggacagggcttagagtggatcggttatattaacccgagtagagggtacactaattacaaccagaaatttaaggacaaagctacactgaccactgacaagtccagctctacagcctatatgcagctttcaagtttgaccagcgaagattccgcggtctactattgtgccaggtactatgacgatcattactgcctggactattggggccaaggaacgaccctaacagtgtcttcggtggagggcgggagcggaggttccggcgggtcaggaggcagtggtggggtcgatgacatccagctcactcagtctcccgcaataatgagcgcttcccctggcgagaaagttaccatgacatgtcgggcctcaagctctgtgtcctacatgaattggtaccagcaaaagagtggaactagcccaaaacgctggatttatgatacctctaaggtagcttccggcgtgccctaccgattctcagggagtggaagcggcacatcgtattccctgaccatctctagcatggaagccgaggacgcagccacttactattgccagcagtggtcaagtaaccctcttacgtttggtgctgggacaaagctggaattgaaa

SEQ ID NO: 23891 - RNA, 333 nt, synthetic construct
  misc_feature 1..333: note = derived and/or modified sequence opt3 from Blinatumomab_LightChain1
  source 1..333: mol_type = other RNA
gacatccagctgacccaaagccccgcctccctcgctgtgtctcttggccagagagcaacaatttcatgcaaggccagtcagagcgtcgattacgacggggattcctatctgaactggtaccagcaaatacctggacagccaccgaaattgttaatctatgacgcgtctaatctggtttcgggtattccccctaggttctcaggcagcgggagtggaactgattttacgctaaacatccacccagtggagaaggtagacgctgccacctaccattgtcagcagtccacagaagatccctggactttcggcggtgggaccaaactcgagattaag

SEQ ID NO: 23892 - RNA, 324 nt, synthetic construct
  misc_feature 1..324: note = derived and/or modified sequence opt3 from Blinatumomab_LightChain2
  source 1..324: mol_type = other RNA
gtggacgatatccagctgacccaaagccccgccattatgtccgcttctcctggcgagaaggtcacaatgacttgcagagcatcaagtagcgtttcctacatgaactggtatcagcagaaatctgggacgtcgccaaagaggtggatatacgacacctcaaaagtggccagcggagtaccgtatcggttcagtggttccggctctgggacaagctactccctcactatctcaagtatggaagcggaggatgctgccacctattactgtcagcaatggagctctaatccccttacatttggagcaggcaccaagctggaattgaaa

SEQ ID NO: 23893 - RNA, 1350 nt, synthetic construct
  misc_feature 1..1350: note = derived and/or modified sequence opt3 from Brazikumab_HeavyChain
  source 1..1350: mol_type = other RNA
caggtgcaactggtcgagagcggcgggggagttgtgcagcccggtagatccctcaggctttcttgcgctgcttcaggcttcacctttagtagctacgggatgcactgggtacggcaggcacctggaaagggcctggaatgggtggccgtcatctggtatgacggttccaacgagtactatgcggattctgtgaaagggcgcttcacaatttcgcgagacaattcaaagaacactttgtacttacagatgaatagcctgcgtgctgaagatacggccgtttattactgtgcaagagacaggggatataccagttcctggtacccagatgcctttgacatatggggccaaggcacaatggtgactgtctctagcgcttccaccaaagggccgtcagtgttccccctagcaccttgcagtcggagcacatctgagtccaccgccgctctcggatgtctggtaaaggattactttccagaacccgttactgtgtcatggaacagcggtgcccttacaagtggcgtccataccttccctgcggtgctgcagtcttccgggttgtatagcctctcgtctgtggtcacggttccatcctcaaattttggaactcagacctacacatgcaacgtggaccacaaacccagtaatactaaggtagataagaccgtggagcgcaaatgttgcgtcgagtgtcctccatgcccggcaccccctgtggccggcccaagcgttttcctgtttccccctaagccaaaagacacactgatgatctccagaacccccgaagtgacgtgtgtcgtggtagatgtttctcatgaggacccggaagtgcagttcaactggtatgtcgatggtgtggaggtccacaatgctaagactaaacctagggaggaacaatttaacagcacattccgggtggtttcagtgctcaccgtagtccatcaggactggttaaatgggaaggagtacaagtgcaaagtgagtaacaagggactgcccgccccaattgagaaaactatctccaagacaaaaggccagcctcgcgaaccccaggtttatacccttccacccagccgagaagagatgacgaagaatcaagtgtctttgacctgtctggtcaaaggcttttacccttcagacattgcagtggagtgggaaagtaacgggcagccagagaataactataagacaactccgcccatgctagatagcgacggatccttcttcctctactctaagctgaccgtagataaatcgagatggcagcaaggtaacgtgtttagctgctccgttatgcacgaagcccttcacaatcattacacacagaagtcactgagtttgtctcctggcaaa

SEQ ID NO: 23894 - RNA, 651 nt, synthetic construct
  misc_feature 1..651: note = derived and/or modified sequence opt3 from Brazikumab_LightChain
  source 1..651: mol_type = other RNA
cagagcgtgctgacccaacccccttccgtctctggcgccccagggcagagagttacaatctcatgcactggaagtagctccaacacgggtgctggctacgacgtgcactggtatcagcaggtaccggggaccgcacccaagctccttatttacggatctggcaataggccttcgggtgtgccagatcggttctcagggagcaaaagtggaacatccgcctctctggcgataactggcttgcaagctgaggacgaagccgattattactgtcagagctatgactcctcattaagtggctgggtctttgggggaggtacccgcctgacagtgctaggccagcccaaggcagcccctagcgttaccctcttcccaccctcttccgaggaactgcaggctaacaaagcaactcttgtgtgcctgatctcagatttttaccctggggccgtcacagtggcttggaaggccgacagcagtccagtaaaagcgggagttgagaccacgactccgtctaagcaatccaataacaagtatgcagccagctcgtacttgtctctcacccccgaacagtggaaatcccatcgatcatacagttgtcaggtgacacacgagggcagcactgtcgagaagaccgtggctcctacagaatgctcc

SEQ ID NO: 23895 - RNA, 363 nt, synthetic construct
  misc_feature 1..363: note = derived and/or modified sequence opt3 from Brolucizumab_HeavyChain
  source 1..363: mol_type = other RNA
agcgaggtgcagctggtcgaatccggcgggggactcgttcaacccggtggctctcttagactgtcatgcaccgccagtgggttcagcttgacagactactattacatgacttgggtgaggcaggctcctggaaagggcttagagtgggtaggttttatcgatccagacgatgacccgtattacgcaacgtgggccaaagggcggttcaccatttcccgcgataactctaagaatacactgtatctacagatgaactcgctccgagcggaagacactgctgtgtactattgtgccggaggcgatcacaattcaggctgggggctggacatatggggacagggtacccttgtcacagtgagcagt

SEQ ID NO: 23896 - RNA, 333 nt, synthetic construct
  misc_feature 1..333: note = derived and/or modified sequence opt3 from Brolucizumab_LightChain
  source 1..333: mol_type = other RNA
atggagatcgtgatgacccagagcccctccacactgtctgcctcagtcggcgacagagttattataacttgccaagctagtgaaatcattcacagctggctcgcatggtaccagcagaagcctgggaaagccccaaaacttctgatctatttggcgtccacgttagcttctggagtgccgtcgaggttctcaggtagcggcagtggggccgagtttaccctgacaatttcctctctacagcccgatgacttcgcaacttactattgtcaaaacgtatacctcgccagcaccaatggagctaactttggccagggtacaaagctgaccgtgctt

SEQ ID NO: 23897 - RNA, 1347 nt, synthetic construct
  misc_feature 1..1347: note = derived and/or modified sequence opt3 from Cabiralizumab_HeavyChain
  source 1..1347: mol_type = other RNA
caggtgcagctggtccagagcggcgccgaggttaagaaacccgggtcctctgtgaaggtatcatgcaaagctagtggatacaccttcacagacaactatatgatctgggtgagacaggcacctggtcagggcctcgaatggatgggggatattaatccatacaacggaggcactacgtttaatcaaaagttcaaaggtagggtcaccataacagccgacaagagcacttccaccgcgtatatggagctttcttcgctgcggtcagaagatacagctgtgtactattgtgcccgcgagagcccgtactttagtaacttgtatgttatggactactgggggcagggaaccttagtgactgtctcctctgcaagcacaaagggcccctccgtgttccctctggccccatgctcacgaagtaccagcgaatctacggctgcactaggctgtctcgtaaaagattactttcccgagcctgttactgtgtcctggaatagcggggccctgaccagcggagtccacacattcccagctgtgcttcagagttctggtctgtattccttgagctcggtggtcactgttccctcttcctcactcggcaccaagacatatacctgcaacgtggaccataaacctagtaatacgaaggtagataaacgtgtggagagcaagtacgggccaccgtgtcccccttgcccagcccccgaatttctgggaggcccttccgtcttcctgtttccacccaagccgaaagacactctcatgatctctagaacacctgaggtgacctgtgttgtggtcgatgtgagccaggaagaccccgaggtacaattcaactggtacgttgatggtgtggaggtccacaatgcgaagactaaaccaagggaagaacagtttaactcaacatatcgggtggtcagtgtgttaaccgttctgcatcaggactggcttaatgggaaggaatacaaatgcaaggtgtccaacaaaggattgcctagctctattgagaagacgatctcaaaggcaaaaggccagccccgcgaaccacaagtatataccctgccccctagtcaggaggagatgacaaagaatcaggtcagcctaacttgtctcgtgaaaggcttctacccatccgatattgccgttgaatgggagtctaacgggcaaccggaaaataactacaagaccacaccccctgtgctggactcggacggatcatttttcctttattccagactgactgtcgataaatcaaggtggcaggagggtaacgtgttcagttgctctgtaatgcacgaggctttgcataatcactacacccaaaagagcctctccctgtcattaggcaag

SEQ ID NO: 23898 - RNA, 654 nt, synthetic construct
  misc_feature 1..654: note = derived and/or modified sequence opt3 from Cabiralizumab_LightChain
  source 1..654: mol_type = other RNA
gagatcgtgctgacccagagccccgccacactctccctttctcctggcgaaagagctactctgtcatgcaaggcaagtcaaagcgtcgactacgatggggacaactatatgaattggtaccagcagaaaccaggacaggccccgaggttgttaatttatgcggcttccaacctggagtctggtatacccgcccggttctcgggctcagggagcggaacggattttaccctaacaatcagttccctcgaacctgaggacttcgcagtttactattgtcacctgtctaatgaagatcttagcacttttggcggtgggaccaaggtggagattaaacgcacagtagccgctccatccgtgttcatctttcccccttcagacgagcaactgaagagtggaaccgcaagcgtcgtgtgcttgctcaacaatttctacccacgagaagccaaagttcagtggaaggtggataacgctctgcagtctggcaattcccaggagtcagtcactgaacaagacagcaaggatagtacatattctctgtccagcaccctcacgttatcgaaagccgactacgagaagcataaagtgtacgcgtgtgaggtaactcaccagggcctgtcttcccccgttaccaagtcatttaaccgtggggaatgc

SEQ ID NO: 23899 - RNA, 1329 nt, synthetic construct
  misc_feature 1..1329: note = derived and/or modified sequence opt3 from Camrelizumab_HeavyChain
  source 1..1329: mol_type = other RNA
gaggtgcagctggtcgaaagcggcgggggactcgttcagcccggtggctcccttagactgtcttgcgccgcttcagggttcacctttagtagctacatgatgtcctgggtgaggcaggcacctggaaagggcttggagtgggtagccacaatctctggtgggggagcgaacacttattacccagactcggtgaaaggccggttcacgatttcacgcgataatgctaagaacagcttatatctgcagatgaatagtctacgagccgaagacaccgcagtctactattgtgcccgtcagctctactattttgattactggggccaagggacaactgtgaccgtttcctctgctagcacaaaaggaccgtccgtgttccccctggcaccttgctcaagaagtaccagcgagtctactgccgctcttggttgtctggtcaaggactactttccagaacccgtgacagtatcctggaactcaggcgccttgaccagcggggttcacacgttccctgcggtgctccagagttctggactgtattccctgagctcggtcgtgactgtgccatcttcctcactcggcaccaaaacatacacttgcaatgtcgatcataagcccagtaacaccaaggttgacaaaagggtggagagcaagtatggtcctccatgtccgccctgccctgcaccagagtttttagggggaccctccgtattcctgtttcctccaaaacccaaggatacacttatgatatctcggaccccggaagtgacgtgtgtcgtggttgacgtgagccaggaggatcctgaagtccagttcaattggtacgtggacggcgtagaggttcacaacgccaaaactaagccccgcgaggaacaatttaattcaacatatagagtggtcagtgtgttgaccgtcctgcatcaggattggctaaacggcaaggagtacaaatgcaaggtgtccaataaagggctcccaagctctatcgaaaagactatttcaaaagctaagggacagcctagggagccccaggtttatacactgccacccagtcaagaagagatgaccaaaaaccaggtgagccttacgtgtctggtaaagggtttctacccttccgacatcgccgtcgagtgggaatctaatggccagccagagaacaattacaagaccacaccgcccgtgttggattcggacgggagctttttcctctattcccggctgactgttgacaaatcacgctggcaagaaggaaacgtgttcagttgctctgtcatgcacgaggcattacataaccactacacccaaaagagcctgtccctctcacttggcaaa

SEQ ID NO: 23900 - RNA, 642 nt, synthetic construct
  misc_feature 1..642: note = derived and/or modified sequence opt3 from Camrelizumab_LightChain
  source 1..642: mol_type = other RNA
gacatccagatgacccaaagcccctcctctctgtcagccagtgtgggcgatagagtcacaattacttgcctcgctagccagacgatagggacctggcttacatggtaccagcagaagcctggaaaagcaccaaagctgttgatctatactgccacctccttagcggacggtgttccgtctaggttctcgggctcagggagcggaacagattttaccctgactattagttccctacaacccgaggacttcgctacatactattgtcaacaggtgtactctatcccttggacctttggcggtgggacgaaagtagaaattaagcggactgtggccgcaccaagcgtcttcatctttcccccttccgatgagcagctcaaatcaggaaccgccagtgtggtttgcctgcttaacaatttctatccacgcgaagctaaggtgcagtggaaggtcgacaacgcactgcagagcggcaattctcaggagtccgtgacagaacaggattcaaaagacagcacttacagtttgtcttccaccctcacactgagcaaggccgattatgagaaacacaaggtatacgcttgtgaggttacccatcaaggcctgtcgtctcccgtgacgaaatcctttaaccgaggggaatgc

SEQ ID NO: 23901 - RNA, 777 nt, synthetic construct; identical to SEQ ID NO: 23068
  misc_feature 1..777: note = derived and/or modified sequence opt3 from Caplacizumab_HeavyChain
  source 1..777: mol_type = other RNA

SEQ ID NO: 23902 - RNA, 657 nt, synthetic construct
  misc_feature 1..657: note = derived and/or modified sequence opt3 from Citatuzumab_bogatox_HeavyChain
  source 1..657: mol_type = other RNA
gaggtgcagctggtccaaagcggccccgggctcgttcagcctggaggttccgtgagaatctcttgcgccgcttcaggctacaccttcacaaactatgggatgaattgggtaaagcaggcaccaggaaaaggccttgaatggatgggttggattaacacttacacgggggagagtacctatgccgacagctttaagggaaggttcacattttccctggatacttctgcgtcggctgcctacttgcagataaattcattacgggcagaagacaccgccgtgtattactgtgctcgcttcgcaatcaaaggcgattattggggccaagggacactgctaaccgtcagcagtgcctccactaagggaccgtctgtgtttcccctcgctcctagctccaaatcaacaagtggtggcaccgccgcgctggggtgccttgttaaggactacttcccagagcccgtgacggtcagctggaactctggagcactgacttccggcgtgcacacctttcctgccgtattgcagtcaagcggtctctacagtctgtcttccgttgtgacagtcccaagctcgtctctggggactcagacctatatttgtaatgtgaaccataagccctccaatacaaaagtggataagaaagtcgaacctaagtcatgc

SEQ ID NO: 23903 - RNA, 1356 nt, synthetic construct
  misc_feature 1..1356: note = derived and/or modified sequence opt3 from Cosfroviximab_HeavyChain
  source 1..1356: mol_type = other RNA
gacgtgaagctgctcgagagcggcgggggacttgtccagcccggtggctccctgaaattgtcttgcgccgcttcagggttcagtttaagcacctccggagttggcgtgggttggtttagacaaccttctgggaagggactggaatggctagcactcatctggtgggatgacgataaatactataacccatcgctgaagtcacagcttagcattagtaaagacttctccaggaatcaggtatttctgaagatatctaacgtggatatcgccgacacagcgacttactattgtgctcggcgcgatccgttcggctacgacaatgccatgggctattgggggcagggaacgagcgtcaccgtgtcctcagcaagtacaaagggtcccagcgtttttcctttggccccatcttccaaatcaactagcggcgggaccgctgcactcggatgcctggtgaaggattacttccccgagcctgtcacagtgagttggaactctggcgccctgacctccggtgtacacacttttccagctgttctccaaagctcggggttatattctctgtcctcagtggtcacagtgcccagtagctcccttggaacccagacgtacatttgtaatgtgaaccataaaccttctaatactaaggtcgacaaacgagttgaaccaaagagctgcgataagacccacacatgtccgccctgccctgccccagagttgctgggcggcccctcagtgttcctatttcctccaaaacccaaggacactctcatgatcagtcgtaccccggaagtaacatgtgtggtcgtggatgtttcccatgaggaccctgaggtgaaattcaactggtacgtcgacggggtggaagtacacaatgcgaagaccaaacccagagaggaacagtataacagcacgtacagggttgtgtctgtcctgactgtgcttcatcaggattggctgaatggaaaggagtataaatgcaaggtctcaaacaaggcattgccagcccctattgagaaaacaatcagtaaggctaaaggtcaaccccgggaaccacaggtgtacaccctgccccctagccgcgacgagctcactaagaatcaggtttccttaacatgtctggtgaaaggcttttatccatctgatatagccgtagaatgggagtcgaacgggcagccggaaaataactacaagaccacgccccctgtcctcgacagcgatggatccttctttctttattcaaagctgaccgtggacaaaagtagatggcaacagggcaacgttttctcttgcagcgtgatgcacgaggcattgcacaatcattacacacagaagtccctatcactgagcccaggtaaa

SEQ ID NO: 23904 - RNA, 639 nt, synthetic construct
  misc_feature 1..639: note = derived and/or modified sequence opt3 from Cosfroviximab_LightChain
  source 1..639: mol_type = other RNA
gacatcgtgatgacccagagccccctgtccctctctacatcagtcggcgatagagttagtcttacttgcaaggccagccaaaacgtggggacggctgtagcatggtaccagcagaaacctggacagtccccaaagctgttgatttattctgcctcgaataggtacaccggtgtgccggaccggttcacaggctcagggagcggaactgattttaccttaacaataagtaacatgcaatccgaggacctggcggattatttctgtcagcagtactctagctatcccctaacctttggcgctggtactaaactcgaactgcgcacagtcgccgcaccttccgtgttcatctttccaccctcagacgagcagcttaagagtgggaccgccagcgttgtgtgcctgttgaataacttctaccctcgagaagctaaagtccaatggaaggtggataatgcactccagtctggaaactcccaggagtcagtaacggaacaggacagcaaggatagtacttattctctgtccagcaccctgacactctcgaaagccgactacgagaagcacaaagtttacgcttgtgaggtgactcatcaaggcttatcttccccagtcaccaagtcatttaatcgtggcgaatgc

SEQ ID NO: 23905 - RNA, 1344 nt, synthetic construct
  misc_feature 1..1344: note = derived and/or modified sequence opt3 from Crizanlizumab_HeavyChain
  source 1..1344: mol_type = other RNA
caggtgcaactggtccagagcggcgccgaggttaagaaacccggggcttccgtgaaggtatcttgcaaagtgtcaggatacaccttcacaagttatgacatcaactgggtcagacaggcacctggtaagggcctcgaatggatggggtggatttacccaggagatggcagcataaaatataatgagaagtttaagggtagggtgactatgacggttgacaaatccaccgatacagcctacatggaactttcttcgctgcggtcagaggacactgcggtgtattactgtgctcgccgaggggaatatggaaactacgagggcgccatggattactggggccaggggaccttggtcacagtgagcagtgcatccaccaagggaccgtctgtattccccttagccccttgcagccgttccacttcagagagtacagctgcactgggttgtctagttaaagactattttccagaacccgtgaccgtcagctggaactctggcgccctcacgtccggggtgcacactttccctgctgtgctgcaatcaagcggactttacagtctgtcttccgtcgttaccgtgacaagctcgaattttggcactcagacctatacatgcaatgtagatcataagccatctaacaccaaagtggacaagacggtcgagagaaagtgttgcgtggaatgtcccccttgcccagccccgcccgttgcgggtccttccgtgttcttgtttccacccaaacctaaggatactctcatgatctcaaggacaccagaggtcacctgtgtggtagttgacgtgagtcacgaggatcccgaagtccagttcaattggtacgtggacgggatggaggtccataacgcaaaaactaagccgcgggaggaacagtttaatagcacattccgcgtggtttccgtgctgaccgtagtccaccaagattggctgaacggaaaagaatataagtgcgccgtgtctaataaaggcctccctgctcccattgagaagacgatcagcaagaccaaaggccagccaagagagcctcaggtttacacattacccccatcaagggaagagatgactaagaaccaggtgagtctgacctgtcttgtcaaagggttttatccctccgacattgccgtggaatgggagagcaatggacaacctgaaaacaattacaagacaactccaccgatgttggactctgatggttcattctttctgtacagtaaactaaccgtagacaagagccggtggcagcagggcaacgtgttctcctgctctgttatgcatgaggcactccacaaccactatacacaaaagtcgctgagcctttcccccgggaaa

SEQ ID NO: 23906 - RNA, 654 nt, synthetic construct
  misc_feature 1..654: note = derived and/or modified sequence opt3 from Crizanlizumab_LightChain
  source 1..654: mol_type = other RNA
gacatccagatgacccaaagcccctcctctctgtcagccagtgtgggcgatagagtcacaattacttgcaaggctagccagtccgttgactacgatgggcactcttatatgaactggtaccagcagaaacctggaaaggcaccaaaactccttatatatgccgcgtcgaatctggagtcaggtgtgccgagcaggttcagtggctccgggtctggaacggactttaccttgacaatcagctccttacaacccgaagatttcgctacttactattgtcagcagtcagacgagaaccctctgacctttggcggtgggacaaaggtagaaattaaacggaccgtggccgcaccaagtgtcttcatctttccccctagcgatgagcagctaaagtctggaactgcctccgtggtttgcctcctgaataacttctacccacgcgaagctaaggtgcaatggaaagtcgacaatgcacttcagtcaggcaacagccaggagagtgtgacagagcaggattctaaggactccacctatagcctgtcgtctacgttgactctctccaaagccgattacgaaaagcataaagtatacgcttgtgaggttacccaccaaggcctgtcaagtcccgtgacaaagagctttaatcgaggggaatgc

SEQ ID NO: 23907 - RNA, 1365 nt, synthetic construct
  misc_feature 1..1365: note = derived and/or modified sequence opt3 from Crotedumab_HeavyChain
  source 1..1365: mol_type = other RNA
gaggtgcagctggtcgaaagcggcgggggactcgttcaacccggtggctcccttagactgtcttgcgccgcttcagggttcacctttagtaactacttgatgaattgggtgaggcaggcacctggaaagggcttagagtggctggccaacatccaggaagacggtattgagaaatattacgtagatagcgtgaaggggcggttcacaatatcccgcgacaatgcgaaaaactctctatatctccagatgaactcgctgcgagctgaagatactgccgtctactattgtgcacgtgagccatcacactacgacatccttacgggatatgattactactatggcatggacgtgtggggccaagggaccacagttactgtgagcagtgcctccaccaagggaccgtctgtctttcccctggctccttgcagcagatccacatcagagagtaccgcagccttgggttgtctcgtgaaagattacttcccagaacccgtaactgttagctggaactctggcgctctgacatccggggtgcatacctttcctgccgtcctgcagtcaagcggactctatagtttatcttccgtggtgacggtcccaagctcgtctctgggcactaagacctacacatgcaatgttgaccacaagccctccaatactaaagtggataagagggtagagtcaaaatatggtcctccatgtccgccctgccctgcgccagagttccttgggggacccagtgtgtttttgttccctccaaagcccaaagacaccctgatgattagccggacaccggaagtcacctgtgtggttgtggatgtctcccaggaggaccctgaagtgcagtttaattggtacgtagatggcgttgaggtgcataacgcaaagacgaagccccgcgaggaacaattcaattctacttatagagtcgtgagcgtcctaacagtgctccaccaggactggctgaacggcaaagaatacaagtgcaaagtttcaaataaggggcttccaagttccatcgagaaaaccattagcaaggccaaaggacagcctagggagccccaggtgtacactctgccaccctctcaagaagagatgacaaagaaccaggtatcattgacctgtctcgtcaagggtttttatcctagtgacatcgctgtggaatgggagagcaatggccagccagaaaacaactacaaaacgaccccgcccgttctggattccgacgggtctttctttttatattcgcggctgacagtggataagagccgctggcaagagggaaatgtcttctcctgctcagtgatgcatgaggccctccacaaccactacactcagaaaagtctttctctgagcttgggcaag

SEQ ID NO: 23908 - RNA, 642 nt, synthetic construct
  misc_feature 1..642: note = derived and/or modified sequence opt3 from Crotedumab_LightChain
  source 1..642: mol_type = other RNA
gacatccagatgacccaaagcccctcctctctgtcagccagtgtgggcgatagggtcacaattacttgcagggctagccaggggatacggaacgacctcggatggtaccagcagaagcctggtaaagcaccaaagcgccttatctatgccgcgtcctctctgcaatcgggcgttccgtcacgattcagcgggagtggatccggcacggagtttattttgaccgtgtctagcttacagcccgaagatttcgctacatactattgtctgcagtacaattccaacccttttactttcggtccagggaccaaagtagacatcaagcgtacagtggccgcaccctcagtctttattttccctccaagtgatgagcagctaaaaagcggaaccgcctctgtggtttgcctcctgaataacttttatcccagagaagctaaggtgcaatggaaggtcgacaatgcacttcagtccggcaactcacaggagagcgtgactgaacaggatagtaaagactctacatactccctgagctcgaccttgacgctctctaaggccgattatgagaaacacaaggtatacgcttgtgaggttactcatcaaggcctgtcctcacctgtgaccaaaagtttcaatagaggggaatgc

SEQ ID NO: 23909 - RNA, 1356 nt, synthetic construct
  misc_feature 1..1356: note = derived and/or modified sequence opt3 from Dezamizumab_HeavyChain
  source 1..1356: mol_type = other RNA
caggtgcaactggtccagagcggcgccgaggttaagaaacccgggtcctctgtgaaggtatcatgcaaagctagtggattcacctttgcaacatacaacatgcactgggtgagacaggcccctggtcagggcctcgaatggatggggtatatctacccaggagacggcaatgcgaactataatcaacagttcaagggtagggtcactattacggctgataaaagcacctccacagcctacatggagctttcttcgctgcggtcagaagacactgcagtgtattactgtgcccgcggggattttgactatgatggaggctactacttcgacagctggggccaggggaccttggttacagtgagttccgcttctaccaagggaccgagcgtctttcccttagcaccttcctcaaagagtactagcggtggcacagccgctctggggtgcctagtgaaagattatttcccagagcccgtaaccgtttcttggaactccggagccctcacgtcaggcgtgcatacttttcctgcggtcctgcagagcagtggtctttactctctgtccagcgtggtgaccgtcccatcgtcttccttggggacacaaacttatatatgtaatgttaaccacaagccctcaaataccaaagtggacaagaaagtagaacctaagagttgcgataagacacatacctgtccaccgtgccccgcacctgagctcctgggaggcccaagcgtgttcctgtttccccctaaaccaaaggacacgctcatgatctcccgaactcccgaggtcacatgtgtggttgtggatgtctctcacgaagacccggaggtgaaattcaactggtacgtagatggcgttgaagtgcataatgccaagaccaaacctcgtgaggagcagtataacagcacttacagagtcgtgtcagtcttaacagtgctgcaccaggactggcttaatgggaaggaatataaatgcaaggttagtaacaaggctttgcccgccccaattgagaaaaccatctccaaggcaaaaggacagcctagggaaccccaagtgtacacgctgccacccagccgggacgagctaaccaagaatcaggtatctctcacatgtctggtcaaaggtttttacccttcagatattgctgtggaatgggagagtaacggccagccagagaataactataagactaccccgcccgttcttgacagcgatgggtccttctttctgtactctaagttgacagtggacaaatcgcgctggcaacagggaaacgtcttcagctgctccgtgatgcacgaagccctccataatcactatactcagaagtcactgagtttatctcctggcaaa

SEQ ID NO: 23910 - RNA, 642 nt, synthetic construct
  misc_feature 1..642: note = derived and/or modified sequence opt3 from Dezamizumab_LightChain
  source 1..642: mol_type = other RNA
gacatccagatgacccaaagcccctcctctctgtcagccagtgtgggcgatagagtcacaattacttgcagggctagcgagaacatatactcctatctcgcatggtaccagcagaagcctgggaaagccccaaaacttctgatccacaatgcgaagacgttggctgaaggagttccgtctcggttctcgggttcaggcagcgggaccgactttacattaactattagttccctgcagcccgaggatttcgccacctattactgtcaacatcactatggagcacctctaacatttggccagggtaccaagctcgaaatcaaacgcactgtggccgctccatctgtattcatttttccccctagcgacgagcagctgaagtccgggacagcatcagtggtctgccttctgaacaatttctacccacgagaagccaaggtgcagtggaaagttgataacgctttgcaaagtggaaatagccaggagtctgtgaccgagcaggactccaaggattcaacgtatagcctcagttctactctgaccctgtccaaagccgactacgaaaagcataaagtctacgcgtgtgaggtgacacaccagggcctcagctcgcccgtaactaagtcttttaaccgtggcgaatgc

SEQ ID NO: 23911 - RNA, 1506 nt, synthetic construct
  misc_feature 1..1506: note = derived and/or modified sequence opt3 from Duvortuxizumab_Chain1_scFv
  source 1..1506: mol_type = other RNA
gagaacgtgctgacccagagccccgccacactctccgtcactcctggcgaaaaggctacgattacctgcagagcatctcaatcagttagttacatgcactggtatcagcagaaaccagggcaggccccgaggcttctgatctacgacgcgagcaatcgggcttccggagtgccctctcgcttctcgggttcaggcagcgggacagatcatactttgaccataagttccttagaggccgaagacgcagccacatattactgttttcaaggatctgtatatcctttcacctttggccagggtactaagctggagatcaaagggggaggcagcggcgggggaggtgaagtgcagctagtcgagtccggcgggggactcgtgcagccaggcggttcactgcgacttagttgcgctgcaagcgggttcacattttctacctacgccatgaactgggttcgtcaagctcccggaaagggcctggagtgggtgggcagaattaggtccaaatataataactacgccacgtactatgcggattcagtcaaggggcggttcactatcagccgcgacgatagtaaaaattctttgtacctccagatgaactccctgaagaccgaagacacagcagtgtattactgtgtaagacacggaaattttggtaacagctatgtttcgtggttcgcctactggggccaggggactctggtgaccgtctcttccgcttcaacaaagggagaggtggccgcatgcgaaaaagaggtggctgccctcgagaaggaagtcgcggccttagagaaagaagttgcagctctggagaagggcggtggggataagacccatacgtgtcctccatgccccgcccctgaagctgccggcggaccaagtgtgtttcttttcccgcccaaacctaaggacactttgatgattagcaggacaccagaggtaacctgtgtggtcgtggatgtttcccacgaggaccccgaagtgaaatttaattggtatgtcgatggcgtggaggtacataacgcaaagactaaacctcgggaggaacagtacaattctacataccgcgttgtgagcgtcctgaccgtgctacaccaagactggctcaacgggaaggaatataaatgcaaggtctcaaataaggccctgccagctcccatcgagaaaacgataagtaaggcgaaaggacagccgcgagagcctcaggtgtacacccttcccccatccagagaagagatgacaaagaaccaagttagcctgtggtgtttggtgaaaggtttctatccttctgatatcgcagtagaatgggagtcaaatggccagcccgaaaacaactacaagactaccccacccgtcctcgacagtgacgggagctttttcctgtattccaagttaacagtggataaatctaggtggcagcagggaaatgttttctcgtgcagcgtgatgcacgaggccctgcataaccactacactcaaaagtccctctcacttagtcctggcaaa

SEQ ID NO: 23912 - RNA, 813 nt, synthetic construct
  misc_feature 1..813: note = derived and/or modified sequence opt3 from Duvortuxizumab_Chain2_scFv
  source 1..813: mol_type = other RNA
caggccgtggtcacccaagagcccagcctgacagtttcccctggcgggactgtgacgcttacctgcagatcttcaacaggagctgtaactaccagtaactacgcaaattgggtgcagcagaagccaggtcaggccccgaggggcctcatcgggggaacaaacaaacgggcgccctggacccctgctcgcttcagcggctccctgttgggtgggaaggccgcattaactattacaggagcccaagctgaagacgaggcagattattactgtgccctgtggtattctaatctatgggtctttggcggcgggaccaaactcacggtgctgggaggtggcgggtcgggaggcggtgggcaggttactcttcgagaatcaggaccagctctggtgaagcccacccagacattgactctgacctgcacattcagcggctttagtctctccacctctggcatgggggtcggatggatacgtcagcctccaggtaaagccctggagtggctcgcgcacatctggtgggacgatgacaagagatacaaccccgcattaaagagcaggctgacgatttccaaagatacttcaaagaatcaagtgttccttacaatgaccaacatggaccctgtagatactgccacatattactgtgctcggatggaattgtggagttattactttgactactggggccaggggaccacggttaccgtgagctctgcctccacaaaaggaaaggtcgcagcttgcaaagagaaggtggccgcgctgaaggagaaagtggccgcactaaaggaaaaagtcgctgccctcaaggag

SEQ ID NO: 23913 - RNA, 681 nt, synthetic construct
  misc_feature 1..681: note = derived and/or modified sequence opt3 from Duvortuxizumab_Chain3_h-CH2-CH3
  source 1..681: mol_type = other RNA
gacaagacccacacatgtcccccttgcccagccccggaggctgcaggcgggcccagcgtgttcctgtttcctccaaaacccaaggatactctcatgatctccagaacgcctgaagttacctgcgtcgtggtagacgtgtctcatgaggatccagaagtcaaattcaactggtacgtggacggagttgaggtgcacaatgccaagacaaaacccagggaggaacagtataactcaacttaccgggtcgtgagtgtacttaccgttctgcatcaggattggttgaatggtaaggagtataagtgtaaagtgagcaacaaggcgttacctgctccaattgaaaagacaatatccaaggccaaaggccagccgcgcgagccccaggtctacaccctgcctccatctcgagaagagatgactaagaatcaggtgtcgctatcatgcgcagtgaaggggttttatcccagcgacatcgccgtcgagtgggaaagtaacggacaacctgagaataactacaaaacaaccccacccgttctcgattccgacggctctttctttctggtgagcaaacttacggtagataaatcccgttggcagcagggtaatgtgttctcatgtagtgtcatgcacgaagctctgcataacagatatactcaaaagagcttgtctctctccccggggaaa

SEQ ID NO: 23914 - RNA, 360 nt, synthetic construct
  misc_feature 1..360: note = derived and/or modified sequence opt3 from Efungumab_HeavyChain
  source 1..360: mol_type = other RNA
atggccgaggtgcagctggtcgaaagcggcgctgaggttaagaaacccggggaatccctcagaatctcttgcaagggatcaggttgtattataagtagctactggatctcctgggtgaggcaaatgcctggcaaagggcttgagtggatgggaaagattgacccaggcgattcttatatcaactactcgccgtcattccagggtcacgtaaccattagcgcagacaaaagtatcaatacagcctatctgcagtggaactccttgaaggcgtctgatactgctatgtactattgcgcccgcgggggacgggactttggcgatagcttcgactactggggccaggggacgttagtgaccgtc

SEQ ID NO: 23915 - RNA, 750 nt, synthetic construct
  misc_feature 1..750: note = derived and/or modified sequence opt3 from Efungumab_HeavyChain_LightChain
  source 1..750: mol_type = other RNA
atggccgaggtgcagctggtcgaaagcggcgctgaggttaagaaacccggggaatccctcagaatctcttgcaagggatcaggttgtattataagtagctactggatctcctgggtgaggcaaatgcctggcaaagggcttgagtggatgggaaagattgacccaggcgattcttatatcaactactcgccgtcattccagggtcacgtaaccattagcgcagacaaaagtatcaatacagcctatctgcagtggaactccttgaaggcgtctgatactgctatgtactattgcgcccgcgggggacgggactttggcgatagcttcgactactggggccaggggacgttagtgaccgtctcctcaggaggtggcgggagtggaggcggtgggagcggaggcggcgggtctgatgtggttatgacacaatccccctcatttctgagcgcattcgtgggagaccgaataactatcacctgtcgtgccagttctggtatttccagatatctagcttggtaccagcaggcacctggcaaggccccaaaactcctgatctacgctgccagcacacttcagaccggggtcccctcgaggttttctggatccggctcaggtactgagttcacactgaccattaatagtttgcaacctgaagattttgcgacgtattactgccagcatctcaacagctatccactgactttcgggggcggaaccaaggtggacatcaaacgggcagccgctctggag

SEQ ID NO: 23916 - RNA, 339 nt, synthetic construct
  misc_feature 1..339: note = derived and/or modified sequence opt3 from Efungumab_LightChain
  source 1..339: mol_type = other RNA
gacgtggtcatgacccagagcccctccttcctgtctgcctttgttggcgatagaatcacaattacttgcagggcttcaagtgggataagccggtacctcgcatggtatcaacaggcccctggaaaggcgccaaaacttctgatctacgctgcctccacgttgcagaccggtgtgccgtctcgcttctcgggctcagggagcggaacagagtttactttaaccattaacagtctgcagcccgaagacttcgcaacatattactgtcaacacctaaattcctatcctctcacctttggcggtgggactaaggtagatatcaaacgagccgctgcactggag

SEQ ID NO: 23917 - RNA, 1350 nt, synthetic construct
  misc_feature 1..1350: note = derived and/or modified sequence opt3 from Elezanumab_HeavyChain
  source 1..1350: mol_type = other RNA
gaggtgcagctggtccaaagcggcgccgaagttaagaaacccggggcttccgtgaaggtatcttgcaaagcatcaggatacaccttcacaagtcacggtatcagctgggtgagacaggcccctggccaggggctcgactggatgggatggatttccccatattctggcaacactaattacgcgcagaaacttcaaggtagggtcacgatgaccacagatacttcgacctcaacagcttatatggagctgagcagtttgcggtccgaagacaccgccgtgtactattgtgcacgcgttgggtctggaccgtactattacatggatgtgtggggccagggcactttagtcacagtgagctccgcctcaaccaaggggcccagtgtatttcctctggctccaagctctaagtccacgtcaggaggtactgcagccctaggctgcctcgttaaggactacttccccgagcctgtgaccgtcagctggaacagtggggctctgacatctggagtgcatacttttccagccgtgcttcagtccagcggcctgtattcgttgtcttccgtcgttaccgtgccctcaagtagcctcggtacacagacctacatatgtaatgtaaaccacaaaccttccaatacgaaggtggataaaaaggtcgaaccaaaatcttgcgacaagactcatacatgtccgccctgccctgcgccagaggcagccgggggacccagcgtgttcctgtttcctccaaagcccaaagatcaactgatgatctcacgaaccccggaggttacttgtgtggtcgtggacgtaagtcacgaagatcctgaggttaagttcaactggtatgtggacggcgtcgaagtgcataatgctaaaacaaagccccgtgaggagcagtacaactccacctatagagtcgtgagcgttctcacggtgttacaccaggattggctgaatggcaaagaatacaagtgcaaagtatctaacaaggcccttccagcacctattgagaagaccatctcaaaagctaaggggcagcccagggaaccacaagtctatacattgccccctagtcgggaggaaatgactaaaaatcaggtgagcctgacctgtctagttaagggattttacccatccgacattgccgtggagtgggagtctaacggtcagccggaaaataactacaaaacaactccccctgtcctcgattcggacggcagcttctttctgtattccaagctgaccgtggacaagtcacgctggcaacaggggaatgtattcagttgctctgtgcttcacgaggcgttgcataaccactacacacagaaaagcctctccctgtcaccaggaaag

SEQ ID NO: 23918 - RNA, 645 nt, synthetic construct
  misc_feature 1..645: note = derived and/or modified sequence opt3 from Elezanumab_LightChain
  source 1..645: mol_type = other RNA
cagagcgccctgacccaacccagatccgtgtctggctcacctgggcagagtgtcacaatcagctgcactggaacgtcctcttcggttggtgactcaatttacgtgagctggtatcagcagcacccaggcaaggctccgaaactcatgctttacgatgtaaccaagaggcccagtggggtgcctgaccggttctccggatctaaaagcggcaacacagcatccctgactatatcaggtttgcaagccgaggatgaagcggactattactgttatagttacgctgggaccgatacattatttggaggcggcaccaaggtcactgtgctggggcagccaaaagccgcacccagcgttacactattccctccatcttccgaggaactccaggccaataaggctaccctggtgtgccttatctcagacttttatcccggagcagtcacggtggcctggaaggctgatagcagtcctgtaaaagccggtgttgagactaccacaccatctaagcagtccaacaataaatacgcggcaagctcgtacctgtctttgactccggaacaatggaagtcccatcgctcatatagttgtcaggtgacccacgagggcagcacagtcgagaaaaccgtggcccccacggaatgctcc

SEQ ID NO: 23919 - RNA, 1359 nt, synthetic construct
  misc_feature 1..1359: note = derived and/or modified sequence opt3 from Emapalumab_HeavyChain
  source 1..1359: mol_type = other RNA
gaggtgcagctgctcgaaagcggcgggggacttgtccagcccggtggctccctgagattgtcttgcgccgcttcagggttcacctttagtagctacgcaatgtcctgggttaggcaggcccctggaaagggcttagagtgggtgtctgcgatctcgggttcagggggaagcacatattacgctgacagtgtaaaaggccggttcactatttcccgcgataactctaagaatacgctgtatctacagatgaacagcctccgagccgaagacaccgcagtgtactattgtgccaaagatggctcctcagggtggtacgtcccacactggtttgacccgtggggacagggtacactggtgactgttagtagcgcttctaccaagggcccctccgtgttccctcttgcaccatcaagcaaaagtacatctgggggaaccgccgctctgggctgcttggtcaaggattattttcccgagcctgtgactgtatcctggaatagcggtgccctcacatcgggggttcataccttcccagcggtgctgcaatcttccggactgtactcactcagtagcgtcgtgacggtgccctcctctagcttaggcactcagacctacatatgtaacgtcaatcacaagccttcaaacacaaaagttgacaagcgtgtggaaccaaaaagttgcgataagactcatacctgtccgccctgccctgcaccagagctgcttggcgggccctccgtatttttgttccctccaaaacccaaggacacactgatgatcagcagaaccccggaggtgacgtgtgtcgtggttgatgtgtctcacgaagaccctgaggtcaagtttaattggtatgtggatggagtagaagttcataacgccaaaactaagcccagggaggagcagtacaattcaacatatcgggtggtcagtgtgctaaccgtcctccaccaggactggctgaacggtaaagaatacaagtgcaaagtgagcaataaggcccttccagctcctattgagaaaactatctccaaggcaaagggccaaccccgcgaaccacaggtttatacactgcccccttctagagaggaaatgaccaaaaaccaggtgtcgttgacgtgtctcgtaaaggggttctacccaagcgatattgctgtcgagtgggagtccaatggacagccggaaaacaattataaaaccacaccccctgtgctggactcagacggcagctttttcttatactctaagctgactgttgataaaagtaggtggcaacagggtaacgtgttttcctgctcagtcatgcacgaggccctccataaccactacacccaaaagagcctttctctgtccccagggaag

SEQ ID NO: 23920 - RNA, 651 nt, synthetic construct
  misc_feature 1..651: note = derived and/or modified sequence opt3 from Emapalumab_LightChain
  source 1..651: mol_type = other RNA
aacttcatgctgacccagccccacagcgtgtccgagtctcctggcaagacagtcactatctcatgcacgagaagtagcgggtccattgcctctaattacgttcaatggtatcagcagaggccaggatcgtcaccgaccacagtgatatacgaagacaaccagcggcccagcggtgtacctgatcgctttagtggctccatcgactctagctccaattcagctagtctcactattagcgggcttaaaaccgaggatgaagcagactattactgtcaatcttatgatggatccaaccgatggatgttcggcggtgggacaaagctgaccgtgttgggacagccaaaagccgcgccctcagtcactttatttcctccaagcagtgaggaactgcaggctaataaggccaccctagtgtgcctcatctctgacttctaccccggcgcagttacagtggcctggaaagctgattccagccctgtcaaggcaggcgtggagacgactaccccatcgaagcagtctaacaataaatatgccgcttcctcatacctgagtcttacaccggagcaatggaaaagccatcgttcctactcttgtcaggtaactcacgaagggagcaccgttgagaagacagtggcccccaccgaatgctca

SEQ ID NO: 23921 - RNA, 1341 nt, synthetic construct
  misc_feature 1..1341: note = derived and/or modified sequence opt3 from Enoblituzumab_HeavyChain
  source 1..1341: mol_type = other RNA
caggtggagctggtcgaaagcggcgggggactcgttcaacccggtggctcccttagactgtcttgcgccgcttcagggttcacctttacaagttactggatgagctgggtgaggcaggcacctggaaagggcttggagttagtatcctctatcacttcgtatggttcattcacgtactatgccgacagcgtgaaagggcggtttaccattagtcgcgataactccaagaatacactgtacctacagatgaactctctccgagcggaagacactgctgtctattactgtgcccgtaatatgtatacccacttcgatagctggggacagggcacactggtgaccgtttcctcagcaagtactaaaggcccaagcgtgtttccgcttgccccctcttccaagtcaacaagcgggggaaccgctgcactgggttgcttggtcaaagactacttccctgagccagtgacggtaagttggaactctggcgccctcacttccggggttcatacctttcccgctgtgctgcaaagctcgggactgtactctctctcctcagtcgtgacagtgcctagtagctccttaggcactcagacctatatatgtaatgtcaaccacaagccatctaatacaaaggttgataaaaaggtggaacccaaaagctgcgacaagacccatacgtgtcctccatgcccggcccccgagctgcttggtgggccttcagtattcttgtttccacccaaacctaaggatactctgatgatcagtagaacaccagaggtgacctgtgtcgtggttgacgtgtcccacgaagatcccgaggtcaagttcaactggtacgtggacggagtagaagttcataatgcgaaaactaagccgagggaggagcagtataacagcacataccgggtggtctctgtgctaaccgtcctccaccaggattggctgaatggcaaagaatataagtgcaaagtgtcaaacaaggcacttcctgcccccattgagaaaacgatcagtaaggctaagggccaaccacgcgaacctcaggtttacaccctgcccccaagcagagacgagttgactaaaaatcaggtgtccctcacatgtctggtaaaggggttttatccctctgatattgccgtcgaatgggagtcgaacggacagcctgagaataactacaaaaccacaccaccggtgttagacagcgacggttccttctttctgtactcaaagctcactgttgataaaagtaggtggcaacagggcaacgtgttctcttgcagcgtcatgcacgaagcacttcataatcactatacccagaagtccctgtcattgagccccgggaag

SEQ ID NO: 23922 - RNA, 648 nt, synthetic construct
  misc_feature 1..648: note = derived and/or modified sequence opt3 from Enoblituzumab_LightChain
  source 1..648: mol_type = other RNA
gacatcgtgctgacccagccccctagcgtctccggcgccccagggcaaagagttacaatttcttgctcaggaagtagctccaacataggttctaattcggtgtcatggtaccagcagctcccgggcactgctcccaaacttctgatctatgataacagcaagaggcctagtggggtaccagaccggttctccggatctaagagcggcacgtccgcatcattggccattaccggtttacagagtgaggatgaagcggactactattgtcaaagccgcgatacatacgggtattactgggtgtttggaggcggcactaaactgaccgtcctagggcagcccaaggctgccccttctgtgacactcttcccaccctcctcagaggaactgcaggcaaataaagccacccttgtttgcctgatcagcgacttttatcctggagctgtgactgtcgcatggaagggtgatagttctccagtgaaggccggcgtagagacaaccacgccgtccaaacagagcaacaataagtacgctgcctcgtcttacttgtccctcactcccgaacaatggaaatcacaccgaagttatagctgtcaggttacccatgaggggtccacagtggagaagactgtcgcgcctaccgaatgctct

SEQ ID NO: 23923 - RNA, 1323 nt, synthetic construct
  misc_feature 1..1323: note = derived and/or modified sequence opt3 from Eptinezumab_HeavyChain
  source 1..1323: mol_type = other RNA
gaggtgcagctggtcgaaagcggcgggggactcgttcaacccggtggctcccttagactgtcttgcgccgtgtcagggatcgacttgagtggatactatatgaactgggtaaggcaggctcctggcaagggtttagagtgggtgggggtcattggaataaatggcgcaacctactatgccagctgggcgaaaggccggttcacaatctcccgcgataactctaagactacggtgtacctgcagatgaatagcctacgagctgaagacaccgccgtttatttttgtgcacgtggggatatttggggacagggtacactcgtgactgtctcaagcgccagtaccaaaggcccatccgtgttcccgctggctccctctagcaagtccacatcagggggaaccgcagcccttggctgcctggtaaaagactactttcctgagccagttactgtgagttggaacagcggtgctttgacatctggggtccacaccttccccgccgtgctccaatcctcaggactgtatagcctgagttctgtggtcacggttccttccagctcgctcggcactcagacctacatctgtaatgtgaaccataagccatctaatacaaaggtagatgcgagagtggaacccaaatcctgcgacaagactcacacctgtcctccatgcccggcacccgagttactgggcgggccttcagtcacactttttccacccaaacctaaggataccttgatgattagtaggacgccagaggtgacttgtgttgtggtcgacgtgagccatgaagatcccgaggtaaaattcaactggtacgttgacggagtggaagtccacaatgccaagacaaagccgcgggaggagcagtatgcttccacctaccgcgtggtctctgtgctgactgttctacatcaggattggctcaacggtaaagaatataagtgcaaagtgagcaataaggccctgcctgcacccatcgagaaaacaatatcaaaggctaaaggccaaccaagagaacctcaggtatacacccttcccccaagtagggaggaaatgacgaagaaccaggtctccctgacctgtttggtgaaggggttttatcccagcgacatcgccgttgagtgggagtctaatggacagcctgaaaacaattacaaaacaactccaccggtgctcgattcagacggcagtttctttctgtatagcaagttaaccgtcgacaaatcccggtggcaacagggtaacgtgttctcttgctcggtaatgcacgaggcgctgcacaaccattacacacagaagtcgctctccctttcacccgggaaa

SEQ ID NO: 23924 - RNA, 657 nt, synthetic construct
  misc_feature 1..657: note = derived and/or modified sequence opt3 from Eptinezumab_LightChain
  source 1..657: mol_type = other RNA
caggtgctgacccaaagcccctcctctctctcagccagtgtcggcgacagagttacaatcaactgccaggctagccagtccgtgtaccacaatacttatcttgcatggtaccagcaaaagcctgggaaagtaccaaagcagctgatttatgatgcctctacgttggcgtcgggagtgccgtcaaggttcagcggtagtggctccgggaccgactttacattaactatatctagcctgcagcccgaggatgtcgctacctactattgtctaggatcctacgactgcacaaacggcgattgtttcgtgtttggtgggggaaccaaagttgaaatcaagcggactgtggccgcaccttcagtcttcatttttccacccagtgacgagcagctcaaaagcggcacagcctctgtggtatgcctgcttaataacttctatcctcgcgaagctaaggttcaatggaaggtggataatgcactgcagtccggcaactcacaggagagcgtcaccgaacaggacagtaaagattctacgtactccttgagctcgactctcaccctgtctaaggccgactacgagaaacataaggtgtatgcttgtgaggtgacacaccaagggctgtcctcaccagtcactaaaagttttaatcgaggagaatgc

SEQ ID NO: 23925 - RNA, 1368 nt, synthetic construct
  misc_feature 1..1368: note = derived and/or modified sequence opt3 from Erenumab_HeavyChain
  source 1..1368: mol_type = other RNA
caggtgcaactggtcgagagcggcgggggagttgtgcagcccggtagatccctcaggctttcttgcgccgcttcaggcttcacctttagtagcttcgggatgcactgggtacggcaggcacctggaaagggcctggaatgggtggccgtcatctcctttgacggttctattaaatactcggtggattcagttaaggggcgcttcacaataagccgagacaacagtaaaaatactttgtttttacagatgaactccctgcgtgcggaggatacggctgtgtattactgtgccagagacaggctaaattattacgattctagcggatattaccattataagtactacggcatggcagtctggggccaagggaccacagtgactgtatcctcagccagtaccaaaggaccaagcgttttcccgctcgctccctgctctcggtccacatcagaaagcaccgcagccctgggttgtcttgtgaaggactattttcctgagccagtcactgtgagttggaactctggcgctctgacatccggggtgcacaccttccccgccgtcttgcagagctcgggactctactctctgtcctcagttgtgacggtacctagtagcaattttggcactcagacctatacatgcaacgtggatcataagccatccaatactaaagtcgacaagaccgtggaacgcaaatgttgcgttgagtgtcccccttgcccagcgccgcccgtggcaggtccttctgtcttcctgtttccacccaagcctaaagatacactcatgatcagcagaaccccagaggtgacgtgtgtagttgtggacgtctcacacgaagatcccgaggtgcagttcaactggtacgtcgacggggtggaagttcataatgccaagactaagccgagggaggagcaatttaacagtacattccgggtggtatccgtcttaaccgtggttcaccaggattggctgaatggaaaagaatataagtgcaaagtgagcaacaagggccttcctgctcccattgagaaaactatctctaagacaaaaggccagccacgcgaacctcaggtctacaccttgcccccatcacgagaggaaatgacgaagaatcaagtgagtctgacctgtctagtaaaggggttctatcccagcgacattgccgtggagtgggagtccaacggacagcctgaaaataactacaaaacaactccaccgatgctcgactctgatggttcgtttttcctgtacagcaaacttaccgttgacaagtccagatggcagcaaggcaacgtcttttcatgcagtgtgatgcacgaggcactgcataatcactatacacagaagtctttgagcctctcccccgggaaa

SEQ ID NO: 23926 - RNA, 648 nt, synthetic construct
  misc_feature 1..648: note = derived and/or modified sequence opt3 from Erenumab_LightChain
  source 1..648: mol_type = other RNA
cagagcgtgctgacccaacccccttccgtctctgccgctccaggccagaaggttacaatctcatgcagtgggagctcctctaacattggaaataactacgtgtcgtggtatcagcagctcccgggtactgcacccaaacttctgatatacgacaataacaagagaccttcaggcatcccagataggttcagcgggagtaaatccggaacgtctaccacattgggcattactggtttacaaaccggggacgaggccgattattactgtggaacatgggacagccggctgtccgcggtagtgtttggcggcgggaccaagctaactgtcctcggacagcccaaagctaatcctacagtgaccctgttcccaccctcaagtgaggaacttcaggccaacaaggcaacgctggtttgcttgatcagcgatttttatcctggtgccgtgactgtcgcttggaaggcagacggctctccagtgaaagccggggtagaaaccacaaagccgtccaaacagtcaaataacaagtacgctgccagcagttatctctctctgactcccgagcaatggaaatcccaccgcagctactcgtgtcaggttacccatgaaggatctacagtggagaagaccgtcgcgcctacggagtgctcc

SEQ ID NO: 23927 - RNA, 1344 nt, synthetic construct
  misc_feature 1..1344: note = derived and/or modified sequence opt3 from Fremanezumab_HeavyChain
  source 1..1344: mol_type = other RNA
gaggtgcagctggtcgaaagcggcgggggactcgttcaacccggtggctcccttagactgtcttgcgccgcttcagggttcacctttagtaactactggatcagctgggtgaggcaggcacctggaaagggcttggagtgggtagccgaaattcggtccgagtctgacgcgtcggctacacactatgccgaagcagtgaaaggtcgcttcactatatcacgagataatgccaagaacagcttatacctgcagatgaatagtctacgtgctgaggacacggcagtctattactgtctcgcctattttgattacgggctggctatccagaactattggggacaaggcacccttgtgacagtttcctctgccagcactaaaggcccatccgtgttcccgctggcgccctgctcaagaagtaccagcgagtctacagcagccttggggtgtctcgtcaaggactactttcctgaaccagtgaccgtatcctggaactcaggagctctgactagcggtgttcatacattccccgccgtgctgcagagttctggcctctactccttaagctcggtcgtgaccgtgccttcttccaattttgggacgcagacttatacctgcaatgtcgatcacaaaccatcaaacacaaaggttgacaagactgtggagaggaaatgttgcgtagaatgtcccccttgcccagcaccgcccgtggctggacctagtgtcttcctgtttccacccaagcctaaagatacccttatgattagccggacaccagaggtgacctgtgttgtggtcgacgtgtcccatgaggatcccgaagtacagttcaattggtacgttgacggcgtggaggtccacaacgccaagacgaaaccgcgcgaggaacaatttaattctactttcagagtggtcagcgtgttgacagttgtgcatcaggattggctgaacggtaaggaatataagtgcaaagtatcaaataaggggctacctagttccatcgagaaaaccattagcaagactaaaggacagcccagggagccacaggtctacacactccctccctctcgggaagagatgaccaagaaccaagtgtcactgacgtgtcttgttaaaggcttttatccaagtgacatcgcggtggaatgggagagcaatggccagcccgaaaacaactacaagaccacacctccaatgctggattccgacgggtctttcttcttgtattcgaagctcactgtcgacaaaagccgctggcagcaaggaaatgtgttttcctgctcagtaatgcacgaggccctgcacaaccattacacccagaagagtttatctctgagcccgggtaaa

SEQ ID NO: 23928 - RNA, 642 nt, synthetic construct
  misc_feature 1..642: note = derived and/or modified sequence opt3 from Fremanezumab_LightChain
  source 1..642: mol_type = other RNA
gagatcgtgctgacccagagccccgccacactctccctttctcctggcgaaagagctactctgtcatgcaaggcaagtaaaagggtcacgacctacgttagctggtatcaacagaagccagggcaggccccgcggttgttaatttacggagcgtccaaccgctatctgggtatacccgctcgattctctggctcggggtcaggaacagactttactctaaccatcagcagtctcgagcctgaagatttcgccgtgtactattgttcccagtcttacaattatccatacacatttggccaaggtaccaaactggagattaagcgtactgtagcagcccccagcgtgttcatctttcctccatccgacgaacagcttaaatcagggacagctagtgtcgtgtgcctgttgaacaatttctaccccagagaggcaaaggttcagtggaaggtggataacgccctccagagcggaaattctcaagagtccgtcaccgaacaggactcaaaagatagcacgtatagtctgtcttccactctgaccctcagcaaggctgactacgagaaacacaaggtgtatgcctgtgaagtaacacatcagggcttatcgtctcctgttactaaatcctttaacaggggcgagtgc

SEQ ID NO: 23929 - RNA, 1371 nt, synthetic construct
  misc_feature 1..1371: note = derived and/or modified sequence opt3 from Frunevetmab_HeavyChain
  source 1..1371: mol_type = other RNA
caggtgcaactggtcgagagcggcgccgaactcgttcagcccggggagtcccttagactgacctgcgctgcatctggattctcattgacaaacaataacgtgaattgggtaaggcaggcccctggtaagggcttagaatggatgggaggggtgtgggcgggcggtgctactgactacaacagtgccctgaaaagccggctaacgatcacccgcgatacatccaagaatactgtctttctccagatgcactctctgcaatcggaggacaccgcaacatattactgtgcccgagatgggggatattcaagcagtaccctttacgctatggacgcatggggccagggcactacagtgaccgtttccgccgcttctacgactgccccaagcgtgttcccgctggcgccctcctgcgggaccacatcaggagcaactgtcgccttggcttgtctcgtgctgggttattttcctgaaccagtaaccgttagttggaacagcggcgccctgacatctggggtgcataccttccccgcagtcctccaggcttccggattatactcactgagcagtatggtgacggtgccttcttcccgttggcttagcgatacttttacatgcaatgtcgcccacccaccctcgaacaccaaagttgacaagactgtgagaaaaacagatcatcctccaggcccgaagccctgtgactgccctaagtgtccaccccctgagatgttgggtgggccatctattttcatatttcccccgaaacctaaggataccctgtccatctcaaggacgcccgaggtaacctgcctagtggtcgacctcggaccagatgacagtgatgtgcagattacatggttcgttgacaatactcaagtgtataccgcgaaaacaagccctcgggaagaacagtttaactccacttaccgcgtcgtgtctgtactgcccatccttcaccaggactggctgaagggcaaagagttcaagtgtaaggttaatagcaaatcattgccaagtcccattgagagaaccatctccaaggccaaaggccagcctcatgagccacaagtgtacgtcctcccgcccgcacaggaggaactgagcaggaacaaggtgtctgtcacatgcttaataaaatcatttcaccctccagatatcgctgtggaatgggagattaccgggcagcccgaacctgagaataactatcggactacgccaccccaactggacagtgatggaacatacttcgtttatagcaagctctccgtggaccgctctcactggcagcgaggtaatacctacacttgttcggtaagccatgaggcccttcactcccatcacacccagaaatcactgacacagagtccgggcaag

SEQ ID NO: 23930 - RNA, 651 nt, synthetic construct
  misc_feature 1..651: note = derived and/or modified sequence opt3 from Frunevetmab_LightChain
  source 1..651: mol_type = other RNA
gacatcgagatgacccagagccccctgtccctctctgtgacacctggcgaatcagtcagtattagctgcagagcctccgaggatatatacaacgctcttgcatggtatctgcaaaagccagggaggtctccgcggttgttaatctacaatactgacacgctgcacaccggagttcccgatcgcttctcgggttcaggcagcgggacagactttactctaaaaattagtcgagtgcagaccgaagatgtaggagtgtatttctgtcagcattactttcactatcctcgtacattcggccagggtaccaagctcgagctgaaaagatccgacgcccaaccatctgtctttcttttccagcccagcctggatgaattgcatactgggtccgcgtcaatcgtgtgcattctcaacgacttttaccctaaggaggttaatgtgaaatggaaggtcgatggagtggtacagaacaagggcatccaggagagtacaaccgaacaaaatagcaaagactctacgtattccctgtcaagcactctgaccatgagttctacagagtaccagtcccacgaaaagttcagctgtgaggttactcataaatcgctcgcttctaccttagtgaagtcctttaacaggtcagagtgccagcgggaa

SEQ ID NO: 23931 - RNA, 1341 nt, synthetic construct
  misc_feature 1..1341: note = derived and/or modified sequence opt3 from Gatipotuzumab_HeavyChain
  source 1..1341: mol_type = other RNA
gaggtgcagctggtcgaaagcggcgggggactcgttcaacccggtggctccatgagactttcttgcgtggcctcagggttcccttttagtaactactggatgaattgggtaaggcaggctccaggaaagggcctggagtgggtgggtgaaatccggttgaaaagcaacaattataccacacactacgcagagtccgtcaaggggcgcttcactatttctcgagacgattcgaaaaactcattatatctgcagatgaatagcctaaagacggaagacaccgccgtgtactattgtacacgtcattactattttgattactggggacagggcactctcgttaccgtgagttccgcgtctacaaaaggcccgagcgtcttccccctggctccttcctcaaagagtaccagcgggggaactgccgcacttggttgcctggtgaaggactactttccagagcccgtaacagtttcttggaactccggcgccttgacctcaggggtgcacacgttccctgctgtcctccaaagcagtggactgtattctctgtccagcgtggtgactgtcccatcgtcttccctcggcacccagacatacatatgtaatgttaaccataaaccctcaaatactaaggtggataaaaaggtagagcctaaaagttgcgacaagacccacacatgtccaccgtgccccgcacctgaattactgggtgggccaagcgtgtttctttttccccctaagccaaaagataccttgatgatctccagaacgcccgaggtcacttgtgtggttgtggacgtctctcatgaagatccggaggtgaagttcaactggtatgtagacggagttgaggtgcacaatgccaaaacaaagcctagggaggaacagtacaacagcacctatcgggtcgtgtcagtcctgactgtgctacaccaggattggctcaatggcaaagaatacaagtgcaaagttagtaacaaggctctgcccgccccaattgagaagacaatctccaaagcgaagggccaacctcgcgaaccccaggtgtatacccttccacccagcagagacgagctgacgaaaaatcaggtatctttgacctgtctcgtcaaggggttctacccttcagatattgcagtggagtgggaaagtaacggacagccagagaacaattacaaaacaactccgcccgttctggacagcgacggttcctttttcttatattctaagctgaccgtggataagtcgaggtggcaacagggcaacgtctttagctgctccgtgatgcatgaagggctccacaatcattacacacagaaatcacttagtctgtctcctggaaag

SEQ ID NO: 23932 - RNA, 657 nt, synthetic construct
  misc_feature 1..657: note = derived and/or modified sequence opt3 from Gatipotuzumab_LightChain
  source 1..657: mol_type = other RNA
gacatcgtgatgacccagagccccctgtccaaccctgtcacaccaggcgagccggcctctatttcatgcagaagtagcaagtccctccttcactctaatgggataacttacttcttttggtatctgcaaaaacccggacagtcgcctcagttgttaatctaccagatgtcaaacctggctagcggtgttccagataggttcagtggctccgggtctggaacggactttaccctacggattagccgcgtggaagcagaggatgtaggcgtgtattactgtgcccaaaatctcgaactgccccctacattcggtcaggggactaaggtcgagatcaaacgaaccgtggcggctccatccgtttttatttttcccccttcagacgaacagcttaagagtggaacagccagcgtggtctgcctgttgaacaatttctatccacgtgaggcaaaagtgcagtggaaggtagataacgccctccaatctggcaattcccaggagtcagttaccgaacaggacagcaaggatagtacttactctctgtccagcacactgaccctctcgaaagctgactatgagaagcataaagtgtacgcatgtgaagtcacgcaccagggcttatcttccccggtgactaagtcattcaacagaggggagtgc

SEQ ID NO: 23933 - RNA, 1365 nt, synthetic construct
  misc_feature 1..1365: note = derived and/or modified sequence opt3 from Gedivumab_HeavyChain
  source 1..1365: mol_type = other RNA
gaggtgcagctggtcgaaagcggcgggggagttgtgcaacccggtaagtccctcagactttcttgcgccgcttcaggcctgaccttcagtagctacgcagtacactgggtgaggcaggcccctgggaaaggattggagtgggtcacattaatctcctatgacggcgcgaaccagtactatgctgattctgtgaagggtcggtttactatttcgcgcgacaattcaaagaacacggtttacctgcagatgaatagcctacgaccagaagataccgccgtgtattactgtgcagtcccggggcccgtgttcggaatatttcctccatggagttatttcgacaactggggccaaggcatcctcgtaacagtttcctctgccagcactaaagggccctccgtgtttcctctggctccatcaagtaaaagcacctctggaggtacagcagcccttggctgcctggtcaaggattacttccccgagcctgtgaccgtgtcctggaactcaggggctttgactagcggagtccatacatttccagccgttctccagagttctggcctgtactccctgagctcggtggtaaccgtgccgtcttcctcactcggtacgcagacttatatttgtaatgtcaatcacaagcccagtaacaccaaagtggacaagaaagttgaacctaagagctgcgataaaacacatacttgtccaccctgccctgcgccagagttacttgggggaccctccgtgttcctgtttccgcctaagcccaaggacaccttgatgatctctcgtacaccagaggtcacctgtgtggtagttgatgtgagccacgaagaccctgaggtcaaattcaattggtacgtggatggcgtcgaagtgcataacgcaaagacgaaacccagagaggagcagtataattcaacttacagggttgtgagtgtactgacagtcctacaccaagactggctcaacggcaaggaatataaatgcaaggtgtccaataaagccctgccagctcccattgagaagaccatcagcaaggccaaagggcagcctcgggaaccacaggtttacactcttccgccctctcgcgaggaaatgacaaagaaccaggtgtcactgacctgtttggtcaaaggattttatcctagtgatatagcagtggagtgggagagcaatggtcaaccagaaaacaactacaagacgacaccccctgtactcgactccgacggctctttctttctgtactcgaaattaaccgtggataagagcagatggcagcaggggaatgttttctcctgctcagtcatgcacgaggctctgcataaccactatactcaaaagagtctctctcttagcccaggaaaa

SEQ ID NO: 23934 - RNA, 648 nt, synthetic construct
  misc_feature 1..648: note = derived and/or modified sequence opt3 from Gedivumab_LightChain
  source 1..648: mol_type = other RNA
gagatcgtgctgacccagagccccgccacactctccgtctctcctggcgaacgggctactctttcatgcagggcaagtcaagttattagccacaacctggcctggtaccagcagaagccagggcaggcgccgcggttgttaatatatggagcttccacgcgcgcctctggtatccccgcacgattctcgggctcagggagcggaaccgactacacactgactattaccagtctacaatccgaggattttgccgtgtattactgtcagcattattctaattggcctccacgtctcacattcggcggtgggaccaaagtagaaatcaagagaactgtggctgcacccagcgtctttattttccctccatccgacgagcagctgaaatcaggaacagccagtgtggtttgccttctgaacaatttttaccccagggaagctaaggtgcagtggaaagtcgataacgccttgcaaagcggcaattctcaggagtccgtgaccgagcaggactcaaaggatagcacgtatagtctctcttccactctgaccctgagcaaggcggactacgaaaaacacaaggtatacgcatgtgaggttacacatcagggcctctcgtctcctgtgactaaatccttcaacagaggggaatgc

SEQ ID NO: 23935 - RNA, 1329 nt, synthetic construct
  misc_feature 1..1329: note = derived and/or modified sequence opt3 from Gemetuzumab_HeavyChain
  source 1..1329: mol_type = other RNA
gaggtgcagctggtccaaagcggcgccgaagttaagaaacccgggtcctctgtgaaggtatcatgcaaagctagtggatacaccatcacagacagcaacattcactgggtgagacaggcacctggtcagtccctcgagtggataggctatatctacccatataatgggggaactgattacaaccagaagttcaaaaatagggccacgcttaccgtcgacaacccgacaaatactgcgtatatggaactgtcttcgttgcggtcagaggataccgctttttactattgtgtgaacggcaatccctggttagcctactggggtcaagggacactggttaccgtgagcagtgcatccactaagggaccttctgtcttcccactagccccctgcagccgctccacatcagaaagtaccgctgcactcggctgtctggtgaaggactactttcctgagccagtaacggttagctggaactctggcgcccttacttccggggtgcataccttccccgctgtcctgcagtcaagcggattgtatagtctctcttccgtggtgacagtccctagctcgtctctgggtactaaaacctacacatgcaatgttgatcacaagccatccaacaccaaagtggacaagcgagtagagtcaaaatatggcccgccctgtcctccatgccccgcccctgaatttctcgggggaccaagtgtgttcctgtttcccccgaagcctaaggatacgttaatgattagccgtactcccgaggtcacatgtgtggttgtggacgtctcccaggaagatccagaggtgcagttcaattggtacgtagacggcgttgaggtgcataacgcgaaaaccaagcctagagaggaacaatttaattctacttatagggtcgtgagcgtcctgacagtgcttcaccaggattggttgaacggtaaagaatacaagtgcaaagtttcaaataaggggctgcccagttccatcgagaaaaccattagcaaggcaaagggacagccacgggaaccccaggtgtatacgctacctccatctcaagaggagatgaccaaaaaccaggtatcactcacatgtctggtcaagggcttctacccgagtgacatcgccgtggaatgggagagcaacggccagcccgaaaataactacaaaactacccctccagttcttgattccgacgggtcgtttttcctgtattctcgcttgacagtggacaagagcagatggcaagagggaaatgtcttttcctgctcagtgatgcatgaagctctccacaaccactacactcagaaaagtctgtctttaagcctgggtaag

SEQ ID NO: 23936 - RNA, 654 nt, synthetic construct
  misc_feature 1..654: note = derived and/or modified sequence opt3 from Gemetuzumab_LightChain
  source 1..654: mol_type = other RNA
gacatccagctgacccaaagcccctccacactctctgcctcagtgggcgatagagtcactattacgtgcagggctagtgagagccttgacaactacgggatacggttcctgacctggtttcagcagaagcctggaaaagcaccaaagttgttaatgtatgccgcgtccaatcagggttctggcgttccgtcgcgcttctcagggagcggaagtggcacagaatttactctgaccatctcctctctacaacccgatgacttcgctacatactattgtcagcagaccaaagaggtgccttggagctttggtcaggggactaaggtagaagtgaaacgaacagtcgccgcaccatccgtgttcatttttcccccttcagatgagcaactcaagagtggaaccgccagcgttgtgtgcctgcttaacaatttctacccacgtgaagctaaggtccagtggaaagtggacaacgcactgcagtctggcaattcccaggagtcagtaacggagcaagatagcaaggacagtacttattctttgtccagcaccctcacactgtcgaaagccgattacgaaaagcacaaagtttatgcttgtgaggtgactcatcagggcctgtcttcccccgtcaccaagtcatttaacagaggggaatgc

SEQ ID NO: 23937 - RNA, 1365 nt, synthetic construct
  misc_feature 1..1365: note = derived and/or modified sequence opt3 from Gilvetmab_HeavyChain
  source 1..1365: mol_type = other RNA
gaggtgcagctggtccaaagcggcggggacctcgttaagcccggaggttccgtgagactttcttgcgtagcctcaggcttcaacatcaaaaatacctacatgcactgggtgaggcaggctcctgggaagggactgcagtggattggccggatagcaccagccaacgtcgatacaaaatatgcgccgaagtttcagggtaaagctactatcagtgccgacacggcaaagaataccgcctacatgcaattgaacagcttacgcgctgaagatacagcagtgtattactgtgttctgatttattacgactatgatggggacatcgatgtgtggggacagggcactctagtcaccgtgtcctctgcctcgacaaccgctccctcagtattccctctcgccccaagctgcggcagtacttccgggtctacagttgcgctggcatgtcttgtgagcggatactttcccgagcctgtcaccgtgtcctggaactcaggtagtctgacgagcggcgtgcatactttcccatctgtcttgcagtcctcagggctctacagcctgagttctatggttaccgtgccctccagccgatggccttcggaaacatttacttgcaatgtagcccacccagcttctaagaccaaagtggacaagccggtccccaaacgtgagaatggaagagtgcctaggccacccgattgtcctaagtgcccagcccccgaaatgctgggcggtccgtccgttttcatttttcctcccaaaccaaaggacacactcttaatcgcacggacccctgaggtgacgtgtgtcgtggtagctctggatcccgaggacccagaagttcagatatcatggttcgtggatgggaagcaaatgcagactgccaaaacacagccccgcgaggaacagtttgcgggaacctatagagtcgtgagtgtccttcctatcggccatcaagactggttgaagggcaaacagttcacttgcaaggtgaacaataaagccctgccaagcccgattgagaggacaatctccaaggcacgggggcaggctcaccaaccctctgtttacgtgctacctccaagccgcgaggaactcagtaaaaacaccgtatcactgacgtgtcttattaaggactttttccctcccgatatcgacgtcgagtggcagtccaatggacagcaggaaccagagagcaagtatcgaaccacacccccgcaactggatgaagacggttcttactttttgtattcaaaactcagtgtggataagagcagatggcagaggggcgacactttcatatgcgccgttatgcatgaggctctgcacaaccactacacccaggagtccttatctcattcgcctgggaaa

SEQ ID NO: 23938 - RNA, 654 nt, synthetic construct
  misc_feature 1..654: note = derived and/or modified sequence opt3 from Gilvetmab_LightChain
  source 1..654: mol_type = other RNA
gacatcgtgatgacccagacacccctgagcctctccgtctctcttggcgagcctgcctcaattagttgccacgctagccaaaacataaatgtttggctgtcctggtacagacagaagccagggcagatcccgcagttgttaatttataaagcatctcatctgcacactggagtgcccgataggttctcgggttcaggcagcgggacggactttaccctacggatcagtcgcgtagaagccgatgacgcgggagtgtactattgtcaacagggccagtcctggcctctcacattcggtcaggggactaaggtcgagattaaacgaaacgatgctcaaccagccgtgtacctgtttcagccctctcctgaccagcttcataccggaagcgcatccgttgtgtgcctgctcaattcattctatccaaaggatatcaacgtcaaatggaaggtggacggcgtaatacaggatacaggcatccaagaaagtgttaccgagcaggacagcaaggattctacttactccttgtcaagcacactgaccatgagttctacggaatatctgtcccacgagctctacagctgtgagattactcataaatcgttaccctctaccctgatcaagtcctttcagcgttcagaatgccaaagagtggac

SEQ ID NO: 23939 - RNA, 1344 nt, synthetic construct; identical to SEQ ID NO: 23222
  misc_feature 1..1344: note = derived and/or modified sequence opt3 from Ifabotuzumab_HeavyChain
  source 1..1344: mol_type = other RNA

SEQ ID NO: 23940 - RNA, 642 nt, synthetic construct; identical to SEQ ID NO: 23223
  misc_feature 1..642: note = derived and/or modified sequence opt3 from Ifabotuzumab_LightChain
  source 1..642: mol_type = other RNA

SEQ ID NO: 23941 - RNA, 1323 nt, synthetic construct
  misc_feature 1..1323: note = derived and/or modified sequence opt3 from Iratumumab_HeavyChain
  source 1..1323: mol_type = other RNA
caggtgcaactgcagcagtggggcgccgggctccttaagcccagcgagaccctgtccttgacatgcgctgtctacggaggttctttctcagcatattactggagttggatcagacagcctccaggcaaagggttagaatggattggagacataaaccacggcggtgggactaattataacccgagcctgaagtccagggttacgatctctgtggatacctcgaaaaatcaattttcactaaagctcaacagcgtaacagccgcggacactgctgtgtactattgtgccagtctgaccgcatactggggacagggctcccttgtcacagtgtctagcgcctccaccaaaggcccctcagttttccctctggctccaagtagcaagtctacttccgggggaacagcagccttgggttgcctcgtgaaggattattttcccgagcctgtcaccgtgtcatggaatagcggcgctctgacgagtggggtacatactttcccagccgttctgcagtcttccggactctacagcttatcgtctgtggtcaccgtgccctcctcaagtctgggcacacagacttacatttgtaacgtgaatcacaaacctagcaacaccaaggtcgacaaaaaggttgaaccaaaatcctgcgataagacacatacctgtccgccctgccctgcgccagagcttttgggtgggccctctgtgtttctgttccctccaaagcccaaagacacgctaatgatcagccggactccggaagtaacatgtgtggtcgtggatgtttcacacgaggaccctgaggtgaagtttaattggtatgtcgatggagtggaagtacataacgcaaaaaccaagccccgcgaggaacaatacaatagtacttatcgagttgtgtccgtcctcacagtgctgcaccaggactggcttaacggcaaagagtacaagtgcaaagtcagcaataaggccctgccagctcctattgagaagaccatctctaaagccaagggccagccccgtgaaccacaggtgtatacgttgcccccttcaagagatgagctcaccaaaaaccaagttagtctgacatgtttagtgaaggggttctacccaagcgacatagcagtagaatgggagtccaatggacagccggaaaacaactataaaactacaccccctgtcctggattctgacggttcgtttttcctctacagcaaacttaccgtggacaagtccaggtggcagcaaggcaatgtgttttcatgcagtgttatgcacgaggctctgcataaccacactcagaagtctttgagcctatccccagggaag

SEQ ID NO: 23942 - RNA, 642 nt, synthetic construct
  misc_feature 1..642: note = derived and/or modified sequence opt3 from Iratumumab_LightChain
  source 1..642: mol_type = other RNA
gacatccagatgacccaaagccccacatccctgtctgcctcagtgggcgatagagtcactattacgtgcagggctagtcaggggataagctcctggctcacctggtaccagcagaagcctgagaaagcaccaaagtctcttatctatgccgcgtcgtcactgcaaagcggagttccgagtcggttctccggttctggcagcgggacagactttactttgaccatttcctcattacagcccgaagatttcgctacatactattgtcagcagtacgacagttatcctatcacctttggacaaggcactcgcctggagattaaacgaacagtggccgcaccaagcgtattcatctttcccccttctgatgaacagctaaagtccggtaccgcctcagtggtctgcctcctgaacaatttctacccacgtgaggctaaagtgcagtggaaggttgacaacgcacttcagagcgggaatagtcaagaatctgtgacggagcaggattccaaggacagcacttattcgctgtcttccaccttgacactctcaaaagccgattacgagaagcacaaagtctacgcttgtgaagtgactcatcagggactgagtagccccgtaaccaagtcctttaacagaggcgagtgc

SEQ ID NO: 23943 - RNA, 1344 nt, synthetic construct
  misc_feature 1..1344: note = derived and/or modified sequence opt3 from Lacnotuzumab_HeavyChain
  source 1..1344: mol_type = other RNA
caggtgcagctgcaggagagcggccccgggctcgtcaagccttcccagaccctttctctgacatgcactgtttcagactacagtatcacgagcgattatgcctggaactggattagacagttcccaggaaaaggtttggaatggatgggctacatatcctattctgggtcgacctcatacaatccgagcttaaagagtaggatcacaatttcccgggacacttctaaaaaccaatttagcctgcagctaaattccgtgaccgctgcagatacagccgtatattactgtgcgtcattcgactatgctcacgccatggattactggggacagggcaccactgtgacagtcagtagcgcatctaccaagggtccctccgtgtttcctctcgccccatcaagcaaaagtacgtctgggggaactgctgcactgggctgccttgttaaggactacttccccgagcctgtgaccgtctcctggaacagcggcgccctgacatcgggggtgcatacttttccagctgtattgcagtcttccggactctattcactgagtagcgttgtgaccgtcccctcctctagcctgggtacacaaacctacatctgtaatgtgaaccacaagccttcaaatacgaaagtggataagcgcgtcgaaccaaaaagttgcgacaagactcatacatgtccgccctgccctgccccagagctcttaggcgggccctccgttttcctgtttcctccaaaacccaaggatacccttatgattagccgaactccggaagtgacatgtgtagtggtcgacgtgtctcacgaggatcctgaggttaagttcaactggtatgtggacggagtcgaagtgcataatgcgaaaaccaagccccgtgaggaacagtacaactcaacgtatagagtagttagtgtgttgaccgtcctgcaccaggattggctaaatggcaaagagtacaagtgcaaagtgagcaacaaggcactcccagcccctatcgagaaaacaatatccaaggctaagggtcagcccagggaaccacaagtctatactctgcccccttctcgggaggaaatgaccaaaaatcaggtgtcgcttacatgtctggttaaggggttttacccaagcgacatcgccgtggagtgggaatccaacggacagccggagaataactacaaaactacaccccctgtattggactcagatggcagtttctttctctattctaagctgaccgtcgacaaaagccgctggcaacagggcaacgtgttctcctgctcagttatgcacgaggcattacataatcactacacccaaaagagcctgtctctctccccagggaag

SEQ ID NO: 23944 - RNA, 642 nt, synthetic construct
  misc_feature 1..642: note = derived and/or modified sequence opt3 from Lacnotuzumab_LightChain
  source 1..642: mol_type = other RNA
gacatcgtgctgacccagagccccgccttcctctccgtcacacctggcgagaaggttacttttacgtgccaggcttctcaatcaattgggaccagtatacactggtaccagcagaaaacagatcaagcaccaaaacttctgatcaagtatgccagcgaatccatttctggaatcccgtcgagattctcaggtagcggcagtgggactgactttaccttgacaatttcctctgtggaggcggaagatgctgccgactactattgtcagcagatcaacagctggcccaccactttcggaggcggtacaaagttagagataaaaaggaccgtagcagccccttccgtgtttatcttcccaccctcagatgaacagctgaagagtgggacggctagcgtcgtgtgcctactcaataacttttaccctcgggaggcaaaggttcaatggaaagtggacaatgccctgcagtctggaaactcccaggagtcagtcactgaacaggatagcaaggacagtacctattctctttccagcacactgactttgtcgaaagctgattacgagaagcataaagtgtatgcctgtgaagtaacccaccaaggcctctcttccccagttacaaagtcattcaatcgcggcgagtgc

SEQ ID NO: 23945 - RNA, 1347 nt, synthetic construct
  misc_feature 1..1347: note = derived and/or modified sequence opt3 from Larcaviximab_HeavyChain
  source 1..1347: mol_type = other RNA
gaggtgcagctgcaagaaagcggccccgagctcgaaatgcctggggcctccgtcaagatctcttgcaaggcttcaggaagtagcttcaccggtttttccatgaactgggttaaacagtctaatggcaaatcgcttgagtggattgggaacatagacacatactatggaggcactacgtacaatcagaagttcaaaggtaaggcaaccctgacagtggataagtcaagcagtactgcctatatgcagttgaaatccttaacctctgaagacagcgcggtatactattgtgctagatccgcctactatgggtcaacatttgcatactggggacaaggcaccctggtgactgtcagtgccgctagcacaaagggcccatctgtgttcccgctagcaccctcctcaaaaagcaccagtgggggaacggccgctctcggttgcctggttaaggattactttcctgagccagtgactgtctcttggaactccggcgcccttaccagcggggtgcacacattccccgcggtactgcagtcgtctggattgtattccctctcaagtgttgtgactgtccctagctcctctctgggcacccagacatacatctgtaatgtgaaccataaaccaagcaataccaaggtggacaagagggtcgagcccaaatcatgcgataagacgcacacttgtcctccatgcccggcacccgaactgctcggtgggcctagtgtttttctcttcccacccaaacctaaggacacactgatgatttcccggaccccagaggtgacttgtgtagtggtcgatgtgagccatgaagaccccgaggttaaatttaactggtatgtggatggagtcgaggtgcacaatgccaagacaaaaccgcgcgaggaacagtacaactctacctatcgagtagtttcagtgcttacggtcttgcatcaagactggctgaatggcaaggaatacaagtgcaaagtgagtaacaaggctctacctgcccccatcgagaaaaccattagcaaggcaaaaggccagccacgtgaacctcaggtctatacattacccccatccagagatgagctgactaagaatcaggtgtctcttacctgtctggttaaggggttctacccctcggacatcgctgtggagtgggaaagcaacggacaacctgagaataactacaaaacaactccaccggtattggattccgacggttcatttttcctctatagtaagctgaccgtcgacaaatctaggtggcagcagggcaacgtgtttagctgctccgttatgcacgaagccttacacaatcattacacacaaaagtcactgagcctctctcccgggaaa

SEQ ID NO: 23946 - RNA, 642 nt, synthetic construct
  misc_feature 1..642: note = derived and/or modified sequence opt3 from Larcaviximab_LightChain
  source 1..642: mol_type = other RNA
gacatccagatgacccaaagccccgcctccctgtctgcttcagtgggcgagacagtcactattacgtgcagagcaagtgaaaacatatacagctatctcgcctggtaccagcagaagcaggggaaatcccctcaacttctggtttataatgcgaagaccttgatcgagggagtgccatctaggttctcgggttcaggcagcgggacacagtttagtttaaaaattaactccctgcagccggaagatttcggatcttacttttgtcagcaccatttcggcactccctttaccttcggtagcgggacagagctagaaatcaagcggaccgtagctgccccttccgtgtttattttcccaccctcagacgagcaactcaaaagtggaactgcaagcgtcgtgtgcctgcttaataacttttatcctcgcgaggccaaggttcagtggaaggtggataatgctctgcagtctggcaactcccaggaatcagtcacagagcaagacagcaaagatagtacctactctttgtccagcacgctcactctgtcgaaggcagactatgaaaaacacaaggtgtacgcctgtgaggtaacccatcagggcctgtcttccccagttacaaaatcattcaatcgaggggagtgc

SEQ ID NO: 23947 - RNA, 1338 nt, synthetic construct
  misc_feature 1..1338: note = derived and/or modified sequence opt3 from Lendalizumab_HeavyChain
  source 1..1338: mol_type = other RNA
caggtgcaactggtccagagcggcgccgaggttaagaaacccggggcttccgtgaaggtatcttgcaaagcatcaggatacaccttcacagactatagtatggattgggtgagacaggcccctggtcagggcctcgaatggatgggggcgatccaccttaacactggatacacgaattataaccaaaagtttaaaggcagggtcaccatgacacgggacactagcacctccacagtgtacatggagctgtcttcgttgcgctcagaagataccgctgtttattactgtgcccgaggtttctatgacgggtacagcccaatggattactggggacagggcactacagtgaccgtcagttccgcatctacgaagggcccgagcgtgtttcccttagccccttgctcccgttcaacttccgagagcaccgctgcactggggtgtctagtaaaggactatttcccagaacccgttacagtgtcttggaatagtggagccctcacttcaggtgtccatacctttcctgctgtgctgcagagcagtggcctttactctctgtccagcgtggtcacagttccatcgtctaacttcgggacccagacgtatacttgcaatgtggatcacaaaccctccaacacaaaggtagacaaaaccgtggagagaaagtgttgcgtcgagtgtcctccatgcccggcgccccctgtggccggaccatcagttttcttgtttccccctaaaccaaaggatactctcatgattagtaggacacccgaagtgacctgtgtcgtggtagacgttagccaagaggatccggaagtgcagtttaattggtacgtcgacggcgtggaggtccataacgcaaagacgaaacctcgggaggaacagttcaattccacctatcgcgtggtttctgtgctgacagtactgcaccaggattggctcaacggtaaggagtacaaatgcaaggtcagcaataaagggttaccctcaagtatagaaaagactatctccaaagccaagggacaaccaagagagcctcaggtgtataccctgcccccaagccaggaagagatgacaaagaaccaagtttctcttacttgtttggtgaaaggcttttacccctcagacattgctgtcgagtgggaaagtaatggccagcctgagaacaattacaagaccacaccaccggtgctggacagcgatgggtccttctttctatattctaggctcaccgtagacaaatcgcggtggcaggaaggaaacgtgttcagctgctccgttatgcatgaggccctgcacaaccactacactcagaagtcacttagtctgtctttgggtaaa

SEQ ID NO: 23948 - RNA, 654 nt, synthetic construct
  misc_feature 1..654: note = derived and/or modified sequence opt3 from Lendalizumab_LightChain
  source 1..654: mol_type = other RNA
gacatccagatgacccaaagcccctcctctctgtcagccagtgtgggcgatagagtcacaattacttgcagggctagcgagtccgttgactcttacgggaactcgttcatgcactggtatcagcagaagcctggaaaagcaccaaagctccttatataccgggcctcaaatctggaaagcggtgtgccgagtcgcttttccggctctgggagcggaacggatttcaccttgacaatctcctcattacagcccgaggactttgcgacttattactgtcaacagagtaacgaagatccttataccttcggcggtgggacaaaagtagagattaagcgaaccgtggctgccccaagcgtctttatctttcccccttctgacgaacagctgaaatccggaactgcatcagtggtttgcctactcaataacttctacccacgtgaggccaaggtgcagtggaaggtcgataatgctctgcaaagcggcaacagtcaggagtctgtgacagaacaggactccaaagatagcacctattcgctttcttccacgctgactttgtcaaaggcagactacgagaaacataaggtatacgcctgtgaagttacccaccagggcctcagtagccccgtgacaaaatccttcaatagaggggagtgc

SEQ ID NO: 23949 - RNA, 1359 nt, synthetic construct
  misc_feature 1..1359: note = derived and/or modified sequence opt3 from Lesofavumab_HeavyChain
  source 1..1359: mol_type = other RNA
gaggtgcagctggtccagagcggcgccgaagttaagaaacccggggagtccctcaagatctcttgcaaagtgtcaggatacagtttcaccagccagtggattggttgggtaagacagatgcctggcaaggggcttgaatggataggaatgatgtatccaggcgagtccgaaacaatctactctccgtcgtttcagggtcaagtgactatttcagctgacaacagcatcagtacggcatatctgcagtggtcctctttgaaagccagcgataccgcgatttactattgtgcttccgggcccggatactcaggctatcactacggctggttcgacacatgggggcagggaactttagtcaccgtgagtagcgcctctacaaagggtccttccgtttttccactggcaccctcaagcaagagtacctctggcgggactgccgctctaggatgcctcgtgaaagattacttccctgagccagtcacagtgtcctggaatagcggcgcactgacctcgggtgtacatacgtttcccgccgttcttcagtcttccgggctgtattcattgagtagcgtggtcactgtgccttcctctagcctcggaacccaaacatacatctgtaacgtgaatcacaagccatcaaacactaaagtcgacaagaaagttgagccgaagagttgcgataagacccatacatgtcccccttgcccagctcccgaactgctgggcggcccttccgtgttcctctttccacccaaaccgaaggacaccttaatgataagcaggacgcctgaggtaacttgtgtggtcgtggatgtttctcacgaagaccccgaggtgaaattcaattggtatgtcgatggggtggaggtacataacgccaagacaaaaccacgggaggaacagtacaattcaacctatcgcgttgtgagtgtcctgactgtgcttcaccaggactggttgaacggaaaggaatacaaatgcaaggtcagcaataaggcgctgcctgcacccatcgagaaaacaatttccaaggccaaaggtcagccacgagaaccccaagtgtataccctacctccatctcgtgaggagatgacgaagaaccaggtttcgctcacctgtctggtgaaaggcttttacccgagcgatatcgctgtagaatgggagtccaatgggcagcccgaaaacaattacaagacaactcctccagtccttgactcagatggaagtttctttctgtattctaagttgaccgtggacaaaagcagatggcaacagggcaacgttttctcctgctcagtgatgcacgaggccctccataatcactacacacaaaagagcctgtctttatcccccggtaaa

SEQ ID NO: 23950 - RNA, 657 nt, synthetic construct
  misc_feature 1..657: note = derived and/or modified sequence opt3 from Lesofavumab_LightChain
  source 1..657: mol_type = other RNA
gacatcgtgatgacccagagccccctgtccctccctgtcacaccaggcgagccggcctctatttcatgcagaagtagccaatcccttctgaggtctaacgggtacaattatttggattggtacttacagaagcccggacagtcgcctcagctgctaatatatctcggttcaaaccgggctagcggcgttccagaccgcttcagtgggtccggatctggcactgattttacgctgaaaatcagccgagtggaagcagaggacgtaggtgtgtactattgtatgcaagcccttcagaccccctacacattcgggcagggaactaagctggaaattaaacgtaccgtcgcggctccttccgtgtttatcttcccaccctcagatgagcagttgaagagtggcacagccagcgttgtgtgcctcctgaataacttttatcctagagaagcaaaagtccaatggaaggtggacaatgccctgcagtctggcaactcccaggagtcagtaaccgagcaggatagcaaggacagtacttactctctctccagcacattaaccctgtcgaaagctgattacgaaaagcacaaagtttatgcatgtgaggtgacgcatcaagggctttcttccccagtcactaagtcattcaataggggagaatgc

SEQ ID NO: 23951 - RNA, 1059 nt, synthetic construct
  misc_feature 1..1059: note = derived and/or modified sequence opt3 from Letolizumab_HeavyChain
  source 1..1059: mol_type = other RNA
gaggtgcagctgctcgaaagcggcgggggacttgtccaacccggtggctccctgagattgtcttgcgccgcttcagggttcacctttaactgggagttaatgggatgggcaaggcaggcccctggcaagggtctggaatgggttagtgggatcgagggaccaggcgacgtgacatactatgcggatagcgtaaaaggccggttcactatttcccgcgacaattctaagaacacgctatacctccagatgaatagcctgcgagctgaagataccgccgtgtattactgtgtcaaagtggggaaggacgcaaaatcagattatcgtggacagggtacacttgttactgtgagcagtgcctccaccgagccgaagtctagcgacaagacacacacctcacccccttccccagctcccgagctgttgggcgggagtagcgtctttctcttccctccaaaacccaaggatactctgatgatatctagaacacctgaagtgacctgcgtagttgtggacgtctcccatgaggatccagaagtgaaatttaactggtacgtggacggagtcgaggttcacaatgcaaagacgaaaccgagggaggaacaatataactcaacttaccgggtggtaagcgtgctgaccgtcctccatcaggattggttaaatggcaaggagtacaagtgtaaagtgagtaacaaggccctgcccgctcctatcgaaaagacaatttctaaggccaaaggtcagccacgcgagccccaggtttatactcttcctccatccagagacgaattgaccaagaatcaagtgagcctgacatgcctagtcaaagggttctacccctcggatatcgcggtggagtgggagtctaacggacagccggaaaataactataagaccacgcctcccgtactcgactccgacggctcatttttcctgtacagtaaacttactgttgataaatcgaggtggcagcagggcaatgtgttttcctgttctgtcatgcacgaggcactgcataaccactatacacaaaagagcttgtcactcagtccagggaaa

SEQ ID NO: 23952 - RNA, 1338 nt, synthetic construct
  misc_feature 1..1338: note = derived and/or modified sequence opt3 from Losatuxizumab_HeavyChain
  source 1..1338: mol_type = other RNA
gaggtgcagctgcaagaaagcggccccgggctcgtcaagccttcccagaccctttctctgacatgcactgtttcaggatacagtatcagcagagacttcgcctggaactggattaggcagccaccgggtaaaggcttggagtggatggggtatatatcctacaatggaaacacgcggtatcagccctctttaaagtcgcgcatcaccatttcacgagatacaagcaaaaatcaatttttcctgaagctaaacagtgtgactgctgcagacaccgccacatactattgtgtaaccgcgtcccgtggctttccttactggggtcaggggactctcgtgacagtctctagcgcttccaccaaaggaccatcagtgttccccctggcccctagtagcaagtctacgtccggcggcactgcagcccttgggtgcctggttaaggattattttccagaacccgtgaccgtctcatggaatagcggagctttgacaagtggtgtgcacactttccctgcagtactccagtcttccggcctgtacagcctgtcgtctgttgtgaccgtcccatcctcaagtctcgggacacagacctacatctgtaacgtgaatcataaaccgagcaacacgaaggtggacaaaaaggtcgagcccaaatcctgcgataagactcacacatgtcctccatgccccgcccctgaattactgggaggcccatctgtttttctttttcccccgaagcctaaagacaccttgatgattagcagaactcccgaggtgacatgtgtagtggtcgatgtgtcacatgaggacccagaagttaagttcaattggtatgtggatggtgtcgaggtgcacaacgctaaaaccaagcctagggaggaacaatacaatagtacgtatcgggtagtttccgtgctgaccgtcctacatcaggactggctcaacgggaaagagtacaagtgcaaagtgagcaataaggccctgcccgcgccaatcgaaaagacaatatctaaagcaaagggacagccccgcgagcctcaggtctatactcttccaccgtcaagagaagagatgaccaaaaaccaagtgagtctgacatgtttggttaagggcttctaccccagcgatatcgccgtggaatgggagtccaatggccagcctgagaacaactataaaactaccccacccgtactcgactctgatgggtcgtttttcctgtacagcaagttaacagtcgacaagtccaggtggcagcaaggaaatgtgttttcatgcagtgttatgcacgaagctctgcacaaccattacacccagaaatctctcagcctttcccctggtaag

SEQ ID NO: 23953 - RNA, 642 nt, synthetic construct; identical to SEQ ID NO: 23131
  misc_feature 1..642: note = derived and/or modified sequence opt3 from Losatuxizumab_LightChain
  source 1..642: mol_type = other RNA

SEQ ID NO: 23954 - RNA, 1338 nt, synthetic construct
  misc_feature 1..1338: note = derived and/or modified sequence opt3 from Lupartumab_HeavyChain
  source 1..1338: mol_type = other RNA
gaggtgcagctgctcgaaagcggcgggggacttgtccaacccggtggctccctgagattgtcttgcgccgcttcagggttcacctttagtaacgcatggatgagctgggttaggcaggcccctggaaagggcttagagtgggtgtcctacatctcttcgtcaggtagcacaatttattacgcggacagtgtaaaagggcggttcactatatcccgcgataattctaagaacacgctgtatctacagatgaatagcctccgagctgaagacaccgccgtgtactattgtgcacgtgagggactgtgggcctttgattactggggccagggcacacttgtcactgtgtcctcagctagtaccaaagggccaagcgttttcccgctggcaccctcttccaagtcaacaagcggaggtaccgccgctttgggctgcctcgtgaaagactattttcctgaaccagtcactgtgagttggaactctggggccctgacatccggagtacacaccttccccgcggttctgcaaagctcgggcctctactctttatcctcagtggtcacggtgcctagtagctccctgggtactcagacctacatctgtaatgtgaaccataagccatctaatacaaaggtcgataaaaaggttgagcccaaaagctgcgacaagactcacacctgtcctccatgcccggcacccgagcttttgggagggccttcagtgtttctgttcccacccaaacctaaggatacactaatgattagtagaaccccagaagtaacgtgtgtggtcgtggacgtttcccatgaggatcccgaagtgaagtttaactggtatgtcgacggcgtggaggtacacaatgccaaaactaagccgagggaggaacagtacaacagcacatatcgggttgtgtctgtcctcaccgtgctgcatcaggattggcttaatggcaaagagtacaagtgcaaagtctcaaacaaggctctgcctgcccccatcgaaaagactattagtaaggcaaaggggcaaccacgcgagcctcaggtgtatacattgcccccaagcagagacgaactcaccaaaaatcaggtttccctgacgtgtttagtgaagggattctacccctctgatatcgctgtagagtgggagtcgaacggtcagcctgaaaataactataaaaccacaccaccggtcctggacagcgacggctcctttttcctctactcaaaacttactgtggataaaagtaggtggcaacaggggaacgtgttttcttgcagcgttatgcacgaggccctgcacaatcattacacccagaagtccttgtcactaagccccgga

SEQ ID NO: 23955 - RNA, 651 nt, synthetic construct
  misc_feature 1..651: note = derived and/or modified sequence opt3 from Lupartumab_LightChain
  source 1..651: mol_type = other RNA
gagagcgtgctgacccagcccccttccgtctctggcgccccagggcaaagagttacaatctcatgcactggaagtagctccaacattggtgctggctacgtggtacactggtatcagcagctcccggggacggcacccaaacttctgatatacgacaataacaagaggccttctggagtgccagatcggttctcgggctcaaagagcggtaccagtgcctccttggcgatctctgggttacgcagcgaagacgaggctgattattactgtgccgcatgggacgatcgactgaatggacccgtctttggcggcgggacaaaactaactgtgctcggacagcctaaggccgctccatccgttaccctgtttcccccttcaagtgaggaacttcaagcaaacaaagccacactggtgtgcttgattagcgacttctatccaggtgctgtcaccgtggcctggaaggcggattcttccccggtaaaggcaggcgttgaaactacaaccccctcaaaacagagcaataacaagtacgccgctagttcttatctctccctgacgcctgagcagtggaaaagccatcgttcgtactcttgtcaggtgactcacgaggggtccaccgtcgaaaagacagtggccccaactgagtgctca

SEQ ID NO: 23956 - RNA, 1731 nt, synthetic construct
  misc_feature 1..1731: note = derived and/or modified sequence opt3 from Lutikizumab_HeavyChain
  source 1..1731: mol_type = other RNA
gaggtgcagctggtcgaaagcggcgggggagttgtgcagcccggtagatccctcaggctttcttgctcagccagtggcttcatctttagccggtacgacatgtcctgggtacgccaggctcctgggaagggactggagtgggtggcatatatttctcacggcggtgccgggacctactatccagattcggtcaaaggacgattcacaatatcacgtgacaacagcaagaatactttgtttttacagatggatagtctgagaccggaagacacgggcgtgtacttctgtgcgaggggcggggttaccaaaggatattttgatgtgtggggtcagggcacacccgtcactgtgtcctctgctagcaccaaggggcctcaagtacagctagttgagtccggaggcggtgtggtccagccagggcggtcactccgcctgagttgcacagccagcggattcaccttttctatgttcggcgtgcattgggtgagacaggcacccggcaaagggcttgaatgggtcgccgctgtttcctacgacggatcaaacaagtattacgcagagagcgtgaagggtaggtttactatcagtcgggataattctaaaaacattctgttcttgcaaatggactccctccgcctggaggatacagccgtatactattgtgctcgaggcagacctaaggtggtcatcccagcgcccctggcccactgggggcagggaaccctcgtgacgtttagctcggcatctactaaaggcccttccgttttcccattagccccgtcaagtaagagcacctccggtgggacagctgccctgggctgccttgtgaaagactactttcccgaacctgtcactgtgtcttggaatagcggagcattgacctcaggcgtacatacattcccagctgttctgcagagttccgggctatatagcctctcttcagtggtcaccgtgcccagtagctccctgggaacgcagacttacatttgtaacgtcaatcacaagccttctaacacaaaggtggataaaaaggttgagccaaaatcgtgcgacaagacccatacttgtcccccgtgccctgcccccgaagcggccggtggcccaagcgtgttcctttttcctcccaaaccaaaggatacactgatgatctccaggacccccgaggtaacgtgtgtcgtggttgacgtgtcacacgaggaccctgaagtcaaattcaattggtatgtggatggggtagaggtgcacaacgcaaagaccaagccacgggaggaacaatacaatagtacatatcgtgttgtctctgtgttgactgtgctccatcaggactggctgaacggaaaagaatacaagtgcaaagtcagcaataaggctttaccggcccccatagagaaaaccatctccaaggctaagggccagcctcgcgagccacaagtttacacactgcccccttcaagagaagagatgactaaaaaccaggtgagcctcacctgtcttgtgaagggtttttatccatctgatattgccgtagaatgggagtccaatgggcagcccgaaaacaactacaaaacaaccccgcctgtcctggacagtgatggcagcttctttttgtattctaagctaactgtggacaaatccaggtggcagcaaggaaatgttttctcatgcagtgtgatgcacgaggcactgcataaccactacacgcaaaagagcctctcgctgtccccaggcaag

SEQ ID NO: 23957 - RNA, 981 nt, synthetic construct
  misc_feature 1..981: note = derived and/or modified sequence opt3 from Lutikizumab_LightChain
  source 1..981: mol_type = other RNA
gacatccagatgacccaaagcccctcctctctgtcagccagtgtgggcgatagagtcacaattacttgcagggctagcgggaacatacacaattacctcacgtggtatcagcagacccctggaaaggcaccaaaacttctgatctacaacgccaagacattggcggacggtgttccgtcccggttctctggctcggggtcaggaactgattatacctttacaattagcagtttacagcccgaggacatcgctacctactattgtcaacatttctggtccattccttacacttttggccagggtacaaaactgcagatcacccgcacggtggccgcaccagatatacagatgactcaatctcccagctccgtatcagccagtgtgggggaccgagtcaccatcacatgccgtgctagccagggaatttcttcctggctagcatggtatcagcagaagcctggcaaagccccaaagctcctgatctacgaggcttcaaatcttgaaactggcgtgcccagcagattcagtgggtctggatccggtagcgattttaccctgacaatttcgtctttgcaacctgaagacttcgccacctactattgtcagcagacgtcctcatttctcctgagtttcggcgggggaactaaggttgagcacaaaaggacagtggcggcaccaagcgtctttatcttcccgccctccgatgaacaactgaagtctggcaccgccagcgtggtatgcctcttaaacaatttttaccctcgggaggctaaagttcagtggaaggtggacaacgccctgcagtcaggtaatagtcaggagtccgtcactgaacaagatagcaaagactctacatattcacttagtagcaccttgacgctgtccaaggcagattacgagaagcataaagtgtatgcttgtgaagtgacccaccaggggctatcttcgccagtcacaaagagcttcaaccgcggagagtgc

SEQ ID NO: 23958 - RNA, 1341 nt, synthetic construct
  misc_feature 1..1341: note = derived and/or modified sequence opt3 from Oleclumab_HeavyChain
  source 1..1341: mol_type = other RNA
gaggtgcagctgctcgaaagcggcgggggacttgtccaacccggtggctccctgagattgtcttgcgccgcttcagggttcacctttagtagctacgcatattcctgggttaggcaggcccctggaaagggcttagagtgggtgtctgcgatctcgggttcagggggacggacatactatgctgacagcgtaaaaggccgcttcactattagtcgagataactccaagaatacgctgtacctacagatgaactctctccgtgccgaagacaccgcagtgtattactgtgccagactgggctatgggagggtcgatgagtggggacggggtacacttgtgactgttagctccgcttcaaccaaaggcccaagtgtgtttccgctggcacccagctctaagtccacatcagggggaaccgccgctttgggctgcctcgtcaaagactacttccctgaaccagtgactgtaagctggaatagtggtgccctgacatctggggttcacacctttcccgcggtgctgcagtccagcggactctactcgttatcttccgtcgtgacggtgccttcaagtagcctgggcactcaaacctatatatgtaacgtcaatcataagccatccaacacaaaggttgataaacgcgtggagcccaagtcttgcgacaaaactcacacctgtcctccatgcccggcacccgagttcgaaggcgggcctagcgtatttcttttcccacccaagcctaaagatacattgatgatctcaagaaccccagaggtgacgtgtgtcgtggttgacgtgagtcatgaagatcccgaggtcaagtttaattggtacgtggacggagtagaggttcacaacgccaagactaaaccgagggaggaacagtataattccacataccgggtggtcagcgtgctgaccgtcctacatcaggattggctcaacggtaaggaatataaatgcaaggtgtctaataaagctctgcctgcctcaattgagaagactatcagtaaagcaaagggccagccccgcgaaccacaagtttacacacttcctcccagccgagaggagatgaccaagaaccaggtgtccctgacgtgtttggtaaaagggttctatccatctgacattgctgtcgaatgggagtcgaatggacagcccgaaaacaattacaagaccacacctccagtgctcgatagcgacggctcctttttcctgtactcaaaattaactgttgacaagagtagatggcagcaaggtaacgtgttttcttgcagcgtcatgcacgaggccctgcacaaccattatacccagaaatccctctcacttagcccggggaag

SEQ ID NO: 23959 - RNA, 648 nt, synthetic construct
  misc_feature 1..648: note = derived and/or modified sequence opt3 from Oleclumab_LightChain
  source 1..648: mol_type = other RNA
cagagcgtgctgacccaacccccttccgcctctggcacaccagggcagagagtcactatctcatgcagtggaagcctctccaacattggtaggaatccggttaactggtaccagcagcttcccggcacggctcctaagctgttgatatatttagacaatctgcggctatctggggtgccagatcgcttctcgggatcaaaaagcggcaccagtgcatccctcgccatctctggtctgcaaagcgaggacgaagcggattactattgtgctacatgggacgattcccaccccgggtggacttttggaggcggcaccaaacttacagtactggggcagcctaaggccgcaccatcagtgaccttgtttccccctagtagcgaggaactccaggccaacaaggctactctggtctgcctgatttctgacttctacccaggagcagtgacagttgcctggaaagctgattcctcaccggtgaaggccggtgtcgagaccacgactcccagcaagcagagtaataacaaatatgcggcatcttcctacctcagcttaacccctgaacaatggaagtcgcatcgatcttattcctgtcaggtgacacacgagggctcaactgtagagaaaaccgttgccccaacagaatgcagt

SEQ ID NO: 23960 - RNA, 1449 nt, synthetic construct; identical to SEQ ID NO: 23575
  misc_feature 1..1449: note = derived and/or modified sequence opt3 from Otlertuzumab_HeavyChain
  source 1..1449: mol_type = other RNA

SEQ ID NO: 23961 - RNA, 339 nt, synthetic construct
  misc_feature 1..339: note = derived and/or modified sequence opt3 from Ozoralizumab_HeavyChain
  source 1..339: mol_type = other RNA
gaggtgcagctggtcgaaagcggcgggggactcgttcaacccggtggctcccttagactgtcttgcgccgcttcagggttcacctttagtgactactggatgtattgggtgaggcaggcacctggaaagggcttggagtgggtaagcgaaatcaacacaaatggtttaattactaaatacccagattccgtgaaggggcggttcacgatatctcgcgacaacgccaaaaataccctgtatctacagatgaactcgctccgaccggaggatacagcggtctactattgtgctcgttcacccagcggatttaatagaggccagggcactctggtgaccgtt

SEQ ID NO: 23962 - RNA, 1089 nt, synthetic construct; identical to SEQ ID NO: 23580
  misc_feature 1..1089: note = derived and/or modified sequence opt3 from Ozoralizumab_HeavyChain_HeavyChain_HeavyChain
  source 1..1089: mol_type = other RNA

SEQ ID NO: 23963 - RNA, 1494 nt, synthetic construct
  misc_feature 1..1494: note = derived and/or modified sequence opt3 from Pasotuxizumab_HeavyChain_LightChain_HeavyChain_LightChain
  source 1..1494: mol_type = other RNA
caggtgcaactggtcgagagcggcgggggactcgttaagcccggtgaatcccttagactgtcttgcgccgcttcaggcttcacctttagtgactactatatgtactgggtgaggcaggcacctgggaaaggattggagtgggtagccatcattagcgatggcggttattacacatattactccgacataatcaaggggcggttcactatttctcgcgataacgcgaaaaattcgttatatctgcagatgaactcactaaaggctgaagacacggccgtgtactactgtgcacgaggatttccactcctgcgtcacggcgccatggattattggggccaggggacccttgtcacagtgagcagtggaggtggcgggtccggaggcggtgggtctggaggcggcgggagcgacatccaaatgactcagtccccgtcaagtctgagcgcttctgttggagatagagtgaccattacatgcaaagcatcccagaatgtcgacaccaacgtggcctggtaccagcaaaagcccggtcaggctcctaagtcattgatctatagcgccagttacaggtattctgatgtaccatcccggttcagcggctcggcgtctgggactgactttacactcaccatatcctcagttcagagtgaggatttcgcaacgtactattgtcagcaatacgacagctacccctatacttttggaggcggtaccaaactggaaatcaagtccgggggcggaggctctgaggtgcagctggtcgagagcgggggaggtctcgtgcagcctggcgggtcattaaaactgagttgcgccgcttccggattcacatttaataagtacgccatgaactgggtgcgccaagcaccaggcaaaggtcttgaatgggtcgctagaattaggagcaagtataataactacgccacttattacgcggattctgttaaggaccggttcaccatctcacgcgacgatagtaaaaatacagcctatttgcagatgaacaatctgaagaccgaggacacggcagtgtactactgtgtacgacatgggaactttggcaatagctatatttcctactgggcttattggggacagggcactctagtgacagtctcttcgggagggggtggcagcgggggaggcggttccgggggcggaggctcacagaccgtggttactcaagaacccagtctcacagtgtctcctgggggaaccgtcacgctgacctgcggcagctccacaggtgccgtgacttcagggaactacccaaattgggtacagcagaaaccgggacaggctcccagaggccttatcggtggcaccaagttcctggcccctgggacaccagcaaggtttagcggatctttgctcggcgggaaagccgctctgactttatccggagttcaacccgaggatgaggcggaatattactgtgtgctgtggtatagtaaccggtgggtcttcggcggtgggaccaagctcacagtgctt

SEQ ID NO: 23964 - RNA, 357 nt, synthetic construct
  misc_feature 1..357: note = derived and/or modified sequence opt3 from Pasotuxizumab_HeavyChain1
  source 1..357: mol_type = other RNA
caggtgcaactggtcgagagcggcgggggactcgttaagcccggtgaatcccttagactgtcttgcgccgcttcaggcttcacctttagtgactactatatgtactgggtgaggcaggcacctgggaaaggattggagtgggtagccatcattagcgatggcggttattacacatattactccgacataatcaaggggcggttcactatttctcgcgataacgcgaaaaattcgttatatctgcagatgaactcactaaaggctgaagacacggccgtgtactactgtgcacgaggatttccactcctgcgtcacggcgccatggattattggggccaggggacccttgtcacagtg

SEQ ID NO: 23965 - RNA, 369 nt, synthetic construct
  misc_feature 1..369: note = derived and/or modified sequence opt3 from Pasotuxizumab_HeavyChain2
  source 1..369: mol_type = other RNA
gaggtgcagctggtcgaaagcggcgggggactcgttcaacccggtggctcccttaagctgtcttgcgccgcttcagggttcacctttaacaaatacgcaatgaattgggtgagacaggcccctggaaagggcttggagtgggtagcgaggatccggagtaaatataacaattacgctacatattacgccgacagcgtgaaggatcgcttcactatttcccgagacgattctaaaaacacggcatatttacagatgaataacctgaagaccgaagacacagccgtctactattgtgtgcgtcacggtaattttgggaactcgtacatatcatactgggcttattggggacagggcactctagttaccgtg

SEQ ID NO: 23966 - RNA, 321 nt, synthetic construct
  misc_feature 1..321: note = derived and/or modified sequence opt3 from Pasotuxizumab_LightChain1
  source 1..321: mol_type = other RNA
gacatccagatgacccaaagcccctcctctctgtcagccagtgtgggcgatagagtcacaattacttgcaaggctagccagaacgttgacacgaatgtggcatggtaccagcagaaacctgggcaagccccaaagtccctcatatattctgcgtcgtacaggtattcagatgtaccgagccggttcagtggatccgcttctggtaccgactttacacttactatcagctccgtgcagtcagaggatttcgccacctactattgtcagcagtacgacagttatccctacacatttggcgggggaaccaaactggaaattaag

SEQ ID NO: 23967 - RNA, 327 nt, synthetic construct
  misc_feature 1..327: note = derived and/or modified sequence opt3 from Pasotuxizumab_LightChain2
  source 1..327: mol_type = other RNA
cagaccgtggtcacacaagagcccagcctgactgtttcccctggcgggacggtgaccctcacatgcggatcttcaactggtgccgtaaccagtggcaactacccaaattgggtgcagcagaagccggggcaggctcccagaggacttatcggcggtacaaaattcctggcacctgggaccccagccaggtttagcggatccttgttaggcggcaaggcggctctgactctatctggggtccaacccgaagacgaggccgaatattactgtgtgctctggtattcgaaccggtgggttttcggaggtggcacaaaactgaccgtgctt

SEQ ID NO: 23968 - RNA, 1023 nt, synthetic construct; identical to SEQ ID NO: 23624
  misc_feature 1..1023: note = derived and/or modified sequence opt3 from Placulumab_HeavyChain
  source 1..1023: mol_type = other RNA

SEQ ID NO: 23969 - RNA, 1353 nt, synthetic construct
  misc_feature 1..1353: note = derived and/or modified sequence opt3 from Porgaviximab_HeavyChain
  source 1..1353: mol_type = other RNA
gaggtgcagctgcaagaaagcggcgggggactcatgcagcccggtggctccatgaagctctcttgcgtcgcctcagggttcacctttagtaactactggatgaattgggttagacagagccctgagaaaggactggaatgggtggctgagatcaggttgaagtccaacaattatgcaacacactacgccgaatctgtaaaaggccggttcactatttcgcgcgacgattcaaagcgaagcgtgtatttacagatgaacacgctgcgtgcggaggacaccggtatatactattgtacaagagggaatggaaactacagggctatggattattggggccaaggcacttcagtcaccgtgtcctctgccagcacaaaagggccatccgtttttccgctagcaccctcaagtaagagcacctctggaggtactgccgctctcggctgcctggtgaaggactacttccctgagccagtcacagtgtcctggaatagtggggcacttaccagcggagtacatacgtttcccgccgttctgcagagttctggcttgtactccctcagctcggtggtcactgtgccttcttcctcactgggtacccagacatatatctgtaacgtgaatcacaaaccaagtaacactaaggtcgataaacgggttgaacccaagagctgcgacaaaacccatacatgtcctccatgcccggctcccgagctgctcgggggaccttccgtgttcttatttccacccaagcctaaggataccctgatgatttctcgcacgccagaagtaacttgtgtggtcgtggacgttagccacgaggatcccgaggtgaaattcaattggtacgtcgacggcgtggaagtacataacgccaagacaaaaccgagagaggaacagtataattcaacctacagggttgtgagtgtccttactgtgttgcaccaagattggctgaacggcaaggagtataaatgcaaggtctccaataaagcgctacctgcacccatcgaaaagacaattagcaaggccaaagggcagccacgggagcctcaggtgtacacccttcccccatctcgcgacgagctgacgaagaaccaggtttcacttacctgtctggtgaaaggattttatcccagtgatatcgctgtagaatgggagagcaacggtcaacctgaaaataactacaagacaactccaccggtcttggactccgacggctctttctttctctactcgaaactgaccgtggataagagccgatggcagcaggggaatgttttctcctgctcagtgatgcacgaggccttacataaccactatacacaaaagagtctgtctctcagccccggaaaa

SEQ ID NO: 23970 - RNA, 642 nt, synthetic construct
  misc_feature 1..642: note = derived and/or modified sequence opt3 from Porgaviximab_LightChain
  source 1..642: mol_type = other RNA
gacatccagatgacccaaagccccgcctccctgtctgtgtcagtcggcgagacagttagtattacttgcagagctagcgaaaacatatactcctctctcgcatggtatcagcagaaacaggggaaatcgcctcaacttctggtgtactcagccacgatcttggcggatggagtaccaagcaggttcagtggttccggctctgggacccagtatagcttaaagattaattccctgcagtcagaggactttggaacatactattgtcagcacttctggggcactccgtacacctttggtgggggaacaaaactagaaatcaagcggaccgtggctgcccccagtgtcttcatttttcctccaagcgatgagcaactcaaatctggcactgcatccgtggtttgcctgcttaacaatttctatccccgcgaagccaaggtgcagtggaaggtcgacaacgctctgcagtcaggcaatagccaggagagtgtgacagagcaagattctaaagactccacctacagcttgtcgtctacgctcactctgtccaaggcagattacgaaaaacataaggtatatgcctgtgaggttacccaccaggggctgtcaagtcctgtgacaaagagctttaaccgaggagaatgc

SEQ ID NO: 23971 - RNA, 1341 nt, synthetic construct
  misc_feature 1..1341: note = derived and/or modified sequence opt3 from Prezalumab_HeavyChain
  source 1..1341: mol_type = other RNA
gaggtgcagctggtcgaaagcggcgggggactcgttcagcccggtggctcccttagactgtcttgcgccgcttcagggttcacctttagtagctactggatgtcctgggtgaggcaggcacctggaaagggcttggagtgggtagcctatatcaaacaggacggtaacgaaaagtactatgtggattctgtcaaagggcggttcacaatttcgcgcgacaatgcgaagaactcattatacctgcagatgaatagcctacgagctgaggatactgccgtgtattactgtgcacgtgaaggaatactctggtttggcgacctgccaacgttctggggccaagggacccttgttacagtgagttccgcctctactaaaggaccgagcgtctttcccctggctccttgctccagatcaaccagtgagagcacagcagccttgggttgtctcgtgaaggattatttcccagagcccgtaaccgtttcttggaactccggcgctctgacttcaggggtgcacacatttcctgccgtcctgcagagcagtggactctactctttatccagcgtggtgaccgtcccatcgtctaatttcggcacgcagacttatacctgcaacgttgaccataagccctccaatacaaaagtggataagactgtagaaaggaaatgttgcgtggagtgtcctccatgcccggcgccccctgtcgcaggtccatcagtgtttctgtttccccctaagccaaaagacacccttatgatcagtcggacacccgaagttacctgtgtggtcgtggatgtaagccacgaggacccggaggttcagttcaactggtacgtggatggggtcgaagtgcataatgccaagacgaagcctcgcgaggaacaattcaactccacttttagagtcgtgtctgttttgacagtggtacaccaggactggctgaatggaaaagagtacaagtgcaaagtcagcaacaagggcctacccgctccaattgagaaaaccatctcaaagactaaaggccagcctagggaaccccaggtgtatacactcccacccagtcgggaggaaatgaccaagaatcaagtttccctgacgtgtcttgtgaaggggttctaccctagcgatattgccgtcgagtgggaatctaacggacagccagagaataactataaaaccacaccgcccatgctggactcagacggtagtttctttttgtacagcaagctcactgtggataaatcccgctggcagcaaggcaacgtattctcttgctcggtgatgcatgaagcactgcacaatcactatacccaaaagagcttatccctgtcacctgggaaa

SEQ ID NO: 23972 - RNA, 642 nt, synthetic construct
  misc_feature 1..642: note = derived and/or modified sequence opt3 from Prezalumab_LightChain
  source 1..642: mol_type = other RNA
gacatccagatgacccaaagcccctcctctctgtcagccagtgtgggcgatagagtcacaattacttgcagggctagccaggggatatccaactggctcgcatggtaccagcagaagcctgagaaagccccaaagtctcttatctatgcggcttcgtcactgcaaagcggagttccgagtcggttctccggttctggcagcgggacggactttaccttgacaatttcctcattacagcccgaagatttcgccacttactattgtcagcagtacgacagttatcctcgcacctttggacaaggcacaaaagtggagatcaagcgaaccgtagcagccccaagcgtgttcatttttcccccttctgatgaacagctgaaatccggtactgcttcagtcgtgtgcctactcaataacttctacccacgtgaggcaaaggttcagtggaaggtggacaatgccctgcagagcgggaacagtcaagaatctgtcacagagcaggattccaaagacagcacctattcgctttcttccacgctgactttgtcaaaggctgattacgagaaacacaaggtgtacgcctgtgaagtaacccatcagggactcagtagccccgttacaaaatcctttaatagaggcgagtgc

SEQ ID NO: 23973 - RNA, 342 nt, synthetic construct
  misc_feature 1..342: note = derived and/or modified sequence opt3 from Radretumab_HeavyChain
  source 1..342: mol_type = other RNA
gaggtgcagctgctcgaaagcggcgggggacttgtccaacccggtggctccctgagattgtcttgcgccgcttcagggttcacctttagtagcttctccatgtcttgggttaggcaggcacctggaaagggcttagagtgggtgtcgtcaatcagcggtagttccgggacaacttactatgccgactctgtaaaaggacggtttacgattagccgcgataactccaagaataccctgtacctacagatgaactcactccgagcggaagacacagctgtgtattactgtgccaaaccattcccgtattttgattactggggccagggcactctggtcaccgtg

SEQ ID NO: 23974 - RNA, 1071 nt, synthetic construct; identical to SEQ ID NO: 23643
  misc_feature 1..1071: note = derived and/or modified sequence opt3 from Radretumab_HeavyChain_LightChain
  source 1..1071: mol_type = other RNA

SEQ ID NO: 23975 - RNA, 693 nt, synthetic construct
  misc_feature 1..693: note = derived and/or modified sequence opt3 from Radretumab_LightChain
  source 1..693: mol_type = other RNA
gccagcgagatcgtgctgacccagtcccccggcacactctctctttcacctggggaaagagctactctgagttgcagggcaagccaatccgtctcttcgtcattcttggcctggtaccagcagaagccaggacaggcgccgcggttactgatttattacgctagcagtcgcgccacgggtatacccgaccgattttccggctctgggagcggaaccgatttcacactaactatctcccgtctcgagcctgaagactttgcagtttattactgtcaacagaccggccggattccacccacattcggtcaggggaccaaagtggagatcaagtcaggaggcagtggcgggcctagggccgctccagaagtatatgcatttgccactcccgagtggcctggaagccgggataaacgcacactggcttgccttattcagaacttcatgccagaggacatctctgtgcaatggctgcacaatgaagtccagttgccggatgccagacattccaccacgcagcccaggaagactaaaggttcaggctttttcgtgtttagccggctcgaggttacccgcgcggaatgggagcagaaggacgagttcatatgtcgagcagtgcacgaagccgctagtccttctcaaacagtccagagagccgtgtccgtaaacccagagagctcgaggagagggggatgc

SEQ ID NO: 23976 - RNA, 1359 nt, synthetic construct
  misc_feature 1..1359: note = derived and/or modified sequence opt3 from Ranevetmab_HeavyChain1
  source 1..1359: mol_type = other RNA
gaggtgcagctggtcgaaagcggcgggggactcgttcaacccggtggctcccttagactgtcttgcgtggcctcagggttcagtttgaccaacaataacgtaaattgggtgaggcaggctcctggaaagggcttagagtgggtcggtggggtgtgggcaggaggcgccacagactacaacagcgcgctgaaatcccggtttactatctctcgcgataatgctaagaacacggttttcctacagatgcactcgctccgatcagaagacaccgccgtgtattactgtgcacgtgatggcgggtatagcagttccacactgtacgccatggacgcttggggacagggtacttctgtcaccgtgagctccgcatcaacaaccgccccaagtgtatttccgcttgctcccagctgcggctctacttccgggtcaacagttgccctggcgtgtttggtgagcggatatttccctgagccagtcaccgtgagttggaactctggctccctcacgagcggtgtgcatacttttccctcggtcctgcaatcttccgggctgcactcactcagtagcatggttaccgtgccttcctctagatggccaagcgaaacattcacttgcaatgtagtgcatcccgcatcaaataccaaagtcgataagcctgtgtttaacgagtgtaggtgcacagacaccccaccgtgtcccgttcctgagccattaggaggccccagtgtgctgattttccctccaaaacccaaggatatacttcggatcacgcgcactccggaagtcacatgcgtggtattggacctgggcagagaggatcctgaagttcagatttcctggtttgtggacgggaaggaggtcatcaccgccaaaactcagagcagggagcagcaattcaatggaacataccaggtggtctctgtgctacccattgaacaccaggattggctcaccggtaaggagtttaaatgtcgggttaaccatatcgacctgccatcacctatagaacgcacgatcagtaaggctcgaggcagagcccacaaacccagcgtgtatgtacttccaccctcccctaaggagctgtcttcgagcgataccgtctccattacatgcttgatcaaggacttctacccaccggacattgatgtggaatggcagtcagttgggcaacaggagcccgagaggaaacaccggatgactcctccacagctcgacgaagatggaagttactttctgtattctaagttaagcgtggacaaatcccgttggcaacagggcgatcccttcacctgtgcagtcatgcatgagacactgcagaatcactacactgacctctcacttagccattctcctggtaag

SEQ ID NO: 23977 - RNA, 1359 nt, synthetic construct
  misc_feature 1..1359: note = derived and/or modified sequence opt3 from Ranevetmab_HeavyChain2
  source 1..1359: mol_type = other RNA
gaggtgcagctggtcgaaagcggcgggggactcgttcaacccggtggctcccttagactgtcttgcgtggcctcagggttcagtttgaccaacaataacgtaaattgggtgaggcaggctcctggaaagggcttagagtgggtcggtggggtgtgggcaggaggcgccacagactacaacagcgcgctgaaatcccggtttactatctctcgcgataatgctaagaacacggttttcctacagatgcactcgctccgatcagaagacaccgccgtgtattactgtgcacgtgatggcgggtatagcagttccacactgtacgccatggacgcttggggacagggtacttctgtcaccgtgagctccgcatcaacaaccgccccaagtgtatttccgcttgctcccagctgcggctctacttccgggtcaacagttgccctggcgtgtttggtgagcggatatttccctgagccagtcaccgtgagttggaactctggctccctcacgagcggtgtgcatacttttccctcggtcctgcaatcttccgggctgcactcactcagtagcatggttaccgtgccttcctctagatggccaagcgaaacattcacttgcaatgtagtgcatcccgcatcaaataccaaagtcgataagcctgtgtttaacgagtgtaggtgcacagacaccccaccgtgtcccgttcctgagccattaggaggccccagtgtgctgattttccctccaaaacccaaggatatacttcggatcacgcgcactccggaagtcacatgcgtggtattggacctgggcagagaggatcctgaagttcagatttcctggtttgtggacgggaaggaggtcctaaccgccaaaactcagagcagggagcagcaattcaatggaacataccaggtggtctctgtgctccccatcgaacaccaggattggctgaccggtaaggagtttaaatgtcgggttaaccatattgaccttccatcacctatcgaacgcacgataagtaaggctcgaggcagagcccacaaacccagcgtgtatgtactgccaccctcccctaaggagttgtcttcgagcgataccgtctccatcacatgcctcattaaggacttctacccaccggacatcgatgtggaatggcagtcagttgggcaacaggagcccgagaggaaacaccggatgactcctccacagctggacgaagatggaagttactttttatattctaagctgagcgtggacaaatcccgttggcaacagggcgatcccttcacctgtgcagtcatgcatgagacactccagaatcactacactgacctttcactgagccattctcctggtaag

SEQ ID NO: 23978 - RNA, 651 nt, synthetic construct
  misc_feature 1..651: note = derived and/or modified sequence opt3 from Ranevetmab_LightChain
  source 1..651: mol_type = other RNA
gacatcgtgatgacccagagccccgcctccctgtctctctcacaaggcgagacagtcactattacgtgcagagctagtgaagatatatacaacgcacttgcctggtatcagcagaagcctgggcaggcgccaaaactgttgatctacaataccgacacattacacactggagttccgagcaggttctccggttctggctcggggaccgatttttcactgacaattagcagtctagagcccgaagacgtggctgtatattactgtcaacattatttccactaccctcggacctttggacagggcactaaggtggagctcaaacgcaacgatgcccagccagcagtctatctgttccagccctcccctgaccaacttcatacaggttctgccagcgtggtttgcctgctcaattccttttacccaaaggatatcaacgtgaaatggaaggtcgacggggtgattcaggataccggaatccaggaatcagtaacggagcaggacaaggatagtacttacagcttgtcttccaccctgacaatgtcaagcactgagtatctgagtcacgaactctactcttgtgagataacccataaatccttacccagcacactgatcaagtcgttccaacgatctgaatgccagcgtgttgac

SEQ ID NO: 23979 - RNA, 1761 nt, synthetic construct
  misc_feature 1..1761: note = derived and/or modified sequence opt3 from Remtolumab_HeavyChain
  source 1..1761: mol_type = other RNA
gaggtgcagctggtcgaaagcggcgggggactcgttcaacccggtagatcccttaggctgtcttgcgccgcttcaggcttcacctttgacgattacgcaatgcactgggtgcggcaggcccctgggaagggattggagtgggtaagtgcgatcacatggaacagcggccatattgactatgctgattccgtggaaggtcgcttcactatatctcgagacaatgccaaaaactcgttatacctgcagatgaactcactacgtgcagaggatacggccgtctattactgtgctaaggtgagctatctcagtaccgcatcctctctggactactgggggcagggaacacttgttactgtgagctccggcggcgggggatcaggtggcgggggaagtgaagtccaactggtgcagagcggcgccgaggttaaaaagccaggttcttccgtaaaagtgtcatgcaaggctagcgggggaagttttggcggctatgggatcggatgggtcagacaggccccgggtcagggcttggagtggatgggagggattacccccttctttggcttcgcggattacgcacaaaagtttcagggtagggtgacaatcaccgccgacgaatctactacaaccgcttacatggagctctccgggctgacgagcgatgacactgccgtgtattactgtgcacgggatcctaatgagttctggaatggctattactcgacccacgactttgattcttggggacagggcacaactgtcaccgtttcctcagctagtacaaaagggccaagcgtgttccccctggccccttcctctaagagcacctcaggaggtacggcggccctcggctgcttagtaaaagactattttccagaacccgtgactgtcagttggaactccggggcactgacaagcggagtgcataccttccctgctgttcttcagtcttcaggcttgtacagtctgagctccgtggtcactgtgccatcttcgagcctaggtacacaaacctatatttgtaatgtaaaccacaagccgtccaatacgaaagttgacaagaaggtggagcccaaatcatgcgataagacccatacatgtcctccatgccccgcccctgaactccttgggggcccaagtgtctttctgtttcccccgaaacctaaggacactctgatgatctctcgcacccccgaggtgacatgtgtcgtggttgatgtgagccacgaagacccagaggtaaaattcaactggtacgtcgatggagtggaagttcacaatgctaagactaaacctagagaggagcagtacaactccacctatagggtggtctcagtgttgacagtactccatcaggactggctgaatggcaaggaatacaagtgcaaagtgagcaacaaggccttacccgcaccaatagagaaaaccatctctaaggccaaagggcaaccccgggaacctcaggtttatactctgccaccgtcccgcgatgagctcacgaagaatcaggtcagtcttacatgtctggtgaagggattctaccccagcgacattgctgtggaatgggagtctaacggtcagcctgagaacaattataaaaccactccacccgtcttggattccgacggctcattctttctatacagtaagctgaccgttgataaaagccgatggcaacaggggaacgtgttctcgtgctccgtgatgcacgaagcgctccataatcactatacacagaagtctctgagcctttcacctggaaaa

SEQ ID NO: 23980 - RNA, 993 nt, synthetic construct
  misc_feature 1..993: note = derived and/or modified sequence opt3 from Remtolumab_LightChain
  source 1..993: mol_type = other RNA
gacatccagatgacccaaagcccctcctctctgtcagccagtgtgggcgatagagtcacaattacttgcagggctagccaggggatacggaactacctcgcatggtatcagcagaagcctggaaaagccccaaaacttctgatctacgcggcttccacgttgcaatctggtgttccgtcgcgcttctcaggcagcgggagtggaaccgactttacattaactatttcctctctgcagcccgaggatgtggccacctattactgtcagcgatataatcgtgcaccttacacattcggccagggtaccaaagtagaaatcaagagagggggaagcggcggcgggggatccggtgagattgtgctaactcaatcaccagactttcagagtgtcacacccaaagaaaaggtgaccatcacgtgcagggccagccaggatataggctctgagctccactggtatcagcaaaagcctgaccagccacccaaactgcttatcaagtacgcttcccattcaactagcggggttcctagtcggttctctggatccggcagcggtaccgattttacactgactattaacgggttggaagcagaggacgccggaacctactattgtcaccagacagattcgctcccatacaccttcggcccgggcacgaaagtggacatcaagcgcactgtcgctgccccctctgtgtttattttccctccatccgatgagcaactgaaatcagggacagcgagtgtagtttgcctgctcaataacttttatcccagagaagcaaaggtgcagtggaaggtcgacaatgccttacagagcggaaactcccaggagtctgtgaccgaacaagatagcaaagactcaacttacagtctgtccagcacacttaccttgtctaaggctgactatgagaaacataaggtgtacgcctgtgaggtcacgcaccagggtctgtcaagtcctgttaccaagagcttcaataggggcgaatgc

SEQ ID NO: 23981 - RNA, 1341 nt, synthetic construct
  misc_feature 1..1341: note = derived and/or modified sequence opt3 from Rosmantuzumab_HeavyChain
  source 1..1341: mol_type = other RNA
caggtgcaactggtccagagcggcgccgaggttaagaaacccggggcttccgtgaaggtatcttgcaaagcatcaggatacaccttcacagactatagtatccactgggtgagacaggcccctggtcagggcctcgaatggattgggtacatatatccaagcaacggagattccggctacaatcaaaagtttaaaaacagggtcactatgacgcgggacacctctacatcgactgcgtatatggagctttcacgcctgcgaagcgaagataccgctgtgtactattgtgccacatacttcgcaaataactttgactactggggtcaggggaccactttgacagttagttccgcctctaccaagggaccgagcgtgttccccttagctccttcctcaaagagtacgagcggcggcactgcagccctggggtgcctagtcaaagattattttccagagcccgtgaccgtatcttggaactccggagctctcacatcaggtgttcatactttccctgccgtgctgcagagcagtggcctttactctctgtccagcgtcgtgaccgtgccatcgtcttccttggggacacagacctatatctgtaatgtcaatcacaagccctcaaacacgaaagttgacaagcgtgtggaacctaaaagttgcgataagactcatacatgtccaccgtgccccgcgcctgagctcctgggaggcccaagcgtatttctgtttccccctaagccaaaagacaccctcatgatttccagaactcccgaggtgacatgtgtcgtggttgatgtgtctcacgaagacccggaggtcaagttcaattggtacgtggatggtgtagaagttcataacgcaaaaaccaagcctagggaggagcaatataatagcacgtaccgggtggtctcagtgttaaccgtcctgcaccaggactggcttaacgggaaagaatataagtgcaaagtgagtaataaggccttgcccgctccaatcgagaagacaatttccaaagccaagggacagcctcgcgaaccccaggtttacactctgccacccagcagagaggaaatgaccaaaaaccaagtgtctctaacatgtctcgtaaagggcttctacccttcagatatcgcagtcgagtgggagagtaatggccagccagaaaacaactataaaactaccccgcccgtgctggacagcgacgggtcctttttcctttactctaagctgacagttgataagtcgaggtggcagcaaggaaatgtgtttagctgctccgtcatgcacgaggctttgcataaccactatacccagaaatcactcagtctgtctcctggtaag

SEQ ID NO: 23982 - RNA, 654 nt, synthetic construct
  misc_feature 1..654: note = derived and/or modified sequence opt3 from Rosmantuzumab_LightChain
  source 1..654: mol_type = other RNA
gacatccagatgacccaaagcccctcctctctgtcagccagtgtgggcgatagagtcacaattacttgcaaggctagccagtccgttgactacgatggggactcttatatgaactggtaccagcagaaacctggaaaggcaccaaaactccttatatatgccgcgtcgaatctggagtcaggtgtgccgagcaggttcagtggctccgggtctggaacggattttaccttgacaatcagccccgtacaagctgaagacttcgccacttactattgtcagcagtccaacgaggatcctttaacctttggcgcaggtacaaagctggaactaaaacggaccgtggccgctccatcagtcttcatttttccccctagtgacgagcagctcaagagcgggactgcatctgtggtttgcctgcttaataacttctacccacgcgaagccaaggtgcaatggaaagtcgataatgctctgcagtccggaaactcacaggagagcgtgacagagcaggacagtaaggattctacctattccttgagctcgacgctcactctgtctaaagccgactacgaaaagcacaaagtatacgcgtgtgaggttacccatcaaggcctgtcctcacccgtgacaaagagttttaatcgaggcgaatgc

SEQ ID NO: 23983 - RNA, 1332 nt, synthetic construct
  misc_feature 1..1332: note = derived and/or modified sequence opt3 from Rozanolixizumab_HeavyChain
  source 1..1332: mol_type = other RNA
gaggtgcccctggtcgaaagcggcgggggactcgttcagcctggtggctcccttagactgtcttgcgccgtgtcagggttcacctttagtaactacggaatggtatgggtgaggcaagctccaggcaagggtttggagtgggtcgcatatatcgacagcgatggggacaatacatactatcgggattccgtgaaaggacgcttcactatttctcgagacaacgccaagtcgtcattatacctgcagatgaatagcctacgtgcggaagatacggctgtttattactgtaccacaggcatagtgagaccgtttctctattggggccaggggactctggtcaccgtgagttccgcctctacaaaaggacccagcgtattccctcttgcaccatgctccaggtcaaccagtgagagcactgccgctctgggttgtttggttaaggactactttcccgaacctgtgacagtctcttggaactccggcgcactcacctcaggggtgcacacgttcccagccgtgctgcagagcagtggactgtactctctctccagcgtcgttactgtgccctcgtcttccttaggcaccaaaacatatacttgcaatgtagatcataagccttcaaacaccaaggtggacaaacgggtcgagagtaagtacggtccaccgtgtcccccttgcccagctcccgagtttcttgggggacctagcgtgttcctgtttccacccaaaccgaaggatacattgatgatctcccgcacccctgaagttacgtgtgtggtcgtggacgtatctcaagaggatcccgaagttcagttcaattggtatgtggacggcgtcgaggtgcacaacgccaaaactaagccaagagaggaacagtttaatagcacatacagggtcgtgtcagttctgaccgtgctacatcaggattggctcaacggcaaggagtataaatgcaaggtaagtaataaagggctgccttccagcattgaaaagactatctctaaagcgaagggacaaccccgggagccacaggtctacacacttcccccttcacaggaagagatgaccaaaaaccaggtgagtctgacgtgtttggttaagggtttctatccaagcgacattgcagtggagtgggaatccaatggccaaccggagaacaattacaagaccacaccccctgtcctcgactctgatgggtcgtttttcctgtacagccgcttaactgtggacaaatcccgatggcaggaaggaaacgtattctcatgcagtgtgatgcacgaggccctgcataaccactatacccagaagtctctcagcctttccctgggcaaa

SEQ ID NO: 23984 - RNA, 657 nt, synthetic construct
  misc_feature 1..657: note = derived and/or modified sequence opt3 from Rozanolixizumab_LightChain
  source 1..657: mol_type = other RNA
gacatccagatgacccaaagcccctcctctctgtcagccagtgtgggcgatagagtcacaattacttgcaagagctcccagtctctcgttggggcttcgggaaaaacgtacctttattggctgttccagaagcctggtaaagcaccaaagaggttgatatacttagtgtcaaccctggacagcggcatcccgagtcggttttccgggtctggaagcggcacagagttcactctaaccatttcctcactccagcccgaagattttgccacatattactgtctgcaaggtacccacttccctcatacttttgggcagggaacaaaacttgagatcaagcgcaccgtagcggctccaagtgtgttcatttttccccctagcgacgaacagctgaagtctggcacggcctccgtcgtgtgcttgctcaacaatttctatccacgagaggcaaaagttcagtggaaggtggataacgccctgcaatcaggcaatagccaggaaagtgtcactgagcaggactctaaagattccacctacagcctgtcgtctacactcactttatccaaggctgactatgagaaacacaaggtgtacgcatgtgaagtaacccatcaggggctgtcaagtcccgttacaaagagctttaaccgtggagagtgc

SEQ ID NO: 23985 - RNA, 1329 nt, synthetic construct
  misc_feature 1..1329: note = derived and/or modified sequence opt3 from Sapelizumab_HeavyChain
  source 1..1329: mol_type = other RNA
caggtgcaactgcaggagagcggccccgggctcgtcaagccttccgaaaccctttctctgacatgcgccgtttcaggacacagtatcagccatgaccacgcttggtcctgggtgagacagccaccgggtgagggcttggaatggattgggttcatatcttactcgggaatcactaactataatccctcattacagggcagggtaacgattagccgggataacagtaaaaataccctgtacctacaaatgaactccctccgcgcagaggacacagccgtgtattactgtgcgcgatctctggctcgtactaccgccatggattattggggtgaagggacacttgtcaccgtgagctccgcatcaactaagggacctagtgtttttccactggcccccagctctaaatccacatcaggcggcaccgctgcattggggtgcctcgtgaaggactacttccctgagccagtcacggtgagctggaatagtggagccctgacttctggtgtacatacctttcccgctgttctgcagtccagcggcctctattcgttatcttccgtggtcacagtgccttcaagtaacttcgggactcagacctacacatgtaatgtggatcacaaaccaagcaacaccaaggtcgacaagacggttgagagaaaatcctgcgtggaatgtccgccctgccctgccccacccgtagcgggaccttctgtgtttctgttcccacccaagccgaaagatactcttatgatcagcaggacacctgaggtcacctgtgtggttgtggacgtctcacaggaagatcccgaggtgcaatttaattggtacgtagacggcgttgaggtgcataacgcaaagactaaaccacgggaggaacagttcaatagtacatttcgcgtcgtgtccgtcttgaccgtggttcaccaggattggctgaacggtaaggaatataagtgcaaagtgagcaataaggggctacctgcccccattgagaaaacgatctctaagaccaaaggacagccaagagaaccccaagtatacacactccctccatcacaggaggagatgactaagaaccaggtcagtctgacctgtcttgtgaaaggcttctatccgagcgacatagctgttgaatgggagtccaatggccaacccgaaaacaactacaagacaactcctccaatgctggattctgacgggtcgtttttcttgtatagcaagctcaccgtggacaaatccaggtggcaggagggaaatgtcttttcatgcagtgtgatgcacgaagccctgcatgcacactacacacagaagtctttaagcctgtccccc

SEQ ID NO: 23986 - RNA, 642 nt, synthetic construct
  misc_feature 1..642: note = derived and/or modified sequence opt3 from Sapelizumab_LightChain
  source 1..642: mol_type = other RNA
gacatccagatgacccaaagcccctcctctctgtcagccagtgtgggcgatagcgtcacaattacttgccaggcttccacggacatatcttcgcacctcaactggtaccagcagaaacctgggaaagcaccagagcttctgatctattacggatcacatttgttaagcggtgttccgagtagattctccggctctgggagcggaaccgattttacattcactatttcctcactggaagccgaggacgcggctacctattactgtggccaaggtaataggctaccctatacatttgggcagggaaccaaggtggaaatcgagcggactgtagccgcacctagtgtgttcatttttccacccagcgatgaacagctcaaatctggcacagcctccgtcgtgtgcctgcttaacaatttctaccctcgcgaggctaaggttcagtggaaagtggacaacgcactgcaatcaggcaatagccaggagagtgtcaccgaacaggattctaaggactccacgtatagcttgtcgtctactctcaccctgtccaaggccgattacgagaaacacaaggtgtacgcttgtgaagtaacacatcaggggctgtcaagtccagttactaagagctttaaccgaggagagtgc

SEQ ID NO: 23987 - RNA, 1356 nt, synthetic construct
  misc_feature 1..1356: note = derived and/or modified sequence opt3 from Selicrelumab_HeavyChain
  source 1..1356: mol_type = other RNA
caggtgcaactggtccagagcggcgccgaggttaagaaacccggggcttccgtgaaggtatcttgcaaagcatcaggatacaccttcacaggttattacatgcactgggtgagacaggcccctggccaggggctcgaatggatgggatggatcaacccagacagtggcggtactaattatgcgcaaaagtttcaggggagggtcacgatgacccgggatacaagcatttccactgcttacatggagcttaaccgcctgcgatctgacgataccgccgtgtattactgtgcacgtgaccagccgttgggatattgcacaaatggcgtttgttcgtacttcgattactggggccaggggaccttagtgactgtctcaagcgccagtacaaaaggaccctccgtgtttcctctggctccatgctctagaagcacctccgaatcaacggcagccctaggttgtctcgtaaaggactatttccccgagcctgttactgtgagttggaacagcggcgctctgacctctggggtccatacatttccagccgtgcttcaatcctcaggactgtacagcttgagttctgtggtcactgttccctccagcaatttcggcacccagacatatacctgcaacgtggatcacaagccttcgaatacgaaagtagacaagactgtggaaaggaaatgttgcgtcgagtgtccaccgtgccccgcgcctccagtggcaggtccctctgtttttctcttccctccaaagcccaaagatacactgatgatatcccggaccccggaggtgacttgtgtcgtggtagacgtttcacatgaagatcctgaggtgcagtttaactggtacgtcgacggggtggaagtccacaatgccaagacaaagccccgcgaggagcagttcaacagtacctttagagtggttagcgtgctgacggtagtccatcaagattggctcaatggaaaagaatataagtgcaaagtgtccaacaagggcttaccagctcctatcgagaaaaccatttctaagacaaaaggccagcccagggaaccacaggtttacactctgccccctagccgggaggaaatgaccaagaatcaagtgtcacttacatgcttggtcaaggggttctatccaagtgacatcgccgtggagtgggagtccaacggacagccggaaaataactacaaaactacaccccctatgctggacagcgatggttcatttttcctatactctaagctcaccgtagacaaaagtcgctggcagcagggcaacgtgttcagctgttccgttatgcacgaggcactgcacaatcattatacccaaaagtctctttcgctgagcccagggaaa

SEQ ID NO: 23988 - RNA, 642 nt, synthetic construct
  misc_feature 1..642: note = derived and/or modified sequence opt3 from Selicrelumab_LightChain
  source 1..642: mol_type = other RNA
gacatccagatgacccaaagcccctcctctgtgtcagccagtgtcggcgatagagttacaattacttgcagggctagccaggggatatactcctggctggcatggtatcagcagaagcctggaaaagccccaaacctccttatctacacggcgtctaccctgcaatcgggtgtgccgtcacggttcagcggcagtgggtccggaacagactttactttgaccatttctagcttacagcccgaggatttcgctacatattactgtcagcaggccaatatctttcctctgaccttcggcggtgggactaaggtagaaattaaacgcacagtggcagccccatccgtctttatctttcccccttcagacgagcaactaaagagtggaaccgctagcgtggtttgcctcctgaacaatttctatccacgagaagcaaaagtgcagtggaaggtcgataacgcccttcagtctggcaattcccaggagtcagtgacggaacaagacagcaaggatagtacttactctctgtccagcaccttgacactctcgaaagctgactatgagaagcacaaagtatacgcctgtgaggttactcatcagggcctgtcttcccccgtgaccaagtcattcaaccgtggggaatgc

SEQ ID NO: 23989 - RNA, 354 nt, synthetic construct
  misc_feature 1..354: note = derived and/or modified sequence opt3 from Solitomab_HeavyChain1
  source 1..354: mol_type = other RNA
gaggtgcagctgctcgaacaaagcggcgccgagcttgtcagacccgggacctccgttaagatctcttgcaaggcttcaggatacgcattcacaaactattggctgggttgggtgaaacagaggcctggccacgggttggaatggattggagacatatttccaggcagtggtaatatccattacaacgagaaattcaaggggaaagccactttaacggcggataagagctcctctaccgcttatatgcagctgtcgtcactaacatttgaagacagcgccgtatacttctgtgcacggctccgcaattgggatgagccgatggactattggggacagggcactaccgtgacagtc

SEQ ID NO: 23990 - RNA, 375 nt, synthetic construct
  misc_feature 1..375: note = derived and/or modified sequence opt3 from Solitomab_HeavyChain2
  source 1..375: mol_type = other RNA
gacgtgcagctggtccaaagcggcgccgaggttaagaaacccggggcttccgtgaaggtatcttgcaaagcatcaggatacaccttcacaagatatactatgcactgggtgaggcaggcccctggtcagggcctcgaatggatcgggtacattaacccaagtcggggatatacgaattacgcggatagcgtcaagggccgctttaccataacaactgacaaatccacctctacagcttatatggagctttcgtcactgcgaagcgaagataccgccacttactattgtgcacgttactacgacgatcattattgcttggactactggggtcaggggacaaccgtgacggttagttccggagagggcacttctacc

SEQ ID NO: 23991 - RNA, 1488 nt, synthetic construct
  misc_feature 1..1488: note = derived and/or modified sequence opt3 from Solitomab_LightChain_HeavyChain_HeavyChain_LightChain
  source 1..1488: mol_type = other RNA
gagctggtgatgacccagagcccctcctctctcacagtcactgccggcgaaaaggttacgatgtcatgcaaaagtagccaatcccttctgaactctgggaatcagaagaactacttgacctggtatcagcagaaacctggacaaccaccgaagttactgatctactgggcttcgacaagagagtcaggtgtgcccgacaggttcactggcagcgggagtggaaccgattttacactaaccatttcctctgtacaggcagaagacctcgccgtgtattactgtcagaatgattatagctaccctctgactttcggcgcgggtacaaaacttgagataaaagggggaggcggctccgggggaggtggctcagggggaggcggtagtgaagtccagctgttggagcaaagcggggctgagctcgtgcggccaggaacctctgttaagatctcctgcaaggcctcaggctatgcatttacgaactactggctgggctgggtgaagcagcgccccgggcacggactggaatggattggtgacatcttccctggcagcgggaatattcattacaacgagaaatttaagggaaaagccactctcaccgctgataagagttcttccacagcatatatgcagttaagctcgctgactttcgaagactctgccgtctacttttgtgctcgacttcgtaattgggatgagccaatggactattggggccagggtaccacagtgaccgtatcctcagggggcggaggcagtgatgttcaattggtgcagagcggggccgaggtcaagaaacccggagcgtccgtgaaggtgtcttgcaaagcaagcggttacacgttcactagatatacaatgcactgggtcaggcaggcccctggccaagggctggaatggatcggatacataaacccatcacggggctataccaattacgctgacagtgttaagggtcgctttactatcacaaccgataaatccacgagcaccgcctacatggagctatcttcactcagaagtgaagacacagcaacttattactgtgctaggtattacgatgaccattattgcctggactactgggggcagggcaccacagtgactgtaagctccggagagggcacctctacagggtcgggaggtagcggcgggtccggaggcgccgatgacattgtgcttacccagtcaccggcgactctgagtttgtctcccggtgaacgggccacgctcagctgtcgcgcatcccagtcagtcagctatatgaactggtaccaacagaagcctgggaaagctccaaagcgatggatctacgatacatctaaggtggcctccggcgttcccgctagattcagtggaagcggctctgggaccgactattccctgactattaattcattagaggccgaggatgcagccacctactattgccagcagtggagtagcaaccctctgacatttggaggcggtaccaaagtggaaatcaag

SEQ ID NO: 23992 - RNA, 339 nt, synthetic construct
  misc_feature 1..339: note = derived and/or modified sequence opt3 from Solitomab_LightChain1
  source 1..339: mol_type = other RNA
gagctggtgatgacccagagcccctcctctctcacagtcactgccggcgaaaaggttacgatgtcatgcaaaagtagccaatcccttctgaactctgggaatcagaagaactacttgacctggtatcagcagaaacctggacaaccaccgaagttactgatctactgggcttcgacaagagagtcaggtgtgcccgacaggttcactggcagcgggagtggaaccgattttacactaaccatttcctctgtacaggcagaagacctcgccgtgtattactgtcagaatgattatagctaccctctgactttcggcgcgggtacaaaacttgagataaag

SEQ ID NO: 23993 - RNA, 324 nt, synthetic construct
  misc_feature 1..324: note = derived and/or modified sequence opt3 from Solitomab_LightChain2
  source 1..324: mol_type = other RNA
gccgacgatatcgtgctgacccagagccccgctacactctccctttctcctggcgagagagcaactctgtcatgcagggccagtcaaagcgtctcctacatgaactggtatcagcagaagccagggaaagcgccgaagcggtggatttacgacacgtctaaagttgcttcgggagtgcccgcccgcttctcaggtagcggcagtgggaccgattattccttgacaataaattctttagaagcagaggacgccgctacttactattgtcagcaatggagctccaaccctctgacctttggaggcggtacaaaggtagaaatcaaa

SEQ ID NO: 23994 - RNA, 1359 nt, synthetic construct
  misc_feature 1..1359: note = derived and/or modified sequence opt3 from Suptavumab_HeavyChain2
  source 1..1359: mol_type = other RNA
gaggtgcagctggtcgaaagcggcggggacctcgttcaacccggaagatcccttaggctgtcttgcgtggcttcaggtttcacctttgatgactacgctatgcactgggtacggcaggcacctggcaaggggttggagtgggtgagtggagtcagctggtccggctctacagtgggttatgccgattcggttaaagggcgcttcactgtgtcacgagacaacgcgcaaaagagcttatacctgcagatgaatagtctacgtgctgaagatacggccctctattactgtgtcaaagacgcatataagtttaactactattactacggactggatgtgtggggccaaggcaccacagtaactgtttcctctgccagcaccaaagggccatccgtgttcccgcttgctccctcaagtaagagcacatctggaggtaccgcagccctgggctgcttggtcaaggactattttcctgagccagtgactgtgtcctggaactcaggggctctcacaagcggagtccataccttccccgccgttctgcagagttctggcctgtactccctcagctcggtggtaacggtgccttcttcctcattaggtactcagacctatatctgtaatgtcaatcacaaaccaagtaacacaaaggtggataaaaaggttgaacccaaaagctgcgacaagactcatacctgtcctccatgcccggcgcccgagctgcttgggggaccttccgtgtttttgttcccacccaagcctaaagatacactgatgatttctagaaccccagaggtcacgtgtgtggtagttgacgtgagccacgaagatcccgaggtcaagtttaattggtacgtggacggcgtcgaagtgcataacgcaaaaactaagccgagggaggagcagtataattcaacataccgggttgtgagtgtactaaccgtcctccaccaagactggctgaacggcaaagaatataagtgcaaagtgtccaataaggcccttcctgctcccatagagaagactatcagcaaagccaaggggcagccacgcgaacctcaggtttacacactgcccccatctagagatgagttgaccaaaaaccaggtgtcactcacgtgtctggtcaagggattctaccccagtgacattgcagtggaatgggagagcaatggtcaacctgagaacaattataaaaccacaccaccggtattagattccgacggcagctttttcctgtactcgaagctcactgtggataagtctaggtggcagcaggggaacgtcttttcctgctcagttatgcacgaagcccttcataaccactatacccagaaaagtctgtctttgagccccggaaag

SEQ ID NO: 23995 - RNA, 1356 nt, synthetic construct
  misc_feature 1..1356: note = derived and/or modified sequence opt3 from Suvratoxumab_HeavyChain
  source 1..1356: mol_type = other RNA
gaagtgcagctggtcgaaagcggcgggggactcgttcaacccggtggctcccttagactgtcttgcgccgcttcagggttcacctttagtagccacgacatgcattgggtgaggcaggcaacaggaaagggcttggagtgggtatccggtatcgggactgccggagatacgtactatcctgactctgtgaaaggccggttcaccatttcgcgcgaaaacgcgaaaaattcattatacctgcagatgaacagcctacgagctggcgatacagccgtctattactgtgcacgtgacagatatagtccaactgggcactactatggaatggatgtgtggggtcagggcaccacagttaccgtgtcctctgccagcactaaggggccgtccgtctttcccctcgctccttcaagtaagagcacatctggaggcaccgcagccctgggttgccttgtgaaagactacttcccagagcccgtaacggtttcctggaactcaggggctctgactagcggagtgcatacctttcctgccgtcttgcaaagttctggcctctactccctgagctcggtggtgacagtcccatcttcctcactgggcactcagacctatatatgtaatgttaatcacaagcccagtaacacaaaggtggataaaagggtagaacctaagagctgcgacaaaacccatacgtgtccaccgtgccccgcgcctgagctcttagggggaccatccgtgttcctgtttccccctaagccaaaagatactctttacatcacacgggagcccgaagtcacctgtgtggttgtggacgtctctcacgaggatccggaagtgaagttcaattggtatgtagacggtgttgaggtgcacaacgcaaagactaaacctcgcgaggaacagtacaatagcacatatagagtcgtgtcagtcttgaccgtgctgcatcaggattggctaaacggcaaggagtacaaatgcaaggttagtaataaagccctccccgctccaattgaaaagacgatctccaaagccaaggggcaacctagggagccccaggtgtataccctgccacccagccgggaagagatgacaaagaaccaggtatctcttacttgtctggtcaaaggattttacccttcagacattgcagtggagtgggaaagtaatggccagccagagaacaattacaagaccacaccgcccgttttggacagcgatggttccttctttctctattctaaactgactgtggacaagtcgcgctggcaacaggggaacgtcttcagctgctccgtgatgcacgaggctttacataaccactacacccagaaatcactgagtctctctcctggcaag

SEQ ID NO: 23996 - RNA, 639 nt, synthetic construct
  misc_feature 1..639: note = derived and/or modified sequence opt3 from Suvratoxumab_LightChain
  source 1..639: mol_type = other RNA
gacatccagatgacccaaagcccctccacactgtctgcctcagtgggcgatagagtcactattacgtgcagggctagtcagagcatatcctcttggctcgcatggtaccagcagaagcctgggaaagccccaaaacttctgatctataaggcgtcgtcattggagagcggagttccgagtcggttctccggttctggcagcgggaccgaatttacattaactatttcctcactgcaacccgacgatttcgctacctactattgtaagcagtacgccgactattggacatttggacagggcaccaaagtggagatcaagcgcactgtagcagcccctagtgtgttcatttttccacccagcgatgaacagctaaagtctggtacagcttccgtcgtgtgcctcctgaacaatttctaccctcgagaggcaaaagttcaatggaaggtggacaacgcccttcagtcagggaatagccaggaaagtgtcaccgagcaggattctaaagactccacgtatagcctgtcgtctactttgaccctctccaaggctgattacgagaaacacaaggtgtacgcctgtgaagtaacacatcaaggactgtcaagtccagttactaagagctttaaccgtggcgagtgc

SEQ ID NO: 23997 - RNA, 642 nt, synthetic construct
  misc_feature 1..642: note = derived and/or modified sequence opt3 from Tadocizumab_LightChain
  source 1..642: mol_type = other RNA
gacatccagatgacccaaacacccagcactctgtccgcctctgtgggcgatagagtcacgatttcatgcagggctagtcaggacataaacaattacctcaactggtatcagcagaagcctgggaaagcaccaaaacttctgatctactataccagcacattgcactccggagttccgtctcggttctcgggttcaggcagcgggactgattacaccttaacaattagttccctgcaacccgacgattttgccacctatttctgtcagcagggaaatactctaccttggacatttggccagggtaccaaggtggaggtaaagcgcacggtggcggctccatctgtcttcatctttccccctagcgacgaacaactcaaatccgggactgcctcagtggtttgcctgcttaacaatttctacccacgagaggcaaaggtgcagtggaaggtcgataacgccctgcagagtggaaatagccaggaatctgtgaccgagcaagactccaaagattcaacatatagcttgagttctactctcaccctgtccaaggctgactacgaaaaacataaggtatacgcatgtgaggttacacaccagggcctgagctcgcccgtgaccaaatcttttaaccgtggcgagtgc

SEQ ID NO: 23998 - RNA, 1341 nt, synthetic construct
  misc_feature 1..1341: note = derived and/or modified sequence opt3 from Tanezumab_HeavyChain
  source 1..1341: mol_type = other RNA
caggtgcaactgcaggagagcggccccgggctcgtcaagccttccgaaaccctttctctgacatgcactgtttcaggattcagtttgatcggttacgacttaaactggattagacagccaccgggcaaagggctggagtggataggaatcatttggggcgatggtacgaccgactataatagcgccgtgaagtccagggtaacaatctctaaagatacttcgaagaaccagttttcactaaaactcagcagtgtgaccgctgcagacacagccgtctactattgtgcgcgcgggggatactggtatgctacctcctactatttcgattactggggccaaggcactctggtgacagtttctagcgcctccaccaaggggccctcagtgtttcctcttgcaccatgcagtcggagcacgtctgaatccactgccgctctgggatgtttggtcaaggactacttccccgagcctgtgaccgtatcatggaatagcggtgcactcacaagtggcgttcacacttttccagccgtgctgcagtcttccgggctgtatagcctctcgtctgtcgtgaccgtgccctcctcaaacttcggaacacagacctacacgtgcaatgtcgatcataaacctagtaacactaaggttgacaaaacagtggaacgaaagtgttgcgtagagtgtccaccgtgccccgctcctccagtggccggccccagcgtctttttattccctccaaaacccaaggataccctgatgatttcccgtactccggaggtgacatgtgttgtggtcgacgtgtctcacgaagatcctgaggtacagtttaattggtatgttgacggtgtggaagtccataacgcgaagaccaaacccagagaggagcaattcaatagcacgtttagggtggtctcagtgcttaccgttgtgcaccaggattggttgaacgggaaggaatacaaatgcaaggtaagtaataaaggactgccatccagcatcgagaagacaatatctaaaactaagggccagcctcgggaaccccaggtctataccctaccaccctcacgcgaggaaatgacaaagaaccaagtgagtctcacttgtctggttaaaggcttctaccctagcgacatcgcagtggagtgggagtccaatgggcagccagaaaacaattataagaccacaccgcccatgcttgactctgatggatcgtttttcctgtacagcaaattgaccgtcgacaagtccagatggcagcaaggtaacgtgttctcatgcagtgtaatgcatgaggccctccacaaccactacactcagaaatctctgagcttatcccctggcaag

SEQ ID NO: 23999 - RNA, 642 nt, synthetic construct
  misc_feature 1..642: note = derived and/or modified sequence opt3 from Tanezumab_LightChain
  source 1..642: mol_type = other RNA
gacatccagatgacccaaagcccctcctctctgtcagccagtgtgggcgatagagtcacaattacttgcagggctagccagtccatatctaacaatctcaactggtaccagcagaagcctgggaaagcaccaaaacttctgatctattacacgtcgcggttccactcaggagttccgagccgctttagtggttccggctctgggaccgacttcacatttactattagctccttgcaacccgaggatatcgccacctattactgtcagcaggaacatacattaccttataccttcggacagggcactaagctggagattaagcgaacagtggcggctccatcagtatttatctttccccctagtgacgaacaactaaaaagcggtaccgcctctgtggtctgcctcctgaataacttctacccacgtgaggcaaaggtgcagtggaaggttgataatgcccttcagtccgggaactcacaggaaagcgtgacggagcaagacagtaaagattctacttattccctgagctcgaccttgacactctctaaggctgactacgagaaacacaaggtctacgcatgtgaagtgactcatcagggactgtcctcacccgtaaccaaaagtttcaatagaggcgagtgc

SEQ ID NO: 24000 - RNA, 1353 nt, synthetic construct
  misc_feature 1..1353: note = derived and/or modified sequence opt3 from Tavolixizumab_HeavyChain
  source 1..1353: mol_type = other RNA
caggtgcaactgcaggagagcggccccgggctcgtcaagccttcccagaccctttctctgacatgcgccgtttacggaggttcattcagtagcggctattggaactggatcagaaaacacccagggaagggattggaatacattggctatatatcctacaatggtatcacttatcataacccgtctttaaaatcgaggattacgatcaatcgggacacctcaaagaaccagtacagcctgcaactaaatagtgtgacacccgaggatactgctgtatattactgtgcacgctacaaatatgactacgatgggggacacgccatggactattggggccagggcaccctcgtgacagtctcctctgcgagcaccaaggggccttccgtgtttccactggctccctcaagtaagagcacttctggaggtacagccgcacttggctgcctggttaaagattacttccctgaaccagtgaccgtctcctggaactcaggggccttgacgagcggagtgcatacttttcccgctgtactccagagttctggcctgtattccctgagctcggttgtgaccgtcccttcttcctcactcggtacacagacttacatttgtaatgtgaaccacaagccaagtaataccaaagtggacaagcgagtcgagccgaaaagctgcgataagacacatacctgtcccccttgcccagcacccgaattacttgggggaccttccgttttcctgtttccacccaagccgaaagacacgttgatgatctctcgtactcctgaggtgacatgtgtagtggtcgatgtgagccacgaggaccccgaagttaagttcaactggtatgtggatggcgtcgaggtgcacaatgccaaaaccaagccacaagaggaacagtacaactcaacttacagagtagttagtgtgctgacagtcctacatcaggactggctcaatggcaaagagtataagtgcaaagtgtccaacaaggctctgcctgcccccatagaaaagaccatcagcaaagcgaaggggcagccaagggagccccaagtctacacgcttcctccatctcgggaagagatgaccaaaaatcaggtgtcactgacatgtttggttaagggattttatccgagtgatattgcagtggaatgggagagcaacggtcagcccgagaacaattacaaaactacccctccagtactcgactccgacggctctttctttctgtattcgaagttaacagtcgataagagccgctggcaacaggggaacgtgttctcctgctcagttatgcacgaagccctgcataatcactacactcagaaaagtctctctcttagccccggaaag

SEQ ID NO: 24001 - RNA, 642 nt, synthetic construct
  misc_feature 1..642: note = derived and/or modified sequence opt3 from Tavolixizumab_LightChain
  source 1..642: mol_type = other RNA
gacatccagatgacccaaagcccctcctctctgtcagccagtgtgggcgatagagtcacaattacttgcagggctagccaggacatatccaactacctcaattggtatcagcagaagcctgggaaagcaccaaaacttctgatctactatacgtctaagttgcactcgggagttccgtcacggttcagcggtagtggctccgggaccgattacacattaactatttctagcctgcaacccgaggactttgccacctattactgtcagcagggatccgcgctaccttggacattcggccagggtaccaaggtggaaatcaaacgcactgtagctgccccatcagtgtttatttttccccctagtgatgagcaactcaagagcgggacagcatctgtcgtgtgcctgcttaacaatttctatccacgagaagccaaggttcagtggaaagtggacaacgctctgcagtccggaaattcacaggagagcgtcaccgaacaagatagtaaggactctacgtactccttgagctcgactctcaccctgtctaaagcagattacgagaagcataaagtgtatgcctgtgaggtaacacaccagggcctgtcctcacccgttactaagagtttcaaccgtggcgaatgc

SEQ ID NO: 24002 - RNA, 1335 nt, synthetic construct
  misc_feature 1..1335: note = derived and/or modified sequence opt3 from Telisotuzumab_HeavyChain
  source 1..1335: mol_type = other RNA
caggtgcagctggtccagagcggcgccgaggttaagaaacccggggcttccgtgaaggtatcttgcaaagcatcaggatacatcttcaccgcctatacaatgcactgggtgagacaggcgcctggtcagggcctcgaatggatggggtggattaagccaaacaatggacttgctaactacgcccaaaaatttcagggcagggtcactatgacgcgggacaccagtataagcacagcatatatggagctgtcccgcttgcgatctgatgacactgccgtgtactattgtgctcgttcggaaatcaccacagagttcgattactggggtcaggggaccttagttactgtgtcaagcgcaagtacaaagggaccgtccgtctttcccctggccccttctagcaagtccacctcaggcggcacggctgccctagggtgcctcgtgaaagactatttcccagaacccgtaactgttagttggaatagcggagcgctgacctctggtgtgcatacatttcctgcagtccttcagtcctcaggcctgtacagcttgagttctgtggtgactgtcccatccagctcgctcgggacccaaacatacatttgtaacgttaatcacaagccctctaacaccaaagtggataagagagtagagcctaaatcctgcgactgtcattgcccaccgtgtcccgcccctgagctgctgggaggcccatcagtgttcctctttccccctaagccaaaggatacgttaatgatcagtaggactcccgaagtcacatgcgtggttgtggacgtcagccacgaggatccggaagtgaaattcaattggtatgtagacggtgttgaggtgcataacgctaagaccaaacctcgggaggaacagtacaattccacttatcgcgtcgtgtctgtcctgacagtgcttcaccaggattggttgaacgggaaggagtacaaatgtaaggttagcaataaagccctgcccgcaccaattgaaaagaccatctcaaaggctaaaggacagcctagagagccccaagtgtatacgctaccacccagtagggaagagatgaccaagaaccaggtatccctcacatgcctggtcaaaggcttttaccctagcgacatagccgtggagtgggaatctaatggccagccagagaacaattataagactaccccgcccgttcttgattcagacgggagtttctttctgtacagcaaattgacagtggacaagtcccggtggcaacagggaaacgtcttctcttgttcggtgatgcacgaagcgctccataaccactacactcaaaagagcctgtccttatcacctggt

SEQ ID NO: 24003 - RNA, 654 nt, synthetic construct
  misc_feature 1..654: note = derived and/or modified sequence opt3 from Telisotuzumab_LightChain
  source 1..654: mol_type = other RNA
gacatcgtgatgacccagagccccgattccctggccgtctctctcggcgagagagctacaattaactgcaagtcaagtgaaagcgttgactcctacgcaaattctttccttcactggtatcaacagaaacctgggcagccaccgaagctgttgatatacagggcctcgactcgggagtcaggagtgcccgatcgctttagcggtagtggctccgggacggacttcaccttaacaatctctagcctgcaggcggaagatgtagctgtgtattactgtcaacagtccaaagaggaccctctaacttttggaggcggtaccaaggtcgaaattaaacgaacagtggccgcaccatcagttttcatctttccccctagtgatgagcagctcaagagcgggaccgcctctgtggtctgcctgcttaacaatttctatccacgtgaggctaaggtgcagtggaaagtagacaacgcactgcaatccggaaattcacaggaaagcgttactgagcaggatagtaaggactctacatactccttgagctcgaccctcacgctgtctaaagccgattatgaaaagcataaagtgtacgcttgtgaggtcactcaccagggcctgtcctcacccgtgaccaagagttttaacagaggcgagtgc

SEQ ID NO: 24004 - RNA, 1335 nt, synthetic construct; identical to SEQ ID NO: 24002
  misc_feature 1..1335: note = derived and/or modified sequence opt3 from Telisotuzumab_vedotin_HeavyChain
  source 1..1335: mol_type = other RNA

SEQ ID NO: 24005 - RNA, 654 nt, synthetic construct; identical to SEQ ID NO: 24003
  misc_feature 1..654: note = derived and/or modified sequence opt3 from Telisotuzumab_vedotin_LightChain
  source 1..654: mol_type = other RNA

SEQ ID NO: 24006 - RNA, 1350 nt, synthetic construct
  misc_feature 1..1350: note = derived and/or modified sequence opt3 from Timigutuzumab_HeavyChain
  source 1..1350: mol_type = other RNA
gaggtgcagctggtcgaaagcggcgggggactcgttcaacccggtggctcccttagactgtcttgcgccgcttcagggttcaacatcaaggacacctacattcactgggtgaggcaggcacctggaaaaggcttggagtgggtagcccggatatatccaacaaatggttacactcgctatgcggatagtgtgaaggggcgatttacgatcagcgctgacacctccaaaaacacagcctacttacagatgaatagcctgcgtgcagaagatactgccgtctattactgttcgagatggggaggcgacggcttctatgctatggattactgggggcagggaaccctagtgacagtttcaagcgcaagtaccaagggtccgtccgtgtttcccctcgccccttctagcaaatccacttcaggcgggacagctgccctgggatgccttgtcaaggactacttcccagagcccgtgaccgtaagttggaacagcggcgcgctgacgtctggtgttcatacttttcctgcagtgttgcaatcctcagggctctatagcctgagttctgtcgtgaccgtgccatccagctcgctgggaacacagacttacatttgtaatgtcaaccacaagccctctaataccaaagttgataagaaagtggaacctaagtcctgcgacaaaacacatacctgtccaccgtgccccgcccctgagctcttaggcggcccatcagtattcctgtttccccctaagccaaaggatacgcttatgatcagtaggactcccgaggtgacatgtgtcgtggttgacgtgagccacgaagatccggaggtcaaattcaactggtatgtggacggggtagaagttcataatgctaagaccaaacctcgggaggagcagtacaactccacttatcgcgtggtctctgtgttgacagtcctgcaccaggattggctaaatggaaaggaatacaaatgcaaggtgagcaacaaagccctccccgcaccaattgagaagaccatctcaaaggctaaaggtcaacctagagaaccccaggtttatacgctgccacccagtagggacgagcttaccaagaatcaggtgtccctgacatgtttggtaaaaggcttttaccctagcgacatagccgtcgaatgggagtctaacgggcagccagagaataactacaagactaccccgcccgtgctcgattcagacggaagtttctttctgtatagcaaattaacagttgataagtcccggtggcaacagggcaacgtgttctcttgctcggtcatgcacgaaggtctgcataatcactacactcagaagtctctctccctttcacctgggaaa

SEQ ID NO: 24007 - RNA, 642 nt, synthetic construct; identical to SEQ ID NO: 23668
  misc_feature 1..642: note = derived and/or modified sequence opt3 from Timigutuzumab_LightChain
  source 1..642: mol_type = other RNA

SEQ ID NO: 24008 - RNA, 1332 nt, synthetic construct; identical to SEQ ID NO: 23052
  misc_feature 1..1332: note = derived and/or modified sequence opt3 from Timolumab_HeavyChain
  source 1..1332: mol_type = other RNA

SEQ ID NO: 24009 - RNA, 642 nt, synthetic construct; identical to SEQ ID NO: 23053
  misc_feature 1..642: note = derived and/or modified sequence opt3 from Timolumab_LightChain
  source 1..642: mol_type = other RNA

SEQ ID NO: 24010 - RNA, 1347 nt, synthetic construct
  misc_feature 1..1347: note = derived and/or modified sequence opt3 from Tomuzotuximab_HeavyChain
  source 1..1347: mol_type = other RNA
caggtgcaactgaagcagagcggccccgggctcgtccagccttcccagtctctttcaattacctgcacagttagtggattcagcctgactaactacggtgtgcactgggtaagacaatccccaggcaaagggttggagtggttaggagtgatctggtctggcggtaatacggactataacaccccgtttacatcgaggctgtcaataaataaggataacagcaaaagtcaggtcttctttaagatgaactccctacagtctaatgacactgccatctactattgtgctcgggcactcacctactatgattacgagttcgcctattgggggcagggaacactggtgaccgttagcactgcgtccacaaaaggcccctcagtgtttcctcttgctccaagtagcaagtctacctccggcgggacggccgcactgggatgcttggtcaaggactacttccccgaacctgtgactgtatcatggaatagcggtgccctcaccagtggcgttcatacatttccagctgtgctgcaatcttccgggctgtacagcctctcgtctgtcgtgactgtgccctcctcaagtttaggaacccagacatatatttgtaacgtcaatcacaaacctagcaacaccaaggttgataaaaaggtggaaccaaaatcctgcgacaagacgcatacttgtccgccctgccctgcaccagagctgcttggcggtccctctgtattcttgtttcctccaaagcccaaagatacactgatgatcagccgcaccccggaagtgacttgtgtcgtggttgacgtgtcacacgaggatcctgaggtcaagttcaattggtacgtggacggggtagaagttcataacgccaaaacaaagccccgagaggaacagtataatagtacctaccgtgtggtctccgtgctaacggtcctccaccaggattggctgaacggaaaagagtataagtgcaaagtgagcaataaggcccttccagctcctattgagaagaccatctctaaagcgaagggccaacccagagaaccacaggtttacacactgcccccttcaagggacgagttgactaaaaaccaggtgagtctcacctgtctggtaaagggcttttatccaagcgatatagcagtcgaatgggagtccaacgggcaaccggaaaataactacaaaacaactccccctgtgttagactctgacggatcgttctttctgtacagcaagctcaccgttgataagtcccggtggcagcagggtaatgtgttctcatgcagtgtcatgcacgagggccttcataaccactatacacagaaatctctgagcttgtccccagggaag

SEQ ID NO: 24011 - RNA, 642 nt, synthetic construct; identical to SEQ ID NO: 23083
  misc_feature 1..642: note = derived and/or modified sequence opt3 from Tomuzotuximab_LightChain
  source 1..642: mol_type = other RNA

SEQ ID NO: 24012 - RNA, 1347 nt, synthetic construct; identical to SEQ ID NO: 23811
  misc_feature 1..1347: note = derived and/or modified sequence opt3 from Trastuzumab_duocarmazine_HeavyChain
  source 1..1347: mol_type = other RNA

SEQ ID NO: 24013 - RNA, 642 nt, synthetic construct; identical to SEQ ID NO: 23668
  misc_feature 1..642: note = derived and/or modified sequence opt3 from Trastuzumab_duocarmazine_LightChain
  source 1..642: mol_type = other RNA

SEQ ID NO: 24014 - RNA, 1368 nt, synthetic construct
  misc_feature 1..1368: note = derived and/or modified sequence opt3 from Varisacumab_HeavyChain
  source 1..1368: mol_type = other RNA
caggtgcaactggtccagagcggcgccgaggttaagaaacccggggcttccgtgaaggtatcttgcaaagcatcaggaggtaccttcagtagctacgccatctcctgggtgagacaggcgcctggccaggggctcgaatggatgggaggctttgacccagaggatggtgaaacaatttatgctcaaaagttccaggggagggtcactatgacggaggacacctctacagatactgcctacatggaactttcgtcactgcggagcgaggacaccgcagtgtattactgtgccacaggacgcagtatggttcgaggcgtgataatcccgtttaacggcatggatgtctgggggcagggaaccactgtgacagtatcctctgctagcaccaaaggtccctccgttttccctttggcaccatcaagtaagagcacgtctggcgggactgccgctttaggatgcctggtgaaggactattttcccgagcctgtcaccgtgtcctggaactcaggcgccctaacaagcggtgtgcacactttcccagcggtcctccagagttctgggctgtactcccttagctcggttgtgaccgtaccctcttcctcactgggaacacaaacctatatttgtaatgtgaatcataaacctagtaacacgaaggtcgataaaaaggtggaaccaaaaagctgcgacaagactcacacatgtccgccctgccctgcaccagagttgctcggcggcccctccgtttttctgttccctccaaagcccaaagataccctgatgatctctcgtactccggaagtgacatgtgtcgtggtagacgttagccatgaggatcctgaggtgaagtttaattggtacgtcgacggggtggaagtccacaacgccaaaaccaagcccagagaggaacagtacaattcaacgtatagggtggttagtgtgctcaccgtattacatcaggattggctgaacggaaaagagtacaagtgcaaagtctccaataaggcccttccagctcctattgaaaagacaatcagcaaagcaaagggtcagccccgggagccacaagtgtatactttgcccccttctcgcgacgagctgaccaaaaaccaggtttcactaacatgtctcgtgaagggcttctacccaagtgacatagctgtcgaatgggagagcaatgggcagccggaaaacaattataaaactacaccccctgtgctggattccgacggatcgtttttcctttactctaagctgaccgtagataagagcagatggcaacagggcaacgtgttttcctgctcagttatgcacgaggccttgcacaatcattatacccagaaaagtctctctctgagcccaggtaag

SEQ ID NO: 24015 - RNA, 642 nt, synthetic construct
  misc_feature 1..642: note = derived and/or modified sequence opt3 from Varisacumab_LightChain
  source 1..642: mol_type = other RNA
gacatcagaatgacccagagcccctcctctctgtcagccagtgtgggcgatagggtcacaattacttgccgggctagccaatccatatcttcgtacctcaactggtatcagcagaagcctgggaaagcaccaaaacttctgatctacgccgcgagctcattgcagagtggagttccgtcccgcttctctggtagcggctccgggacggactttaccttaacaatttcaagtctgcaacccgaggatttcgctacttattactgtcagcagagctattctacccctctaacatttggaggcggtaccaaagtggaaatcaagcgaactgtagccgcaccatccgtgttcatttttcccccttcagacgagcagctcaaaagcgggacagccagtgtcgtgtgcctgcttaataacttctacccacgtgaagctaaggttcaatggaaggtggataatgcactgcagtctggaaactcccaggagagcgtcaccgaacaggactcgaaagattctacgtattccttgtcaagtactctcaccctgagcaaggccgactacgagaaacacaaggtgtacgcttgtgaggtaacacatcaaggcctgtcctctcccgttactaagagctttaatagaggcgaatgc

SEQ ID NO: 24016 - RNA, 1359 nt, synthetic construct
  misc_feature 1..1359: note = derived and/or modified sequence opt3 from Vunakizumab_HeavyChain
  source 1..1359: mol_type = other RNA
gaggtgcagctggtccaaagcggcgccgaagttaagaaacccggggcttccgtgaaggtatcttgcaaagcatcaggatacaccttcacagactatgaggtgcactgggtcagacaggcccctggtcagggcctcgaatggatgggggtgatcgatccaggaactggcggtgttgcgtacaaccagaagtttgaggggagggtgacgatgaccgctgacacaagtactagcaccgcctatatggaacttcggtccctgcgctctgatgacacagcagtctactattgtacccgatactcgttgttctatggatcaagcccgtacgccatggattactggggccaaggcactttagtgacagtaagttccgcttctaccaaagggcccagcgtttttcctctggcaccatcctcaaagagtacgagcggaggtactgccgctctaggctgcctcgtgaaggactatttccccgagcctgtcaccgtgtcttggaactccggggccctgacatcaggagtgcatacttttccagcggtccttcagagcagtggcctgtactctttgtccagcgttgtgaccgtaccctcgtcttccctcggtacacagacctatatttgtaatgtgaatcacaaaccttcaaacacgaaggtcgataaaaaggtggagccaaaaagttgcgacaagactcatacatgtccgccctgccctgcaccagaactgctcgggggacccagcgttttcctgtttcctccaaagcccaaagataccttaatgatatcccgtactccggaggtgacatgtgtcgtggtagacgtttctcacgaagatcctgaggtgaagttcaattggtacgtcgacggcgtggaggtccataacgccaaaaccaagcccagagaggaacagtataatagcacgtacagggtggtttcagtgctgaccgtacttcaccaagattggttgaacggcaaagaatataagtgcaaagtcagtaataaggctctgccagcccctatcgagaagacaatttccaaagcaaaggggcagccccgggaaccacaggtgtacactctaccccctagccgcgaggagatgaccaaaaaccaggtttctctcacatgtctggtgaagggattttacccatcagacatcgctgtcgaatgggagagtaatggtcaaccggaaaacaattataaaactacaccccctgtgcttgacagcgatggctccttctttctgtactctaagttgaccgtagacaagtcgagatggcagcaggggaacgtgttcagctgctccgttatgcacgaggccctccataatcactatacccaaaaatcactgagtttatctccaggaaag

SEQ ID NO: 24017 - RNA, 639 nt, synthetic construct
  misc_feature 1..639: note = derived and/or modified sequence opt3 from Vunakizumab_LightChain
  source 1..639: mol_type = other RNA
gagatcgtgctgacccagagccccgacttccaatccgtcacacctaaggaaaaagttactattacgtgctctgcctcaagtagcgtgaactacatgcactggtttcagcagaagccagatcagtccccgaaactctggatatatagaacctctaatcttgcttcgggcgtaccctcaaggttcagcgggagtggatccggtacagactacactctgaccatcaactctttggaggcagaagatgccgcgacatattactgtcaacagcggagctcctatccttggacctttggccaggggactaagttagagattaaacgcacagtggctgccccatcagtcttcatctttccccctagtgacgaacagctaaagagcggaaccgcatctgtggtttgcctgctcaataacttctacccacgagaggccaaggtgcaatggaaagtcgataatgctctgcagtccggcaactcacaggagagcgtgacggaacaggacagtaaggattctacttattcccttagctcgaccctgacattgtctaaagcagactacgagaagcataaagtatacgcctgtgaagttactcaccaaggtctctcctcacccgtgaccaagagttttaatcgtggggagtgc

SEQ ID NO: 24018 - RNA, 1341 nt, synthetic construct; identical to SEQ ID NO: 23921
  misc_feature 1..1341: note = derived and/or modified sequence opt3 from Xentuzumab_HeavyChain
  source 1..1341: mol_type = other RNA

SEQ ID NO: 24019 - RNA, 648 nt, synthetic construct; identical to SEQ ID NO: 23922
  misc_feature 1..648: note = derived and/or modified sequence opt3 from Xentuzumab_LightChain
  source 1..648: mol_type = other RNA

SEQ ID NO: 24020 - RNA, 726 nt, synthetic construct
  misc_feature 1..726: note = derived and/or modified sequence opt3 from anti-rabies_SO57_LightChain
  source 1..726: mol_type = other RNA
atgagcgtgcccaccatggcctgggctctgctccttctgtccttgttaacacagggcactgggtcttgggcacaatcagccctgacgcagcctagaagtgtcagcggatccccaggtcagtctgttaccatctcgtgcacaggcacttcaagcgacattgggggatacaacttcgtgagttggtatcagcaacacccgggcaaggcgcccaaactaatgatatacgatgctaccaagaggccttccggtgtaccagaccggttttctgggagcaaatccggaaatacagcctcactcaccatcagtggcctgcaggcagaggatgaagccgactattactgttgcagctatgctggcgattacactcccggggtggtcttcggaggtggcacaaaacttaccgtgctggggcagcctaaggcagccccatctgttacgttgtttcccccttcctcagaggaactccaggctaacaaggccactctggtgtgtctgattagcgacttctatccaggagcggtcaccgtggcatggaaggccgatagttctccggtaaaagctggcgttgagacaactaccccctccaagcaaagcaataacaaatacgccgcatcgtcttacctctccttaacacctgaacagtggaagtcacatcgcagttatagctgccaggtgacccacgagggttccacggtcgagaaaactgtggctccaacagaatgttct

SEQ ID NO: 24021 - RNA, 1428 nt, synthetic construct
  misc_feature 1..1428: note = derived and/or modified sequence opt3 from anti-rabies_SO57_HeavyChain
  source 1..1428: mol_type = other RNA
atggactggacctggagattcctgtttgtggtcgccgctgcaacaggcgttcagagccaagtgcagctcgtacagtccggggccgaggtgaagaaacccggatcttcagtcaaggtgagttgcaaagcgagcggtggcactttcaacaggtacacggttaattgggtgcggcaggctcctgggcaaggacttgaatggatgggcggtatcattccaatatttgggaccgccaactatgcacagcgcttccagggacgactgacaatcactgccgatgagtccacctctacagcttacatggaattgtcgtcattacgtagcgacgataccgcagtctatttttgtgccagagagaatctggacaacagtggcacttactattacttctccggctggtttgatccgtgggggcagggaactctagtgaccgtatctagcgcttccacgaagggtccctcagttttccctctcgccccaagtagcaaatctacttccggcgggaccgcggcactgggatgccttgtgaaggactattttcccgaacctgtcacagtgtcatggaatagcggcgccctgacaagtggtgtgcacaccttcccagctgtcttgcaatcttccgggctctacagcctgtcgtctgttgtgacagtaccctcctcaagtctgggaacccagacgtacatttgtaacgtgaatcataagcctagcaacactaaagtcgataagagggtggagccaaaatcctgcgacaagacacacacctgtccgccctgccctgccccagagctcttaggcggcccctctgtttttctgttccctccaaaacccaaggatactcttatgatcagccggacaccggaagtgacctgtgtcgtggtagacgtttcacatgaggatcctgaagtgaagtttaattggtatgtcgacggggtggaggtccacaacgcaaaaacgaagccccgcgaggaacagtacaatagtacctatagagtggtttccgtgttgacagtactgcatcaggattggctaaacggaaaagagtacaagtgcaaagtcagcaataaggctctcccagcccctattgagaaaactatctctaaggcgaagggtcaacccagggaaccacaggtgtataccctgcccccttcacgggaagagatgactaaaaaccaggttagtcttacatgtctggtgaagggcttctacccaagcgacatagccgtcgagtgggaatccaatgggcaaccggagaacaactataaaaccacaccccctgtgttggactctgatggatcgttctttctctacagcaagctgaccgtagacaaatcccgctggcagcagggcaatgtgttctcatgcagtgttatgcacgaagcattacacaaccattacactcagaagtctctgagcctctccccaggtaag

SEQ ID NO: 24022 - RNA, 696 nt, synthetic construct
  misc_feature 1..696: note = derived and/or modified sequence opt3 from anti-rabies_SOJB_LightChain
  source 1..696: mol_type = other RNA
atggcctggaccgtgctgctccttggcctgttgagccactgcacagggtccgtcacttcttacgttttaacgcagcccccttcagtgagtgtagctccaggaaagaccgcaagaatcaactgtggtggcaataacattgagtataggagcgtgcattggtaccaacagaaatccgggcaggccccggtcgcggtgatatatgacaattctgatcggccctcgggaatccctgaacgcttctcaggcagcaagagtggtaacacagctactctgaccatttcccgagttgaggccggggacgaagcagattactattgccaggtgtgggacatctctagcgatgtcgtgtttggaggcggcacaaaactaaccgtactcgggcaaccaaaggccgctccctccgttactctgttccctccatcaagtgaggaacttcaggcaaataaagccacactggtgtgtttgattagcgacttttaccccggagctgtcaccgtggcctggaaggcggattcttcccctgtgaaggccggtgtcgagacgactaccccatcaaaacagagcaacaataagtatgcagctagttcttacctctccctgacaccggagcagtggaaaagccaccgttcgtactcttgccaagttactcatgaaggctccaccgtggagaagacagtagcccccaccgaatgttca

SEQ ID NO: 24023 - RNA, 1554 nt, synthetic construct
  misc_feature 1..1554: note = derived and/or modified sequence opt3 from anti-rabies_SOJB_HeavyChain
  source 1..1554: mol_type = other RNA
atggacaccctgtgcagcacactccttctgttgactatcccctcctgggtgttatctcagattacgctgaaggagaccggccctaccctagtcaaaccaactcaaaccctcacactgacctgtactttctcagggtttagtcttagcacatccggagttggtgtgggctggataagacagccgcccgggaaggccctggaatgggtaaccttgatctactgggatgacgataaaaggtattctccttcgctcgagaaccgggtgacgattcgcaaggacacttcaaagaatcaggtcgctctgaccatgacaaacatggatccactggacactggaacctactattgcgcacaccgacagcatatcagcagtttcccctggtttgattcctggggccaaggtacactcgtgaccgtttctagcgcctccacgaaggggccttcagtgttcccattagcgccctgtagtcgtagcacttctggaggcacagctgccctgggctgccttgtcaaggactactttcctgaaccagtgaccgtatcctggaactcaggggcattgactagcggagttcacacattcccggccgtgctgcagagttctggtctatattccctcagctcggtcgtgaccgtgccctcttcctcactgggcacgcagacctacacatgtaatgtcaatcataaacctagtaacactaaggttgataaaagagtggagcttaagaccccactgggggacacaactcatacctgccccaggtgtcctgaaccaaaaagctgcgatacacccccgccttgtccccggtgcccagagcctaagtcctgtgacacacccccaccctgccctcgctgcccagagccgaagtcttgtgatactccccctccatgccccagatgtcctgctccagaattgctcggaggccccagcgtatttctgttcccgcctaaaccaaaggacacgttaatgatttcaaggacacccgaggtgacctgcgtcgtggttgacgtgagtcacgaagatcctgaggtccagtttaaatggtatgtggacggtgtagaggttcacaatgcaaagactaaaccccgggaggaacaattcaactccacctttcgcgtggtcagcgtgctgacagtcctccaccaggattggcttaatgggaaggaatacaaatgtaaggtgtctaacaaggccctgccagctcctatcgagaaaaccatatcaaagactaaaggacagccccgagaaccacaggtttacacattgccgcctagtagagaggagatgacgaagaatcaagtgagcctaacctgcctggtaaaaggcttctatccctccgacatcgccgtcgaatgggagtcttcgggccagccagaaaacaattacaacactacaccccctatgctcgatagcgacgggtcctttttcctgtattcaaaacttaccgtggataagagtaggtggcagcaaggaaatattttctcttgtagcgttatgcatgaggcgctgcacaaccggtttacacagaaatccttgtcactcagcccaggtaag

SEQ ID NO: 24024 - RNA, 702 nt, synthetic construct
  misc_feature 1..702: note = derived and/or modified sequence opt3 from anti-rabies_SOJA_LightChain
  source 1..702: mol_type = other RNA
atggaggcccccgctcagctcctgttccttctgttgttatggctgcctgacaccacaggcgaaatcgtgctaactcaaagcccagcaacgctctccctgtctccgggggagagagccacccttgcgtgcagggcttcacagacagccagtcggtacctggcatggtatcagcagaagcccggacaagcccctcgcttgctcatttacgatactagcaaccgagctaccggtataccagcacgtttttccggctctgggtcgggaacagacttcaccctgtcaatcagcagtctggaacccgaggattttgccgtctattactgtcagcagagattcaattggccttggacttttggccagggtacaaaagttgagttcaagaggaccgtggctgccccatccgtatttatttttcccccttctgacgaacaactcaaaagcgggacggcgtccgtggtctgcttactgaacaatttctatccacgggaggcaaaggtgcagtggaaagttgataacgcccttcagtcaggaaatagtcaggaaagcgtgactgagcaagactctaaggattccacctactcattgagcagtacactgactctatctaaggctgactatgaaaaacacaaggtctacgcctgtgaggtgacccatcagggcctctccagcccggtaacaaaatcgttcaaccgcggcgagtgc

SEQ ID NO: 24025 - RNA, 1422 nt, synthetic construct
  misc_feature 1..1422: note = derived and/or modified sequence opt3 from anti-rabies_SOJA_HeavyChain
  source 1..1422: mol_type = other RNA
atggagttcggcctgagctggctctttcttgtggccatcctgaagggggtccagtgcgaagttcaattgttagagtccggaggtggcctggtgcagcccgggggatctctaagactctcatgtgctgcaagtggcttcacctttagcaactacgccatgtcctgggtaaggcaggcgcctggtaaagggctggaatgggtgtctgctatttcggcctcaggacacagcacatatcttgcagacagtgtcaagggccggttcactatatcccgcgataattctaaaaacacgctgtacttgcagatgaatagcctccgagccgaggacaccgctgtgtattactgcgcaaaggatcgtgaagttacaatgatcgtggtcctgaacggcgggtttgactattggggacaaggtactagagtgaccgtatcctcagccagtacaaaaggcccaagcgttttcccgctggctccctcttccaagtcaaccagcgggggaactgccgcgctcggctgtttagtgaaggattactttcctgagccagtcacagtgagttggaactctggtgcactgacctccggggtgcatacgttccccgccgtccttcagagctcgggattgtattctctgtcctcagttgtgactgtacctagtagctccctaggcacccagacatacatttgcaatgtgaatcacaaaccatctaacactaaggtcgacaaaagggtggagcccaagagctgtgataaaacccatacatgccctccatgtccggctcccgaactcctgggcgggccttcagtttttcttttcccacccaagcctaaggacaccctgatgatcagtcggacgccagaggtgacttgcgtcgtggtagatgtttcccacgaagaccccgaggtgaaatttaattggtacgtcgatggagtggaggtccataacgccaagacaaaaccgcgcgaggaacagtataatagcacctacagagtggtttctgtgttgactgtactccaccaagactggctgaacggtaaggaatataaatgtaaggtctcaaataaagcattacctgctcccattgagaagacaatcagtaaggccaaaggccagccaagggaacctcaggtgtacaccctgcccccaagccgggaggagatgacgaagaaccaggtttcccttacctgcctcgtgaaagggttctatccctctgatatagcggtcgaatgggagtcgaatggacaacctgaaaacaactacaagacaactccaccggtgctggacagcgacggctcctttttcttgtattcaaaactaaccgtagataagagtcgctggcagcagggtaatgtgttctcttgtagcgttatgcacgaggccctgcataaccactacacacaaaagtccctctcactgagccccgggaaa

SEQ ID NO: 24026 - RNA, 321 nt, synthetic construct
  misc_feature 1..321: note = derived and/or modified sequence opt3 from anti-rabies_LightChain
  source 1..321: mol_type = other RNA
gtgatgacccagagccccgccacactgtccctctctcctggcgagagagctactctttcatgcagggcaagtcaaagcgtccggaactacctggcctggtatcagcagaagccagggcaggcgccgcgcttgttaatctacggagcttccaatcgagccacgggtattcccgcacgtttctctggctcggggtcaggaaccgactttacactgactataagcagtctagaacctgaggatttcgccgtttattactgtcaacagagatccgactggccactctcttttggccagggtaccaaactggaaatcaagaggaca

SEQ ID NO: 24027 - RNA, 333 nt, synthetic construct
  misc_feature 1..333: note = derived and/or modified sequence opt3 from anti-rabies_HeavyChain
  source 1..333: mol_type = other RNA
ggccccgcctgggaggtgcctgaaaccctgccagtccagccgctcgacagcccctccgttgctatggcatgcacaggggtgagacaagcccctggaaagggtcttgagtgggtagcggtgatctcttacgatggctcaaacaaatattacgctgacagtgtcaaggggaggttcactattagccgggataattccaaaaacacgctgtatttgcagatgaactctttacgcgccgaagacaccgcagtgtactattgtgccaaggattcaaattcgggaagctactatgctcacgacctgggctactggggtcaggggactctagttacagtg

SEQ ID NO: 24028 - RNA, 342 nt, synthetic construct
  misc_feature 1..342: note = derived and/or modified sequence opt3 from anti-rabies_LightChain
  source 1..342: mol_type = other RNA
gagctggtgatgacccagagccccctctcccttcctgtcacactgggccaaccagcctctatctcatgcagaagtagccagtccttgattcactctaacgggaatacttacttaaactggttccagcagaggccgggacaatcgccccggcgcctgatatataaggtttcagaccgagatagcggtgtgcctgaccgttttagtggctccgggtctggaacggatttcaccctaaaaatcagcagagtagaagctgaggacgtgggcgtctactattgtctccagggtacacattggccaaggacttttgggcagggaaccaagctggaaattaaacggaca

SEQ ID NO: 24029 - RNA, 351 nt, synthetic construct
  misc_feature 1..351: note = derived and/or modified sequence opt3 from anti-rabies_HeavyChain
  source 1..351: mol_type = other RNA
gtggtccagcccggcagaagcctgaggctctcctgcgccgcttctgggttcaccttttcaagttacgcaatgcactgggttcggcaagcccctggaaagggtcttgagtgggtggcggtaatcagctatgacggctccaacaaatactatgctgattctgtgaaggggcgcttcacaatttcgcgagacaattcaaagaacactctgtacttgcagatgaatagcttacgtgccgaagatacggcagtctattactgtgccagagacaaagctctggcagccaggcggggatattactactattacggcaccgatgtgtggggtcaggggactctagttacagtgagttcc

SEQ ID NO: 24030 - RNA, 648 nt, synthetic construct
  misc_feature 1..648: note = derived and/or modified sequence opt3 from anti-RSV_5ITB_LightChain
  source 1..648: mol_type = other RNA
agcgacatccagatgacccaatccccctctacactgtcagccagtgtgggcgatagagtcactattacgtgcagggctagccagtccatatcttcgtggctcgcatggtaccagcagaagcctgggaaagccccaaagttgctgatctatgacgcgtcaagccttgagagtggagttccgtcccggttctctggtagcggctccgggaccgaatttacattaactatttcaagtctgcaacccgatgacttcgctacctactattgtcagcagtacaacacatatagctggtggacctttggacagggcactaaagtggatatcaagcgcacagtagccgcaccttctgtgttcatttttccaccctccgacgagcaactaaaatcaggtaccgccagcgtcgtgtgcctcctgaataacttctaccctcgagaagctaaggttcagtggaaggtggataatgcacttcagagtgggaactctcaggagtccgtcacggaacaagacagcaaagattcgacttattctctgtcctcaaccttgacactcagtaaggccgactacgagaaacacaaggtgtacgcttgtgaggtaactcatcagggactgagctccccagttaccaaatcttttaatcgtggcgaatgc

SEQ ID NO: 24031 - RNA, 660 nt, synthetic construct
  misc_feature 1..660: note = derived and/or modified sequence opt3 from anti-RSV_5ITB_HeavyChain
  source 1..660: mol_type = other RNA
gtggagagcggcgggggactgatccagcccggtggctccctcagactttcttgcgccgtctcagggttcaccgttagtagcaagtacatgacatgggtgaggcaagctcctggaaaaggcctggaatgggtatccgtgatttatggtgggggatctacttactatgcagactcggtcgtgggccggtttacgatatcacgcgataacagcaagaataccttgtacttacagatgaacagtctgcgagccgaggacacagcggtttattactgtgcttcccgtctaggcgtgagagccactaccggggatctcgactattggggacagggtacactggtcaccgtgtctagcgcatccactaaaggcccatcagtattcccgcttgcccccagtagcaagtctacatccgggggaaccgctgcactgggctgcttggttaaagattactttcctgaaccagtgacggtctcatggaatagcggtgccctcaccagtggggtgcacactttccccgctgtgctgcagtcttccggactgtacagcctctcgtctgtcgttacagtgccttcctcaagtttaggcactcaaacctatatctgtaacgtaaatcataagccaagcaacacaaaggtggacaaaagggtcgagcccaagtcctgc

SEQ ID NO: 24032 - RNA, 639 nt, synthetic construct; identical to SEQ ID NO: 23996
  misc_feature 1..639: note = derived and/or modified sequence opt3 from anti-alpha-toxin_4U6V_LightChain
  source 1..639: mol_type = other RNA

SEQ ID NO: 24033 - RNA, 675 nt, synthetic construct
  misc_feature 1..675: note = derived and/or modified sequence opt3 from anti-alpha-toxin_4U6V_HeavyChain
  source 1..675: mol_type = other RNA
gaggtgcagctggtcgaaagcggcgggggactcgttcaacccggtggctcccttagactgtcttgcgccgcttcagggttcacctttagtagccacgacatgcattgggtgaggcaggcaacaggaaagggcttggagtgggtatccggtatcgggactgccggagatacgtactatcctgactctgtgaaaggccggttcaccatttcgcgcgaaaacgcgaaaaattcattatacctgcagatgaacagcctacgagctggcgatacagccgtctattactgtgcacgtgacagatatagtccaactgggcactactatggaatggatgtgtggggtcagggcaccacagttaccgtgtcctctgccagcactaaggggccgtccgtctttcccctcgctccttcaagtaagagcacatctggaggcaccgcagccctgggttgccttgtgaaagactacttcccagagcccgtaacggtttcctggaactcaggggctctgactagcggagtgcatacctttcctgccgtcttgcaaagttctggcctctactccctgagctcggtggtgacagtcccatcttcctcactgggcactcagacctatatatgtaatgttaatcacaagcccagtaacacaaaggtggataaaagggtagaacctaagagctgc

SEQ ID NO: 24034 - RNA, 879 nt, synthetic construct
  misc_feature 1..879: note = derived and/or modified sequence opt3 from anti-alpha-toxin_4U6V_Chain-A
  source 1..879: mol_type = other RNA
gccgacagcgatatcaacattaagaccggcacaactgacatagggtccaatacgaccgtgaaaacaggagatctggtcacttacgacaaggagaacggtatgcacaaaaaggttttctattcttttatcgatgacaaaaatcataacaagaagctccttgtgattagaaccaaaggcacaatcgctgggcagtacagggtatattcagaagagggagcaaataagagtggcctggcctggcccagcgcgttcaaagtgcaattgcagttacctgataacgaagtcgctcagatttccgactactatccacgcaattctatcgataccaaggagtacatgtcgactctgacatatggttttaacgggaatgtgaccggagacgatacgggcaaaataggcgggctaatcggagccaacgtttcaattggtcacactctcaagtacgtgcagccggacttcaagaccatcctggaaagccccacagataaaaaggtcggctggaaagtgatttttaataacatggtaaatcaaaactgggggccttacgaccgggacagttggaatccagtttatggaaaccagcttttcatgaagactcgaaacggctccatgaaagcagccgataattttctggaccccaacaaggcttctagcttgctctcctcaggtttcagtcctgattttgcaaccgtgatcacaatggaccgtaaagccagcaagcagcagaccaatatagatgtcatttacgagagagtgagggacgattatcaactgcattggacgtctactaactggaaggggacaaataccaaagacaagtggatcgatcggtcctcagagcgctacaaaattgactgggaaaaggaggaaatgactaac

SEQ ID NO: 24035 - RNA, 879 nt, synthetic construct; identical to SEQ ID NO: 24034
  misc_feature 1..879: note = derived and/or modified sequence opt3 from anti-alpha-toxin_4U6V_Chain-B
  source 1..879: mol_type = other RNA

SEQ ID NO: 24036 - RNA, 642 nt, synthetic construct
  misc_feature 1..642: note = derived and/or modified sequence opt3 from anti-IsdB_5D1Q_Chain-A
  source 1..642: mol_type = other RNA
gacatccagctgacccaaagcccctcctctgtgtcagccagtgtcggcgatagaattacaataacttgcagggctagccaggacatctccaactgggttgcatggtaccagcagaaacctgggaaagccccaaagctccttatttattctgcgtcgtcactgcaaagcggagtgccgagtcggttctccggttctggcagcgggacggattttaccttgacaatctcctcattacagcccgaggacttcgctacttactattgtcagcaggccaatacctttccttggacattcggacaaggcaccaaagtagaaattaagcgcactgtggcagccccaagtgtctttatctttccccctagcgatgagcagctgaaatctggtacagcttccgtggtttgcctactcaacaatttctacccacgagaagcaaaggtgcagtggaaggtcgacaacgccctgcagtcagggaatagccaagagagtgtgaccgaacaggattctaaagactccacgtatagcctttcgtctactctgaccttgtccaaggctgattacgagaaacacaaggtatatgcctgtgaggttacacatcagggactctcaagtcccgtgactaagagcttcaaccgtggcgaatgc

SEQ ID NO: 24037 - RNA, 783 nt, synthetic construct
  misc_feature 1..783: note = derived and/or modified sequence opt3 from anti-IsdB_5D1Q_Chain-B
  source 1..783: mol_type = other RNA
caggtgcaactggtccagagcggcgccgaggttaagaaacccgcttcctctgtgaaggtatcatgccaggcaagtgggggaagtttctccaccagaacaatctcttggctcaggcaggcccctggtcaaggccttgaatggatgggagggatttcgccaatatttggcgcggctaactacgcccagcggttccagggtcgcgtgactatcacggcagacaaatcaaccagcacagcctatatggagctgactagcttgacctccgaagatacagctgtctactattgtgcacgagaccgtccgcccggggcccagtttgatacctggggacaaggcactttagtgacagtttctagcgcttccaccaagggcccttcagtgttcccactggcccccagtagcaaatctacgtccgggggaactgcggcactaggttgcctcgtcaaggactactttcctgagccagtgaccgtatcatggaatagcggcgccctgacaagtggggttcacactttccccgctgtgcttcagtcttccggactgtatagcttgtcgtctgtcgtgaccgtgccttcctcaagtctcggcacacagacctacatttgtaacgtcaatcataagccaagcaacacgaaagttgataagaaagtggaaccgaagtcctgcggtgggggatctggccaccatcaccatcaccaccatcaccatcacggcggggactataaagatcacgacggagattacaaggaccatgatatcgactacaaggatgacgacgataaa

SEQ ID NO: 24038 - RNA, 822 nt, synthetic construct
  misc_feature 1..822: note = derived and/or modified sequence opt3 from anti-IsdB_5D1Q_Chain-C
  source 1..822: mol_type = other RNA
gaggtgcagctggtcgaaagcggcgggggactcgttcaacccggtggctcccttaccctgtcttgcgccgcttcagggttgatcttcagtgacagcacaatgcactgggtgagacaggcatccggaaggggcttagagtgggtagcccggattcgctctaaggcgaacaattacgctacttcgtcagataaaagcgccacggcatatctggccagtgtgaagggtcgatttaccatatcccgtgacgattctaaagacacaactttcctagaaatgagctccctcaagatcgaggataccgctgtctactattgtattgcatcaagtacaaccgggtggtacgtgagagaagactttgattattggggacatggcactctggttacagtgagctctgcctccaccaaaggcccttcagtcttcccacttgctccgagcagtaagtctacgtccgggggaactgccgcgctgggttgcttggtgaaggactactttcccgagcctgtaaccgttagctggaactcgggcgcactcacatctggggtgcacactttcccagccgtcctgcagtcctcaggactgtatagtctcagctccgtggtgaccgtcccctctagctcattaggcacacagacctacatctgtaatgttaaccataaacctagtaatacgaaggtggataaaaaggtagagccaaaatcctgcggtgggggaagcggccaccatcaccaccatcaccatcaccaccatggcggggactacaaggatcacgacggagattataaggaccatgacattgattacaaagacgatgacgataag

SEQ ID NO: 24039 - RNA, 648 nt, synthetic construct
  misc_feature 1..648: note = derived and/or modified sequence opt3 from anti-IsdB_5D1Q_Chain-D
  source 1..648: mol_type = other RNA
gagatcgtgctgacccagagccccggcacactctccctttctcctggggaaagagccactctgtcatgcagggctagtcaaagcgtctcctcttcgtacttggcatggtatcagcagaaaccaggacaggccccgcggttactgatttacggtgcgtcaagccgcgctacgggcatacccgaccgattcagtgggtccggatctggcaccgattttacactaagcatctcccgtctcgagcctgaagacttcgccgtttattactgtctgcactatggtacttcaccaatgtacacctttgggcaaggaacaaaacttgagattaagagaaccgtggcagcccccagtgtattcatctttcctccaagcgatgaacagctgaaatctggcactgcttccgtggtctgcttgctcaacaatttctatcccagggaggcaaaggtgcagtggaaagttgacaacgccctgcagtcaggcaatagccaagagagtgtgacagaacaggattctaaggactccacctacagcctgtcgtctacgctcactttatccaaggctgattacgagaaacataaggtctatgcctgtgaagtgacccaccaggggctgtcaagtcctgtaacaaagagctttaaccggggagagtgc

SEQ ID NO: 24040 - RNA, 360 nt, synthetic construct
  misc_feature 1..360: note = derived and/or modified sequence opt3 from anti-IsdB_5D1Q_Chain-E
  source 1..360: mol_type = other RNA
cccggcaagatgaccgacctgcaggatacaaaatacgtggtctatgagagcgttgaaaacaatgagtccatgatggacactttcgtgaagcaccctatcaaaacggggatgctcaacggaaagaaatacatggtaatggaaaccacaaatgatgactattggaaggattttatggtggagggtcaaagagtcaggactatttctaaggacgccaaaaacaatacccggacaataatcttcccatacgtggaaggcaagaccctttatgatgctattgttaaagtgcatgtcaagactatcgactacgatgggcagtatcacgtgcgcattgtagacaaagaggcatttacaaaggccaac

SEQ ID NO: 24041 - RNA, 657 nt, synthetic construct
  misc_feature 1..657: note = derived and/or modified sequence opt3 from anti-IsdB_5D1X_Chain-A
  source 1..657: mol_type = other RNA
gacatcgtgatgacccagagccccctgtccctccctgtcacacttggccaaccagcctctatttcatgcagtagcgctcagtccctggttcactctgatggggactcgtacttgacttggttccatcagagaccgggacagtcacccaggcggttaatatataaggtgagcatccgcgatgcaggggtacctgaccgatttagtggctccgggtctggaacggatttcaccctgaaaattagccgtgtggaggccgaagacgtcggcgtgtactattgtatgcaagcgacacactggccatacacttttggtcaggggaccaagctagagatcaaaagaacagttgctgccccctccgtgttcatttttcctccatcagatgaacagctcaagagtggaaccgcaagcgtcgtgtgcctgcttaacaatttctatcccagggaggccaaagtacagtggaaggttgacaacgctctgcaatctggcaattcccaggaatcagtgactgagcaggatagcaaggacagtacatactctttgtccagcaccctcacgctgtcgaaagcagattatgagaagcataaagtctacgcctgtgaagtgactcaccagggcctgtcttcccctgtgaccaagtcatttaaccggggtgagtgc

SEQ ID NO: 24042 - RNA, 777 nt, synthetic construct
  misc_feature 1..777: note = derived and/or modified sequence opt3 from anti-IsdB_5D1X_Chain-B
  source 1..777: mol_type = other RNA
caggtgcaactggtccagagcggctccgaggttaagaaacccgggtcttcagtgaccctcagttgcaaggccagcggagacacattcaacactcacacgtactcctgggtaagacaggctcctggtcagaggcttgaatggatcggcgggattatgccaatatttgcagcctctaaatcggcgccgcatctgcaagatcggttgaccatcacagctaataaggccactcgcaccgcatatatggagttaacatcactgaccagcgacgatagtggagtgtactattgtgcccgagacggccgtggtgctctacagtactgggggcagggaactctcgtcacagtgtcctctgcaagcaccaaaggcccctccgttttccctctggccccatcaagtaagagcacgtctggcgggactgctgcccttggatgcctggtgaaggattattttcccgaacctgtcaccgtgtcctggaactcaggtgcgttgacaagcggcgtacacactttcccagcagttctccagagttctgggctgtactccctgagctcggtggtcaccgtgccctcttcctcactcggaacacaaacctatatttgtaatgtgaaccataaacctagtaatacgaaggtcgacaaaaaggttgagccaaaaagctgcggcggtgggtccggacaccatcaccaccatcaccatcaccaccatggcggcgattacaaggaccacgatggggactacaaggatcatgacatcgattataaagacgacgatgacaag

SEQ ID NO: 24043 - RNA, 822 nt, synthetic construct; identical to SEQ ID NO: 24038
  misc_feature 1..822: note = derived and/or modified sequence opt3 from anti-IsdB_5D1X_Chain-C
  source 1..822: mol_type = other RNA

SEQ ID NO: 24044 - RNA, 648 nt, synthetic construct
  misc_feature 1..648: note = derived and/or modified sequence opt3 from anti-IsdB_5D1X_Chain-D
  source 1..648: mol_type = other RNA
gagatcgtgctgacccagacacccgccactctcagccttacgcctggcgaaagagctaccctgacatgcagggcatcccaatctgtctcaagtagctacttggcctggtatcagcagaagccagggcaggcgccgcggttactgatttacggagcttcctctcgcgccactggtatacccgaccgattctcgggctcagggagcggaaccgattttacactaagtatctcccgtctcgagcctgaagacttcgcagtttattactgtctgcactatggcacctctccaatgtactttttcggtagagggactgtgcttgatattaaaaggacagtagccgctcccagcgtgtttatcttccctccatccgacgagcaactgaagtcaggaaccgcaagtgtcgtgtgcttgctcaacaatttttatccccgggaagccaaagttcagtggaaggtggataacgctctgcagagcggcaattctcaggagtccgtcacggagcaagactcaaaagatagcacttacagtctgtcttccaccctcacattaagcaaggccgactacgaaaagcataaagtgtatgcgtgtgaggtaactcaccagggcctgtcgtctcctgttaccaagtccttcaaccgcggggaatgc

SEQ ID NO: 24045 - RNA, 354 nt, synthetic construct
  misc_feature 1..354: note = derived and/or modified sequence opt3 from anti-IsdB_5D1X_Chain-E
  source 1..354: mol_type = other RNA
aagatgaccgacctgcaggatacaaaatacgtggtctatgagagcgttgaaaacaatgagtccatgatggacactttcgtgaagcaccccatcaaaacgggcatgctcaacgggaagaaatacatggtaatggaaaccacaaatgatgactattggaaggattttatggtggagggacaaagagtcaggactatttctaaggacgccaaaaacaatacccggacaataatcttcccttacgtggaaggtaagaccctttatgatgctattgttaaagtgcatgtcaagactatcgactacgatggccagtatcacgtgcgcattgtagacaaagaggcatttacaaaggccaac

SEQ ID NO: 24046 - RNA, 792 nt, synthetic construct
  misc_feature 1..792: note = derived and/or modified sequence opt3 from anti-IsdB_5D1Z_Chain-B
  source 1..792: mol_type = other RNA
gccgaggtgcagctggtcgaaagcggcgggggagttgtgcaacccggtggctccctcagactttcttgcgctgcatcagggttcacctttaacaagttctggatgaattgggtaaggcaggcccctggaaaaggcctggagtgggtggcggacatccaggtcgatggtagtgaaaagaactacgtggacagcgttaaagggcggtttacaatttcccgcgataatggaaagaactctttgtatttacagatgaactcgctgcgagctgaggacactggcgtgtactattgtgcccgtggcagatacgattattggtcagggtacctaagcccatggggacaaggtacgctcgtcaccgtgagttccgcatctacaaaaggcccgagcgtattccccctggccccttcctcaaagagtactagcgggggaaccgctgcacttggctgcctggttaaggactattttccagaacccgtgacagtctcttggaactccggtgccttgacctcaggggtgcacactttccctgctgtgctccagagcagtggactgtactctctgtccagcgtcgttacagtgccatcgtcttccctcggcacccagacgtacatatgtaatgtaaatcataaaccctcaaatactaaggtggataaaaaggtcgagcctaaaagttgcggcgggggaagcggtcaccatcaccatcaccaccatcaccatcacggcggggactataaggatcacgacggagattacaaggaccatgatatcgactataaagacgatgacgataag

SEQ ID NO: 24047 - RNA, 642 nt, synthetic construct
  misc_feature 1..642: note = derived and/or modified sequence opt3 from anti-IsdB_5D1Z_Chain-C
  source 1..642: mol_type = other RNA
gacatccagctgacccaaagcccctccttcctctctgcctcagtggctgatagagtcacaattacttgcagggcaagtcaggccgttcggagctcccttgcgtggtaccagcagaagcctggcaaagctccacaactgttgatatattctgcctcgacgttagagaacggggtgtcaagccgctttagtggatccggtccgggcaccgagttcacactgactatctctagcctacagcccgaagacgtagggacctactattgtcagcagctcaatacatacccttttaccttcggaccaggcactaaggtggaaattaaacgaacagtcgcagccccctccgtgtttatcttccctccatcagatgagcaactgaagagtggtaccgctagcgttgtgtgccttctgaacaatttttatccccgtgaagcaaaagtccagtggaaggtggacaacgccttgcagtctggaaattcccaggagtcagtaacggagcaagatagcaaggacagtacttactctctctccagcaccctgacactgtcgaaagctgattatgaaaagcacaaagtttacgcctgtgaggtgactcatcaggggctctcttcccctgtcaccaagtcattcaacagaggcgaatgc

SEQ ID NO: 24048 - RNA, 810 nt, synthetic construct
  misc_feature 1..810: note = derived and/or modified sequence opt3 from anti-IsdB_5D1Z_Chain-D
  source 1..810: mol_type = other RNA
caggtgcaactgcaggagagcggccccgggctcgtcaagccttccgaaaccctttctctgatctgcacagtttcaggaggtagtattagctcctcttcgtactattggggctggataagacagactccagagaggaacttggaatggatcgggattatctacttctcaggaacgacctattacaatccgagcttacagagtcgggtgtccatgtctctggaccgcagcacaaaccgattttccctacgtctctcaagtgtaactgccgctgataccgcaatttattactgtgccaaacccaagagcagagacaggggcggtcctggggatgactatttcggaatggatgtgtggggccaaggcatcatggtcacagtgtcttccgcgtcaaccaaagggccaagcgtttttcccctggctcctagttctaagtccactagcggaggtacagccgcacttggctgcctggtgaaagactacttcccagagcccgtcaccgtgtcgtggaactctggggccttgacgtccggagtacacacttttcctgctgttctccagtcaagtggcctgtacagcctgtcctctgtggtcaccgtgccaagctcaagtctcggtacacagacttatatatgtaatgtgaatcataagccgtccaacaccaaggtcgataaaaaggttgaacccaaaagctgcgggggaggctctggccaccatcaccatcaccaccatcaccatcacgggggagactacaaggatcacgacggtgattataaagaccatgatatcgactacaaggacgatgacgataag

SEQ ID NO: 24049 - RNA, 810 nt, synthetic construct; identical to SEQ ID NO: 24048
  misc_feature 1..810: note = derived and/or modified sequence opt3 from anti-IsdB_5D1Z_Chain-F
  source 1..810: mol_type = other RNA

SEQ ID NO: 24050 - RNA, 792 nt, synthetic construct; identical to SEQ ID NO: 24046
  misc_feature 1..792: note = derived and/or modified sequence opt3 from anti-IsdB_5D1Z_Chain-G
  source 1..792: mol_type = other RNA

SEQ ID NO: 24051 - RNA, 642 nt, synthetic construct
  misc_feature 1..642: note = derived and/or modified sequence opt3 from anti-IsdB_5D1Z_HeavyChain
  source 1..642: mol_type = other RNA
gacatccagatgacccaaagcccctccttcctgtctgcctcagtgggcgatagggtcacaattacttgcagggctagtcaggggataacgacctacctcggatggtatcagcagcggcctggtaaggcaccacaacttctgatctacgccgcgagctccttgcagtctggcgttccgccccgcttttcggggtcaggaagcggcacagagttcactttaaccattagttccctgcagcctgaagactttgctacatattactgtcagcaactaaacacctatccatacactttcggtcccgggacacgactcgagatcaaacgtaccgtggccgcaccttctgtatttattttcccacccagcgatgaacagctgaagtccggaacggcctcagtggtctgccttctgaataacttttatcctagagaggctaaagtgcagtggaaggttgacaatgcattgcagagtggcaacagccaagaatctgtgactgagcaggattccaaagactcaacctacagcctcagttctacactgactctgtccaaggccgattacgagaagcacaaagtctatgcttgtgaagtgacccatcagggcctcagctcgccagtaacaaagtctttcaatagaggggagtgc

SEQ ID NO: 24052 - RNA, 471 nt, synthetic construct
  misc_feature 1..471: note = derived and/or modified sequence opt3 from anti-IsdB_5D1Z_Chain-I
  source 1..471: mol_type = other RNA
ggccccgccaaggctaccaacaatacataccctatcctgaaccaggagctcagagaagcaattaaaaatccagccataaaggacaaagatcacagcgcgccgaactccaggcccatcgacttcgagatgaagaaaaaggatgggactcaacagttttatcattacgcttcttcagtgaagcctgcccgggtcattttcacggacagtaaaccagaaatcgagcttggactgcagagcggtcagttttggcgcaagttcgaagtttatgagggcgataaaaagttgcccattaaattagtgtcctacgacaccgtaaaggattatgcatacatccgattttctgtgtcgaatgggacaaaggccgtcaaaatagtgtcaagcactcacttcaacaataaggaggaaaaatatgactacaccctgatggagtttgctcaacctatctacaacagtgcagataagttcaaaaca

SEQ ID NO: 24053 - RNA, 324 nt, synthetic construct
  misc_feature 1..324: note = derived and/or modified sequence opt3 from anti-HIV_b12_LightChain
  source 1..324: mol_type = other RNA
gagatcgtgctgacccagagccccggcacactctccctttctcctggggaaagagccactttctcatgcaggagtagccactccattcggtctcgccgagtcgcttggtaccaacataagccaggacaggcaccgcgtctggttatacacggtgtgtcgaacagagcctcaggcatcagcgacaggtttagtgggtccggatctggcacggatttcaccttgacaattactcgggtagagcccgaagactttgcgttatattactgtcaggtgtatggtgctagctcctacaccttcgggcagggaacaaaactggagcgcaag

SEQ ID NO: 24054 - RNA, 381 nt, synthetic construct
  misc_feature 1..381: note = derived and/or modified sequence opt3 from anti-HIV_b12_HeavyChain
  source 1..381: mol_type = other RNA
caggtgcaactggagcagagcggcgccgaagtcaagaaacccggggcttccgttaaggtgtcttgccaggcatcaggatacagattcagtcactttaccgtacattgggtgaggcaggcccctggtcaacggttcgagtggatgggctggatcaacccatataatgggaacaaagaatttagcgcgaagttccaggaccgcgtcacatttactgctgatacgtccgccaataccgcatacatggagctccgatctcttcgttcggccgacacagctgtgtattactgtgcaagagttggagaatggggctgggatgactcaccgtatgataactactatatggacgtgtggggtaaagggactaccgtcattgtgagcagt

SEQ ID NO: 24055 - RNA, 633 nt, synthetic construct
  misc_feature 1..633: note = derived and/or modified sequence opt3 from anti-HIV_2G12_LightChain
  source 1..633: mol_type = other RNA
gtggtcatgacccagagcccctccacactgtctgcctcagttggcgacactatcacgattacctgcagagctagtcaaagcatagagacatggctcgcatggtaccagcagaagcctgggaaagccccaaaacttctgatctataaggcgtccactttgaagaccggagtgccgtctaggttctcgggttcaggcagcgggacagaatttaccttaactattagtggactgcagttcgatgactttgctacataccactgtcaacattatgccggctactccgcaaccttcggtcaggggacgcgggtagagatcaaacgcactgtggccgctccctctgtctttattttccctccaagcgatgaacagctaaagtccggaaccgcatcagtggtttgcctcctgaacaatttttatccccgagaggccaaggtgcagtggaaagtcgacaacgcccttcaaagtggcaatagccaggaatctgtgacagagcaggattccaaggactcaacttacagcctgagttctaccttgacactctccaaagctgattatgagaagcacaaagtatacgcgtgtgaagttacccatcagggcctgagctcgcctgtgacgaagtctttcaaccgtggg

SEQ ID NO: 24056 - RNA, 672 nt, synthetic construct
  misc_feature 1..672: note = derived and/or modified sequence opt3 from anti-HIV_2G12_HeavyChain
  source 1..672: mol_type = other RNA
gaggtgcagctggtcgaaagcggcgggggactcgttaaggccggtggctcccttatcctgtcttgcggggtgtcaaacttcagaattagtgctcacaccatgaattgggtaaggcgggtgcccggaggcggtttggagtgggtcgcaagcatatccacatcttcgacttaccgcgactatgccgatgcggtgaaagggcgatttacggtttcacgtgacgatttagaagacttcgtgtacctgcaaatgcataagatgagagtcgaggataccgctatctattactgtgccaggaaaggaagcgaccggctaagtgataacgacccttttgatgcatggggcccaggcacagtggtaactgtttccccggcctctaccaaggggcccagcgtgttccctctcgctccatcctcaaaaagtacaagcggaggtaccgcagccctgggctgccttgtcaaggactattttcccgaacctgtgactgtgtcttggaactccggggctctgacatcaggagtccacaccttcccagccgttttgcagagcagtggcctctactctctgtccagcgtggtaacggtgccctcgtcttccctgggtactcagacctatatttgtaatgtcaatcataagccttcaaacacaaaagtggataagaaagttgagccaaag

SEQ ID NO: 24057 - RNA, 642 nt, synthetic construct
  misc_feature 1..642: note = derived and/or modified sequence opt3 from anti-HIV_4E10_LightChain
  source 1..642: mol_type = other RNA
gagatcgtgctgacccagagccccggcacacaatccctctctcctggggaaagagccactctttcatgcagggctagtcagagcgtcggaaacaataagctggcatggtaccagcagcggccaggtcaagccccgcgcttgttaatttatggcgcgtcctctcgaccctcgggggttgctgaccgtttctcaggaagcggcagtggtacggattttaccctgacaatatccagactagagcctgaagacttcgccgtgtactattgtcagcagtacgggcagtctctcagcacttttggacaaggcaccaaagtagaggtgaagaggacagtcgcagccccatccgtgttcatctttcccccttcagatgaacagctgaaaagtggcaccgctagcgttgtgtgccttctgaacaatttctatccacgggaggcaaaggtccagtggaaagtggacaacgccttgcagtctggaaattcccaagagtcagtaactgaacaggatagcaaggacagtacatactctctctccagcaccctgacgctgtcgaaggctgattatgagaaacacaaggtttacgcctgtgaagtgactcatcaggggctctcttcccccgtcaccaaatcatttaaccgcggtgag

SEQ ID NO: 24058 - RNA, 684 nt, synthetic construct
  misc_feature 1..684: note = derived and/or modified sequence opt3 from anti-HIV_4E10_HeavyChain
  source 1..684: mol_type = other RNA
caggtgcaactggtccagagcggcgccgaggttaagagacccgggtcctctgtgaccgtatcatgcaaagctagtggaggtagcttctccacatacgcactctcttgggtgaggcaggcccctggccgggggcttgaatggatgggaggcgtcatcccactgttgactattacgaactatgcgccgcgctttcagggtcgaataaccatcacagctgaccgttcgacttcaaccgcctacttagagctgaatagcctaagacccgaagatacagcagtgtattactgtgccagggaggggaccactggatggggctggctcggcaagcctattggggctttcgcacactggggacaaggtacactggttaccgtgagttccgcctctacgaaaggcccaagcgtctttccccttgctccttcctcaaagagtactagcgggggaaccgccgcgctgggctgcttggtgaaagactatttcccagaacccgtaacagtttcttggaactccggtgcactcacttcaggggtgcatacctttcctgccgtcctgcagagcagtggactgtactctctctccagcgtggtgacagtcccatcgtcttccttaggcacccagacgtatatctgtaatgttaaccacaagccgtcaaatactaaggtggataaaaaggtagagcccaaa

SEQ ID NO: 24059 - RNA, 312 nt, synthetic construct
  misc_feature 1..312: note = derived and/or modified sequence opt3 from anti-HIV_VRC01_LightChain
  source 1..312: mol_type = other RNA
gaaatcgtgctgacccagagccccggcacactctccctttctcctggggaaactgccattatatcatgcagaacgagtcaatacggaagcctggcttggtatcagcagaggccaggtcaggcaccgcggttggtcatctactccggctctacccgcgccgcggggattcccgaccgattctcgggatcacgttggggccctgattataacttaacaatcagcaatctggagagtggtgactttggggtttactattgtcaacagtacgagttctttggacagggcactaaggtgcaggtagatattaaaaga

SEQ ID NO: 24060 - RNA, 363 nt, synthetic construct
  misc_feature 1..363: note = derived and/or modified sequence opt3 from anti-HIV_VRC01_HeavyChain
  source 1..363: mol_type = other RNA
caggtgcaactggtccagagcggcgggcagatgaagaaacccggagagtccatgagaatctcttgcagggcctcaggttacgagttcattgactgtaccctcaactggatacggcttgctcctggcaagcgcccagaatggatggggtggctgaaaccgcgaggaggcgcagttaattatgcccgtcccttgcagggtagagtgacaatgactagggatgtatacagtgacacggcgtttttagaactgcggagcctaaccgtggatgacacagctgtctatttctgcactcgcgggaagaactgtgattacaattgggactttgagcactggggaagaggcacccctgtgatcgtttcctct

SEQ ID NO: 24061 - RNA, 330 nt, synthetic construct
  misc_feature 1..330: note = derived and/or modified sequence opt3 from anti-HIV_PG9_LightChain
  source 1..330: mol_type = other RNA
cagagcgccctgacccaacccgcttccgtgtctggctcacctgggcagagtatcacaattagctgcaacggaacttccaatgacgtcggtggctacgagtctgtttcgtggtatcagcagcacccagggaaggcaccgaaagtggtaatatacgatgtgtcaaagagacccagcggagtcagtaacaggttctccggctctaaaagcggtaatacggcctccctcaccatctcagggcttcaagcggaagacgagggagattattactgtaagagtctgacaagcactcggcgccgagtgtttggcaccggcacaaaattgaccgtttta

SEQ ID NO: 24062 - RNA, 408 nt, synthetic construct
  misc_feature 1..408: note = derived and/or modified sequence opt3 from anti-HIV_PG9_HeavyChain
  source 1..408: mol_type = other RNA
cagagactggtggagagcggcgggggagtcgttcaacccggttcctctctcaggctttcatgcgccgctagtggcttcgactttagccggcaggggatgcactgggtgcgccaggcacctggacagggcctggaatgggtagccttcatcaagtacgatggttccgagaaatatcatgcggactctgtgtgggggcgattgtcgatttcacgtgataacagcaaggacaccttatacctgcaaatgaatagtctaagagtcgaagatacagctacttatttttgtgtgagggaggccggaggcccagactaccggaacggctataattactatgatttctacgacgggtactataactaccactatatggatgtttggggaaaaggtacgaccgtgacagtctcctct

SEQ ID NO: 24063 - RNA, 630 nt, synthetic construct
  misc_feature 1..630: note = derived and/or modified sequence opt3 from anti-HIV_VRC07_LightChain
  source 1..630: mol_type = other RNA
gagatcgtgctgacccagagccccggcacactctccctttctcctggggaaactgccattatatcatgcagaacgagtcaatacggaagcctggcttggtatcagcagaggccaggtcaggcaccgcggttggtcatctactccggctctacccgcgccgcggggattcccgaccgattctcgggatcacgttggggccctgattatacattaactatcagcaacctggagagtggtgactttggggtttactattgtcaacagtacgagttctttggacagggcaccaaggtgcaggtagatattaaaagaacagtggctgccccatccgtcttcatctttcccccttctgacgaacaactaaagagcggcaccgcatccgtggtttgcctcctgaataacttctatccaagggaagccaaagtgcagtggaaggtcgataatgcacttcagtcagggaacagtcaggagagcgtgactgagcaagactctaaagattccacatactcactgagcagtaccttgacgctctctaaggctgactacgaaaagcacaaagtatatgcctgtgaggttactcatcagggactgcggtcccccgtgaccaagagctttaatcgcggtgaatgc

SEQ ID NO: 24064 - RNA, 375 nt, synthetic construct
  misc_feature 1..375: note = derived and/or modified sequence opt3 from anti-HIV_VRC07_HeavyChain
  source 1..375: mol_type = other RNA
caggtgcaactggtccagagcggcgggcagatgaagaaacccggagagtccatgagaatctcttgcagggcctcaggttacgagttcattgactgtaccctcaactggatacggcttgctcctggcaagcgcccagaatggatggggtggctgaaaccgcgaggaggcgcagttaattatgcccgtcccttgcagggtagagtgacaatgactagggatgtatacagtgacacggcgtttttagaactgcggagcctaacctccgatgacacagctgtgtatttctgcactcgcgggaagtactgtaccgccagagattattacaactgggactttgagcactggggacaaggcacacctgtcatcgtgtcttcg

SEQ ID NO: 24065 - RNA, 315 nt, synthetic construct
  misc_feature 1..315: note = derived and/or modified sequence opt3 from anti-HIV_3BNC117_LightChain
  source 1..315: mol_type = other RNA
gacatccagatgacccaaagcccctcctctctgtcagccagtgtgggcgatacagtcactattacgtgccaggctaacgggtacctcaattggtatcagcagagaaggggaaaggcacctaaacttctgatatacgacggtagcaagttggaacggggcgttccatcccgcttctctgggcgacgttggggacaagaatataacttaaccatcaataacctgcagccggaggatattgccacatacttttgtcaggtgtatgagttcgtagtgcccggcactagactagacctcaaaaggaccgtcgcggctcct

SEQ ID NO: 24066 - RNA, 387 nt, synthetic construct
  misc_feature 1..387: note = derived and/or modified sequence opt3 from anti-HIV_3BNC117_HeavyChain
  source 1..387: mol_type = other RNA
caggtgcaactgctccagagcggcgccgctgtcaccaagcccggggcatccgttagagtgtcttgcgaggcctcaggatacaacatcagggactatttcattcactggtggcggcaggcgcctggtcagggccttcaatgggtagggtggataaatccaaaaacaggacagccgaacaatccccgccagtttcagggccgagtgagtctgactcgtcatgctagctgggatttcgacacgttttccttctacatggatttgaaggccttaagatctgacgataccgcagtctatttttgtgccaggcaacggtcggactactgggatttcgacgtgtggggttcagggacacaggttactgtgagcagtgcttccaccaaaggacct

SEQ ID NO: 24067 - RNA, 324 nt, synthetic construct
  misc_feature 1..324: note = derived and/or modified sequence opt3 from anti-HIV_10-1074_LightChain
  source 1..324: mol_type = other RNA
agctacgtgagacccctgtccgtcgccctcggcgagaccgctaggatctcttgcgggcggcaggcacttggatcacgcgccgttcaatggtatcagcaccgacctggtcaggcgccaattctgttgatatacaacaatcaggaccgtccgagtggcatccccgaaagattcagcgggacacctgatattaactttggaactagggctacgttaaccatctccggcgtggaggccggtgacgaagcagattattactgtcatatgtgggactctcggtcggggttctcatggagctttggaggcgccacacgcctgactgtacta

SEQ ID NO: 24068 - RNA, 396 nt, synthetic construct
  misc_feature 1..396: note = derived and/or modified sequence opt3 from anti-HIV_10-1074_HeavyChain
  source 1..396: mol_type = other RNA
caggtgcaactgcaggagagcggccccgggctcgtcaagccttccgaaaccctttctgttacatgctcagtgagtggagacagcatgaacaattactattggacttggatcagacagtccccaggtaaaggcctggagtggattgggtacatatctgatagggaatcggccacgtataacccgtcattgaatagccgggtagtgatcagtcgcgacacctccaagaaccagttatctctgaaactaaatagcgtcacacccgctgatactgcagtgtactattgtgccaccgcgcgacgtggacaaagaatttacggcgttgtgtccttcggtgagtttttctattactactcaatggacgtctgggggaagggaacaaccgtgactgtaagtagc

SEQ ID NO: 24069 - RNA, 633 nt, synthetic construct
  misc_feature 1..633: note = derived and/or modified sequence opt3 from anti-HIV_PGT121_LightChain
  source 1..633: mol_type = other RNA
agcgacatctccgtggcccccggcgagaccgctagaatttcttgcggggaaaagtcactgggaagtagggcagtccagtggtaccaacaccgggccggtcaggcgcctagcctcataatctataacaatcaggatcgcccatccggcattccggagcgattctctgggtcgcccgactcaccttttggaacaactgctacgcttaccatcacaagcgttgaagccggcgatgaggcagactactattgtcatatttgggatagtcgtgtgccaactaaatgggtattcggtgggggaaccacactgaccgtgttgggccagcccaaggccgctccttccgtcactttatttccaccctctagcgaagaactgcaagcaaacaaagccaccctagtgtgcctcatctccgacttctaccctggcgctgttacagtggcctggaaggcggattcaagtccagtcaaagcaggggtggagacgactaccccgagcaagcagtctaataacaagtatgccgcttcctcatacctgagccttacacccgaacagtggaaaagtcacaagtcttattcctgtcaggtaactcatgagggaagcaccgttgagaaaacagtggcccctaccgagtgctcg

SEQ ID NO: 24070 - RNA, 705 nt, synthetic construct
  misc_feature 1..705: note = derived and/or modified sequence opt3 from anti-HIV_PGT121_HeavyChain
  source 1..705: mol_type = other RNA
cagatgcaactgcaggagagcggccccgggctcgtgaagccttccgaaaccctttctctgacatgctcagtcagtggagccagcatctccgactcttactggtcgtggattagaaggtcaccaggtaaaggcttggagtggatagggtatgttcacaagagcggagatactaactacagtccgtccttaaaatctcgggtgaatctgagcctagacacgtccaagaaccaggtatcactcagtctggtggctgcaaccgccgcggatagcggcaaatattactgtgctcgcacacttcatggtcgacgtatctatgggattgtcgccttcaatgaatggtttacttacttctatatggacgtgtggggaaacggcacccaggttacagtgtcttccgcatcaaccaagggccccagcgtctttcctctggccccaagttctaagtccactagcgggggaacagctgcattgggttgcctcgtgaaagattacttccccgagcctgtaaccgtttcgtggaactctggcgccctgacgtccggggtgcacacttttccagctgtcctgcaatcaagtggactctacagcttatcctctgtggtgaccgtccccagctcaagtctgggcacacagacttatatctgtaatgttaatcataagccttccaacaccaaagtggacaagagagtagaaccaaaaagctgc

SEQ ID NO: 24071 - RNA, 657 nt, synthetic construct
  misc_feature 1..657: note = derived and/or modified sequence opt3 from anti-HIV_PGDM1400_LightChain
  source 1..657: mol_type = other RNA
gacttcgtgctgacccagagcccccactccctctctgtcacacctggcgagtcagccagtatcagctgcaagtcctctcattcgcttattcacggggatcggaacaattacctggcttggtatgttcaaaaaccaggaaggtcaccgcagttgttaatatacctggcaagcagtcgggcctccggtgtgcccgaccgcttttctggcagcgggtccgataaggacttcactctaaaaatctcacgagtagaaacggaggatgtgggaacctattactgtatgcagggccgtgaaagtccttggacatttggtcaggggactaaggtcgacattaaaagaaccgtggcggctccaagcgttttcatctttcccccttctgatgagcaactcaagtccggaacagcctcagtggtctgcctgcttaacaatttctatccaagggaagcaaaggtgcagtggaaagtagacaacgccctgcagagcggcaatagtcaggagtctgttaccgagcaagattccaaggacagcacttactcgttgtcttccacactcaccctgtcaaaagctgattatgaaaagcataaagtgtacgcatgtgaggtcacgcaccagggcctgagtagccccgtgactaagtcctttaacagaggggaatgc

SEQ ID NO: 24072 - RNA, 735 nt, synthetic construct
  misc_feature 1..735: note = derived and/or modified sequence opt3 from anti-HIV_PGDM1400_HeavyChain
  source 1..735: mol_type = other RNA
caggcccaactggtgcagagcggccccgaggtcagaaagcctgggacctccgttaaagtgtcttgcaaggctccaggaaacacactcaaaacttacgaccttcactgggtaaggtcagtgccgggtcagggcctgcagtggatggggtggatcagtcatgaaggagataagaaagtcattgtggagcggttcaaggcaaaggttacgatagactgggatcgcagcaccaatacagcctatttgcaattatccggcctgacttctggtgacaccgcggtgtactattgtgctaaagggtcgaagcaccgactacgtgattacgccctctatgacgatgacggagcactgaactgggccgtcgatgtggactacctttcaaatctggaattttggggccagggcacagctgtaaccgttagcagtgcatccactaaagggccctctgtgttccctttggccccaagctccaagtcaacaagtggaggtaccgctgccctcggctgcctggtcaaagattattttcccgagcctgtgacggtgagctggaactctggggcgctgacttccggagtccataccttcccagcagttctccagtcaagcggcttatacagtctgtcttccgtggtaacagtgcccagctcgtctcttggtactcagacctacatctgtaatgtcaaccacaagccttccaatacaaaggtggacaaaaaggttgaaccaaaatcatgcgat

SEQ ID NO: 24073 - RNA, 630 nt, synthetic construct
  misc_feature 1..630: note = derived and/or modified sequence opt3 from anti-HIV_N6_LightChain
  source 1..630: mol_type = other RNA
tacatccacgtgacccagagcccctcctctctgtcagtcagtattggcgacagagttacaataaactgccaaactagccagggggtgggatccgatctccattggtatcagcacaagcctggtagggccccaaaacttctgatccatcacacgtcttcggtagaggacggcgtgccgtcacggttcagcgggagtggatttcatacctccttcaatttgacaatttctgatttacaggctgacgatatcgcaacttactattgtcaagtcctgcagtttttcggccgcggtagccgactacacattaagcgtaccgtggccgcgccctccgtttttatcttccctccatcagacgaacagctcaaaagtgggacagctagcgtggtctgcctgcttaacaatttttaccccagagaggccaaggtgcagtggaaagtagataacgcactgcaatctggaaattcccaggaatcagttaccgagcaggacagcaaggatagtacttattctttgtccagcacactcaccctgtcgaaggccgactacgaaaaacacaaggtgtatgcttgtgaggtcacgcatcagggcctgtcttcccctgtgactaaatcattcaacaggggcgagtgc

SEQ ID NO: 24074 - RNA, 675 nt, synthetic construct
  misc_feature 1..675: note = derived and/or modified sequence opt3 from anti-HIV_N6_HeavyChain
  source 1..675: mol_type = other RNA
agagcccacctggtgcagagcggcaccgctatgaagaaacccggggcatccgtcagggtttcttgccaaacatcaggatacactttcacggcccatatcctcttttggttccggcaggcgcctggtcgcggccttgagtgggtggggtggattaagccacagtatggagctgtaaactttggcggtgggttccgagaccgtgtgaccctgacaagagatgtctacagggaaatagcctatatggacatccggggattgaaaccggatgacactgcagtgtactattgtgcccgcgatagaagttacggcgacagctcctgggctttagatgcatggggccaggggaccacagttgtggtctctgccgcttcgaccaagggaccctcagtgtttcctctggccccaagcagtaaatccacttctggtggcacagcggcactagggtgcctcgtaaaggactatttccccgagcctgttaccgtgagctggaactccggagccctgacgtcaggcgtccacacttttccagctgtgcttcaaagtagcggtctgtactctttgtcctcagtggtcaccgttcccagcagttctctcgggacacagacttacatttgtaatgtgaatcataagccttccaacaccaaagtagataagaaagtggaaccaaagagctgc

SEQ ID NO: 24075 - RNA, 1080 nt, synthetic construct
  misc_feature 1..1080: note = derived and/or modified sequence opt3 from anti-HIV_N6_GChain
  source 1..1080: mol_type = other RNA
gcctgggaggacgctgataccacactgttctgcgcaagcgacgccaaggcgtactccactgaaaaacacaacgtgtgggctacgcatgcctgtgtccccaccgatcctgacccacaggagatcccgctcgaaaatgttacagagaactttaatatgtggaagaacaatatggtggaacaaatgcacgaggatattatatctctttgggacgagtcactgaaaccctgcgtaatgttgactggcgggagtaccatcaagcaggcatgtcctaaagtgacattcgaaccaattcccatccattattgcgcccctgctggatttgcaattttaaagtgtagagatgaggacttcaacggtaccggcccatgcaagaatgtcagcactgtgcagtgtacacacgggatcaaacccgttgtgtccacccagctgctactcaacggatctctggccaagggcgatatagtcatcaggtcggaaaatcttacgaacaatgctaaagtgattatcgtacaactgaacgagcctgttcagattgtgtgcatccggccaaataacggtgggtcaggaagcggcggcgacatacgccaggcccattgtaatgtcactcgagggaagtgggtgaacattaccaaaaacgtgaaggagcagttgtggaagatctttaataaaacaactaacattaccttcaataacacaatctttaatagtccggcgggaggtgatctcgaaatcaccacgcactccttcaactgcggcggggagtttttctactgtaatacttctgacctgtttaacgaaacaaatctgagcgcaaaccacaccgatactaatgagaacattacactccaatgccgtataaagcagatcgtcagaatgtggcagagggttggacaggccatgtatgctccccctattgccggcaatataacctgcatctccaacattacgggtttactgcttacccgggacggggtgaatgacacacatgataaagaaaacgagactttccgcccaaccggaggcgacatgagagataactggaggtcagagttgtacaagtataaagtaatcaagctgaaa

SEQ ID NO: 24076 - RNA, 645 nt, synthetic construct
  misc_feature 1..645: note = derived and/or modified sequence opt3 from anti-HIV_10E8_LightChain
  source 1..645: mol_type = other RNA
agctacgagctgacccaggaaacaggcgtgtccgtcgccctcgggagaactgttacgattacctgcaggggagactctcttcggtcacactatgctagttggtaccaaaagaaacccggtcaggcacctatcctgttgttctatggcaagaacaatcgcccaagcggggtgccggatcgattttccggatctgcctcgggcaaccgtgcgtcattaacaataagcggtgctcaggccgaggacgatgcagaatactattgtagttccagagacaaatctgggagcaggctgtccgtattcggaggcggcactaagctaaccgtgctctcacagcccaaagccgctcctagtgtcacactgtttccacccagctctgaggaacttcaagcaaataaggccaccctggtgtgcttgatctccgatttctaccctggggctgttactgtggcctggaaggcggactcaagcccagtcaaagcaggagtggagacaaccacgcccagtaagcagtctaacaataaatatgccgcttccagctacctctcgctgactcctgagcagtggaagtctcatcggtcctactcatgtcaggtaacccacgaaggtagtacagttgagaaaactgtggccccaaccgaatgcagc

SEQ ID NO: 24077 - RNA, 708 nt, synthetic construct
  misc_feature 1..708: note = derived and/or modified sequence opt3 from anti-HIV_10E8_HeavyChain
  source 1..708: mol_type = other RNA
gaggtgcagctggtcgaaagcggcgggggactcgttaagcccggtggctcccttagactgtcttgctcagccagtgggttcgactttgataacgcttggatgacctgggtgaggcaacctccaggaaaaggcttggagtgggtaggtcggatcacagggccgggagaaggctggagcgtggactacgcagcccccgtcgagggccgcttcactatttcccgattaaattctataaactttctgtatctagaaatgaataacctccgtatggaggattcggggctgtacttctgtgcgagaacgggaaagtattacgacttttggtcaggttatcctccaggcgaggaatacttccaggattgggggaggggaacccttgtgacagttagcagtgcttccactaaaggcccctctgtgtttcctctggccccaagctccaagtcaaccagtggtgggacagcagccttgggatgcctcgtcaaagactatttccccgagcctgtgaccgtaagctggaactctggcgctctgacttccggcgttcacacatttccagcagtgctgcagtcaagcgggctctacagtttatcttccgtcgtgaccgtgccgagctcgtctctgggaacgcagacttacatctgtaatgtcaatcataagccctccaacaccaaggttgataaacgggtggaacctaagtcatgcgacaaa

SEQ ID NO: 24078 - RNA, 333 nt, synthetic construct
  misc_feature 1..333: note = derived and/or modified sequence opt3 from anti-HIV_12A12_LightChain
  source 1..333: mol_type = other RNA
gacatccagatgacccaaagcccctcctctctgtcagccagtgtgggcgatagagtcacaattacttgccaggctgggcagggaataggtagctccctccagtggtaccaacagaagcctggcaaagcaccaaaacttctggttcacggggcctctaacttgcataggggagtgccgtcgcggttctcaggcagcggttttcacacgaccttcagtttaacaatctccgggctgcagcgcgacgattttgcgacttatttctgtgctgtactagagtttttcggacccggcaccaaggtggaaattaagcgaacagtcgccgcaccttctgtg

SEQ ID NO: 24079 - RNA, 381 nt, synthetic construct
  misc_feature 1..381: note = derived and/or modified sequence opt3 from anti-HIV_12A12_HeavyChain
  source 1..381: mol_type = other RNA
agccagcacctggtgcaatccggcacccaggtcaagaaacccggggcctctgttagaatctcatgccaggctagtggatacagcttcacagactatgtgctccattggtggaggcaggcacctggtcaaggccttgagtggatggggtggattaagccagtatacggagcccggaactatgcgcgccgatttcagggccgtataaatttcgatagagacatctacagggaaattgcttttatggatctgtccggtttgcggtctgacgatactgccttatatttctgtgcacgcgacgggtcgggagatgacacgtcatggcacctggatccgtggggccagggcaccctagtgatcgtcagcgccgctagtacaaaaggg

SEQ ID NO: 24080 - RNA, 315 nt, synthetic construct
  misc_feature 1..315: note = derived and/or modified sequence opt3 from anti-HIV_12A21_LightChain
  source 1..315: mol_type = other RNA
gacatccagatgacccaaagcccctcctctctgtcagccagtgtgggcgatagagtcacaattaactgccaggctgggcagggaataggtagctccctcaattggtaccagaagaaacctggcagggcaccaaaacttctggttcacggggcctctaacttgcaacggggagtgccgtcgcgcttctcaggcagcggttttcatactacgttcaccttaacaatcagttccctgcagcccgacgatgtagcgacttatttttgtgctgtgttccagtggtttgggcctggaaccaaggtcgacattaagcgaaca

SEQ ID NO: 24081 - RNA, 384 nt, synthetic construct
  misc_feature 1..384: note = derived and/or modified sequence opt3 from anti-HIV_12A21_HeavyChain
  source 1..384: mol_type = other RNA
agccagcacctggtgcaatccggcacccaggtcaagaaacccggggcctctgttagagtgtcatgccaggctagtggatacacattcactaactatatcctccattggtggaggcaggcacctggtcaaggccttgagtggatggggctgattaagccagtatttggagccgtgaattacgcgcggcagttccagggccgcatacagttgacgcgagacatctatcgtgaaattgcttttctggatctgagcggtctaagatccgacgataccgccgtctactattgtgcaagggacgagtctggggatgacctcaaatggcacttacatccgtggggacaaggcacacaggtgatcgtttcgcccgcctcaactaagggccct

SEQ ID NO: 24082 - RNA, 648 nt, synthetic construct
  misc_feature 1..648: note = derived and/or modified sequence opt3 from anti-HIV_35022_LightChain
  source 1..648: mol_type = other RNA
cagagcgtgctgacccaatccgcctctgtctcaggcagtctcgggcagagcgttacaatctcctgcactggacccaactctgtgtgttgctcgcacaagtcaattagctggtaccagtggcctccaggtagagctccgacgcttataatctatgaggacaatgaaagggcacccggcattagtcctcggttctccgggtacaaatcttattggagcgcctacctgaccatctccgatttgcgcccagaggacgaaacaacttattactgttgctcatatacccataacagtggatgtgtatttggcacaggtaccaaggtgagcgtcttagggcagtctaaagcgaatccctccgtgactctgttccctccatcaagcgaggaactacaagctaacaaggccacactcgtttgcctgattagtgatttttaccccggagcagtgaccgtcgcctggaaagctgactcttcccctgtgaaggcaggcgtagagacgactaccccaagcaagcagtcgaataacaaatacgccgcttcttcctatctttcactgacaccggagcagtggaagagtcaccgaagctactcctgtcaggttactcatgaaggctctaccgtggagaaaacagtcgcccccaccgaatgcagc

SEQ ID NO: 24083 - RNA, 729 nt, synthetic construct
  misc_feature 1..729: note = derived and/or modified sequence opt3 from anti-HIV_35022_HeavyChain
  source 1..729: mol_type = other RNA
gagggccagctggtgcaaagcggggccgaactcaagaaacccggagcttccgtcaagatctcttgcaaaacctcaggttacagattcaacttttatcacattaattggataaggcagacagcaggccgggggcctgagtggatgggatggatcagtccatacagcggcgacaagaaccttgccccggcgttccaggatcgcgttattatgactacggacaccgaagtgcccgtaacatcctttacttctaccggtgctgcctatatggagatccgaaatctgaaattcgatgacacagggacctacttttgtgcaaagggattgttacgtgatggctcgtcaacttggctgccttatctatggggccaggggacactcctgaccgtgagcagtgcctccacgaagggaccatctgtcttcccccttgctcctagctccaaatcaaccagtggtggcactgcagccctggggtgcttggtgaaggactactttccagaacccgttacagtgagctggaactctggagctctcacttccggcgtccataccttccctgccgtgctgcaatcaagcggtctgtatagtctctcttccgtagttacagtgccaagctcgtctttagggacccagacgtacatttgtaatgtcaaccacaaaccgtccaatactaaggtggataaaagagtggagcccaagtcatgcgacaagggactggaggtcctttttcag

SEQ ID NO: 24084 - RNA, 648 nt, synthetic construct
  misc_feature 1..648: note = derived and/or modified sequence opt3 from anti-HIV_3BC176_LightChain
  source 1..648: mol_type = other RNA
cagagcgtgctgacccaacccgcctccgtctctgcttcacctggccagagtatcacagttagctgcactgggtccagaaacgacgtgggaggttacgatttcgtatcttggtatcagaggcacccaggcggggtgccgaagctcattatatacgagatctcgaaacggccctcaggcattcctcagcgctttagcggaagtcgatccggtaatacggcatctcttaccatcagcgggctgcaagacgatgacgaagccgattattactgttgctcctatgcgtcatacgaccgtttgattttcggaggcggcacaagagtcagtgtgttaaggcagccaaaggctgcccccagcgttactctgtttcctccatcttccgaggaactacaggcaaacaaagccaccctcgtgtgtctgatctcagatttctatcccggggctgtcacagtggcatggaaggccgacggaagccctgtaaaagctggtgttgagaccactaagccaagtaagcagtctaataacaaatacgccgcgtccagctacctttcgctgacaccggaacaatggaagtctcatcggtcctattcatgccaggtgacccacgagggcagtacggtcgagaaaactgtggcacccaccgaatgtagc

SEQ ID NO: 24085 - RNA, 699 nt, synthetic construct
  misc_feature 1..699: note = derived and/or modified sequence opt3 from anti-HIV_3BC176_HeavyChain
  source 1..699: mol_type = other RNA
gaacaggtgcaactgatgcagagcggcgcccagctcagagaccccggggattcccttaagatctcttgcaaggcttcaggatacaacttcattgactatcacatacattgggtcaggctggcacctggtcggggcttggagtggatggggtggatcgatccagttggaggcattaccaaatacgccggtcagtttcaagggcgcttaagtctgacacgagacactagcacgaataccctattcctcgagctgtcccgtcttacagcgggagatactgctgtgtatttttgtgccagatctatgaggccggtagaccacggcatcgattactcgggcctgttcgtgtttcatttctgggggcggggatcagacgtcttggtgagcagtgcatccaccaaaggtccctctgtttttcctctcgccccaagctccaagtcaacaagtggcgggaccgctgcactgggatgcctggtgaaagattatttccccgaacctgtcactgtgagctggaactctggcgccctcacatccggtgtacacacctttccagctgttttacagtcaagcgggctgtacagtctttcttccgtggtcacggtgcccagctcgtctttgggaactcagacctatatttgtaatgtgaaccataagccttccaatacaaaggtcgacaaaaaggttgagccaaaatcatgcgat

SEQ ID NO: 24086 - RNA, 621 nt, synthetic construct
  misc_feature 1..621: note = derived and/or modified sequence opt3 from anti-HIV_3BNC55_LightChain
  source 1..621: mol_type = other RNA
gacatccagatgacccaaagcccctcctctctgtcagccagtgtgggcgataaggtcacaattacttgccagacgagcgctgggtacctcaactggtatcagcagagaaggggacgggcacctaaacttctgatgtacgacggttcccgcttggttaccggcgtgccatctcgattctcggggcgtagatggggaacacaatataatttaactataggctcactgcagccggaggatatcgccacctactattgtcaggtatacgaatttttcggtcccgggacaaggctagacctcaagcggaccgtggcggctcctagcgtctttattttcccacccagtgatgagcagctgaaatccggaactgcctctgtggtttgccttctgaacaatttttatcctcgcgaagcaaaggtgcaatggaaagtcgacaacgccttgcagagcggcaattcccaggagtcagtgacagaacaggatagtaaggacagcacctactctctctcctcaacgctgactctgagcaaggctgattacgagaaacacaaggtatatgcatgtgaggttacccatcaaggcctcagttctccagtgacaaaatccttcaacagaggggaatgc

SEQ ID NO: 24087 - RNA, 675 nt, synthetic construct
  misc_feature 1..675: note = derived and/or modified sequence opt3 from anti-HIV_3BNC55_HeavyChain
  source 1..675: mol_type = other RNA
caggtgcaactggtccagagcggcaccgccgttaagagacccggggcttccgtgagggtatcttgccaggcatcaggatacacattcactgactattttatctactggtggcggcaggcccctggtcaaggcctcgagtggcttgggtggattaacccactgacgagtcagccgagctatccctcccgcttccagggacgattgaccttaacacgtgatacttttgacgaaatgctgtacatggatctaagaggcctcaggtctgacgataccggtatatatttctgtgcgcggcgccactcggactactgcgattttgacatctgggggtcaggaacacagattatcgtgagcagtgcttccaccaaaggcccttctgtcttcccactggcccccagctccaagtcaacttctggcgggacagcagcccttggatgtctggtgaaagattattttcctgagccagttaccgtgagctggaatagtggtgctttgacgtccggcgtccatactttccccgcagtgctccaatcaagcgggctgtacagtctgtcttccgtagttaccgtgcctagctcgtctctcggaacacagacttacatttgcaacgtcaatcacaagccatccaacaccaaagtggacaagagagtggaaccgaagtcatgtgataaaaca

SEQ ID NO: 24088 - RNA, 618 nt, synthetic construct
  misc_feature 1..618: note = derived and/or modified sequence opt3 from anti-HIV_3BNC60_LightChain
  source 1..618: mol_type = other RNA
gacatccagatgacccaaagcccctcctctctgtcagccagagtgggcgatacagtcactattacgtgccaggctaacgggtacctcaattggtatcagcagaggcggggaaaggcacctaaacttctgatatacgacggtagtaagttggagcgcggcgttccagcccgattcagcgggcgtagatggggacaagaatataacttaaccatcaataacctgcagccggaggatgtggcgacatacttttgtcaggtatatgagttcattgtgcccggcactaggctagacctcaaacggaccgtcgctgccccttccgtgtttatcttcccaccctctgatgaacagctgaagtcgggtacagcatcagttgtgtgccttctgaataacttttaccctcgcgaagccaaagtccaatggaaggtggacaatgctttgcagagcgggaacagtcaggagtccgtaaccgagcaggattctaaggacagcacttattccctctcaagtacactgaccctgagcaaagcagattacgaaaagcacaaagtttacgcctgtgaggtgacgcatcaaggactctcttccccagtcactaagtcattcaatagaggcgaatgc

SEQ ID NO: 24089 - RNA, 687 nt, synthetic construct
  misc_feature 1..687: note = derived and/or modified sequence opt3 from anti-HIV_3BNC60_HeavyChain
  source 1..687: mol_type = other RNA
caggtgcacctgagccaatccggcgccgctgtcaccaagcccggggcatctgttagagtgtcatgcgaggccagtggatacaaaatcagcgaccatttcattcactggtggaggcaggcgcctggtcagggcctccagtgggtagggtggataaacccaaagacaggacaaccgaataacccccggcagtttcagggccgcgtgtcccttactcgacaggcttcttgggatttcgacacgtattcgttttacatggatctgaaagccgtccgttcagacgataccgcaatctatttctgtgccagacaaaggagcgacttttgggatttcgacgtgtggggtagtgggacacaggttactgtgtcctctgctagcaccaagggaccttccgtctttccattggcaccctcaagtaaaagcacatctggcggcaccgccgctttagggtgcctggtgaaggattacttccctgaaccagtaactgtttcctggaactcaggagccctaacaagcggtgtgcatacctttcccgcggtcctccagagttctggcctgtattcccttagctcggtggtgacggtcccttcttcctcactggggactcagacctacatttgtaatgttaatcacaagccaagtaacacaaaagtggacaagcgggtagagccgaaaagctgcgataagact

SEQ ID NO: 24090 - RNA, 687 nt, synthetic construct
  misc_feature 1..687: note = derived and/or modified sequence opt3 from anti-HIV_3BNC60_HeavyChain
  source 1..687: mol_type = other RNA
gaggtgcacctgagccagtccggcgccgctgtcaccaagcccggggcatctgttagagtgtcatgcgaagccagtggatacaaaatcagcgaccatttcattcactggtggaggcaagcgcctggtcagggcctccagtgggtagggtggataaacccaaagacaggacagccgaataacgctcggcaatttcagggccgcgtgtcccttactcgacaggcctcttgggatttcgacacgtattcgttttacatggatctgaaagcagtccgttcagacgataccgccatctatttctgtgctagacagaggagcgacttttgggatttcgacgtgtggggtagtgggacacaagttactgtgtcctctgcaagcaccaagggaccctccgtctttcctttggccccatcaagtaaaagcacatctggcggcaccgctgccttagggtgcctggtgaaggattacttccccgagcctgtaactgtttcctggaactcaggagcgctaacaagcggtgtgcatacctttccagcagtcctccagagttctggcctgtattcccttagctcggtggtgacggtcccctcttcctcactggggactcagacctacatttgtaatgttaatcacaagcctagtaacacaaaagtggacaagcgggtagaaccaaaaagctgcgataagact

SEQ ID NO: 24091 - RNA, 648 nt, synthetic construct
  misc_feature 1..648: note = derived and/or modified sequence opt3 from anti-HIV_447-52D_LightChain
  source 1..648: mol_type = other RNA
cagagcgtgctgacccaacccccttccgtctctgccgctccaggccagaaggttacaatctcatgcagtgggagctcctctaacattggaaataactacgtgctctggtatcagcagttcccgggtactgcacccaaacttctgatatacggcaataacaagagaccttcggggatcccagacaggttttcaggaagcaaaagtggcacgtccgccaccttgggtattacagggttacaaactggagatgaggcggactatttctgtgctacctgggattctggcctgagcgccgactgggtatttggcgggggaacaaagctaaccgtgctctcccagcccaaagcagccccttcagtcactctgttcccacccagtagcgaggaacttcaggctaataaggcaacactggtgtgcttgatctctgatttttaccctggtgccgttaccgtggcttggaaggccgactcctcaccagtcaaagcgggcgtggaaacgactaccccgagcaagcagagtaacaataaatatgcagcctcttcctacctcagcctgacacccgagcaatggaagtcgcaccggtcttattcctgtcaggtaactcatgaagggtcaaccgttgagaaaacagtggctcctaccgagtgc

SEQ ID NO: 24092 - RNA, 693 nt, synthetic construct
  misc_feature 1..693: note = derived and/or modified sequence opt3 from anti-HIV_447-52D_HeavyChain
  source 1..693: mol_type = other RNA
gaggtgcagctggtcgaaagcggcgggggactcgttaagcccggtggctcccttagactgacctgcgtggcctctgggttcacattttcagacgtatggttgaactgggtgaggcaagctcctggaaaaggcttagagtgggtcggtcggatcaagagtcgcactgatgggggaacgaccgactacgcagccagcgtgaaaggccgattcacaatttcccgtgatgactctaagaatactctgtatctacagatgaactcgctcaaaaccgaagatacagcggtttactcatgtaccactgacggctttataatgatcagaggggtgagcgaggattattactattactatatggacgtctggggaaagggtacaaccgtgacggtaagttccgcttctactaagggcccaagcgttttcccgctggccccctgctccaggtcaaccagtgggggaacagcagcccttggctgtctggtgaaagattactttcctgaaccagtcactgtgagctggaactctggtgctttgacctccggggtgcacacattccccgcagtcctccagtcaagcggactgtacagtctgtcttccgttgtgaccgtacctagctcgtctctcggcacgcagacttatacatgcaatgtgaatcataagccatccaacaccaaagtcgacaagcgggtggagtta

SEQ ID NO: 24093 - RNA, 645 nt, synthetic construct
  misc_feature 1..645: note = derived and/or modified sequence opt3 from anti-HIV_447-52D_LightChain
  source 1..645: mol_type = other RNA
cagagcgtgctgacccaacccccttccgtctctgccgctccaggccagaaggttacaatctcatgcagtgggagctcctctaacattggaaataactacgtgctctggtatcagcagttcccgggtactgcacccaaacttctgatatacggcaataacaagagaccttcggggatcccagacaggttttcaggaagcaaaagtggcacgtccgccaccttgggtattacagggttacaaactggagatgaggcggactatttctgtgctacctgggattctggcctgagcgccgactgggtatttggcgggggaacaaagctaaccgtgctctcccagcccaaagcagccccttcagtcactctgttcccacccagtagcgaggaacttcaggctaataaggcaacactggtgtgcttgatctctgatttttaccctggtgccgttaccgtggcttggaaggccgactcctcaccagtcaaagcgggcgtggaaacgactaccccgagcaagcagagtaacaataaatatgcagcctcttcctacctcagcctgacacccgagcaatggaagtcgcaccggtcttattcctgtcaggtaactcatgaagggtcaaccgttgagaaaacagtggctcctaccgag

SEQ ID NO: 24094 - RNA, 705 nt, synthetic construct
  misc_feature 1..705: note = derived and/or modified sequence opt3 from anti-HIV_447-52D_HeavyChain
  source 1..705: mol_type = other RNA
gaggtgcagctggtcgaaagcggcgggggactcgttaagcccggtggctcccttagactgacctgcgtggcctctgggttcacattttcagacgtatggttgaactgggtgaggcaagctcctggaaaaggcttagagtgggtcggtcggatcaagagtcgcactgatgggggaacgaccgactacgcagccagcgtgaaaggccgattcacaatttcccgtgatgactctaagaatactctgtatctacagatgaactcgctcaaaaccgaagatacagcggtttactcatgtaccactgacggctttataatgatcagaggggtgagcgaggattattactattactatatggacgtctggggaaagggtacaaccgtgacggtaagttccgcttctactaagggcccaagcgttttcccgctggccccctgctccaggtcaaccagtgggggaacagcagcccttggctgtctggtgaaagattactttcctgaaccagtcactgtgagctggaactctggtgctttgacctccggggtgcacacattccccgcagtcctccagtcaagcggactgtacagtctgtcttccgttgtgaccgtacctagctcgtctctcggcacgcagacttatacatgcaatgtgaatcataagccatccaacaccaaagtcgacaagcgggtggagttaaaaactcccaca

SEQ ID NO: 24095 - RNA, 624 nt, synthetic construct
  misc_feature 1..624: note = derived and/or modified sequence opt3 from anti-HIV_5H/I1-BMV-D5_LightChain
  source 1..624: mol_type = other RNA
gacatccagatgacccaaagcccctccacactgtctgcctcaattggcgatagagtgactataacgtgcagggctagtgaggggatctaccactggctcgcatggtatcagcagaagcctggaaaagccccaaaacttctgatttacaaggcgagctccttggcttctggtgccccgtcgcggttctcaggcagcgggagtggaaccgactttacattaactatctcctctctgcagcccgatgacttcgcaacctattactgtcaacagtatagcaactaccctctaacatttggcggtgggaccaagctcgaaattaaacgcactgtcgccgctccatccgttttcatctttcccccttcagatgagcagctgaagagtggaacagcaagcgtggtatgccttctgaataacttctatccacgagaagccaaggtgcagtggaaagtcgacaatgctttgcaatctggcaactcccaggagtcagtgaccgaacaggatagcaaggacagtacgtactctctctccagcactctgaccctgtcgaaagccgattacgagaagcataaagtttatgcgtgtgaggtgacacaccagggcctctcttcccccgtcactaagtca

SEQ ID NO: 24096 - RNA, 651 nt, synthetic construct
  misc_feature 1..651: note = derived and/or modified sequence opt3 from anti-HIV_5H/I1-BMV-D5_HeavyChain
  source 1..651: mol_type = other RNA
caggtgcaactggtccagagcggcgccgaggttagaaagcccggggcttccgtgaaagtatcttgcaaggcatcaggagacaccttcagtagctacgccatctcctgggtgaggcaggcgcctggtcagggcctcgaatggatgggagggattataccaatctttggcacagctaactatgcccaagcattccagggtcgggtcactattacggccaatgagtctacctcgacagcttacatggaactttcaagcctgcgcagtgaggatactgcaatctattactgtgcccgagacaacccgaccttgttagggtccgattattggggagctggcacactggtgaccgtttctagcgcctccactaaaggcccctcagtgtttcctctagcgccatgcagtcgtagcacatctgggggaaccgcagccctcggttgtctggtcaaggactacttccccgaacctgtgacggtatcctggaactcaggcgctcttactagcggggttcacacctttccagccgtgctgcagagttctggattgtattccctcagctcggtcgtgacagtgccctcttcctcactgggcactcagacctacatttgcaatgtcaatcataaacctagtaacacaaaggttgataagagagtg

SEQ ID NO: 24097 - RNA, 657 nt, synthetic construct
  misc_feature 1..657: note = derived and/or modified sequence opt3 from anti-HIV_5H/I1-BMV-D5_A-Chain
  source 1..657: mol_type = other RNA
atgcagctgctcagcggcatcgtgcaacagcagaacaatcttctgagagccattgaggctcagcaacacttgttacagctgaccgtctgggggataaagcagctacaggcaaggatcctcgccggaggttccggcgggcatacaacttggatggaatgggaccgggagattaacaattacacgtctctgatccactcacttattgaagagagtcaaaaccagcaggagaaaaatgaacaggagctgttggaaggaagctccggcggtcaactcctgtctgggatcgttcagcagcaaaacaatctgctccgcgcgatagaggctcagcagcatttactgcagcttaccgtgtggggaatcaagcaattgcaggcccgtattctggcaggcggctcagggggacacacaacttggatggaatgggatcgagagatcaacaattatacctcgctaattcatagcctcatcgaggaaagtcagaaccagcaagagaaaaatgaacaggagctgcttgaaggttcctctggcgggcagctgttgagcggaatagtacagcaacagaacaatctcctgagagccattgaggctcagcagcacttactgcaactcacagtgtggggcatcaagcagcttcaggcaaggattctggccggtggg

SEQ ID NO: 24098 - RNA, 390 nt, synthetic construct
  misc_feature 1..390: note = derived and/or modified sequence opt3 from anti-HIV_8ANC195_LightChain
  source 1..390: mol_type = other RNA
gacatccagatgacccaaagcccctccacactgtctgcctcaattggcgatactgtgagaataagttgcagggctagccagtccatcacggggaactgggtcgcatggtaccagcagcggcctggaaaggccccacgcctccttatttatcgaggtgcggctctgttgggcggggttccgtctcgtttctcgggatcagccgcaggcaccgactttacattaactatcggtaatctgcaagccgaggatttcgggaccttttactgtcagcagtatgacacataccccggaaccttcggccagggcactaaagtggaagtaaagagaacagtggctgcacctagcgtctttattttcccacccagtgatgagcaactaaaatccgggacc

SEQ ID NO: 24099 - RNA, 423 nt, synthetic construct
  misc_feature 1..423: note = derived and/or modified sequence opt3 from anti-HIV_8ANC195_HeavyChain
  source 1..423: mol_type = other RNA
cagatccacctggtgcaaagcggcaccgaggtcaagaaacccgggtcctctgttacagtgtcatgcaaggcctacggagtaaacactttcggtctctatgctgtgaattgggtcagacaggcacctggccagagtcttgaatacattgggcagatatggaggtggaaaagctccgcctctcatcactttcggggacgcgtgctgatctcggcggttgacttgacgggctcaagcccaccgattagttccttagagatcaagaacctgacctctgatgacacagctgtgtatttctgtactaccacaagcacctacgataaatggtccggtctacatcacgacggggtcatggccttttcaagttggggacaaggcactctcattagcgtgtctgcagcctccacaaagggcccctcagtattc

SEQ ID NO: 24100 - RNA, 333 nt, synthetic construct
  misc_feature 1..333: note = derived and/or modified sequence opt3 from anti-HIV_CAP256-VRC26.01_LightChain
  source 1..333: mol_type = other RNA
cagagcgtgctgacccaacccccttccgtctctgccgctccaggccagaaggttacaatctcatgcagtgggagctcctctactattggaaacaattacgtgtcgtggtatagactccttccgggtacggcacccaaactgttgatatacaagaacgacaataggccttcaggcatcccagatcggttcagcgggagtaaatccggaacctctgccacattaggcattagcggtctgcagactggggacgaggcggattattactgtggaacctgggacacatccctatcaggcggcggggtatttggaaccggtactaaggtgacagtcctc

SEQ ID NO: 24101 - RNA, 432 nt, synthetic construct
  misc_feature 1..432: note = derived and/or modified sequence opt3 from anti-HIV_CAP256-VRC26.01_HeavyChain
  source 1..432: mol_type = other RNA
gaggtgcaggtcgttgaaagcggcgggggagtggtacaacccggtagatccctgaggctctcttgcaccgcctcaggcttcacatttagtaacttcgctatggggtgggtgcggcaggcacctggaaagggccttgagtgggtcgcctttatcagctccgacggttctaataaaaactacggggattcggtgaagggacgcttcactatttcacgagacaatagcaaaaacacggtttttctgcagatgaatagtttgcgtgtggaagataccgcgttatattactgtgctaaggacgtcggcgattataaatccgacgagtggggcacagaatactatgatatatctatcagctacccaattcaggacccgagagccatggtgggggcattcgatctgtggggacaaggtactatggtaaccgtttccccc

SEQ ID NO: 24102 - RNA, 324 nt, synthetic construct
  misc_feature 1..324: note = derived and/or modified sequence opt3 from anti-HIV_CAP256-VRC26.02_LightChain
  source 1..324: mol_type = other RNA
cagagcgtgctgacccaacccccttccgtctctgccgctccaggccagaaggttacaatctcatgcagtgggagcaactccaatattggaaacaaagacgtgtcttggtaccagcagataccggcaactgcccccaagctccttatctatgagaataacaaaagaccttcgggtatttcagataggttcagcggcagtaagtccgggacgtctgcgaccctggctatcacaggattgcaaactggcgacgaagccgattactattgtgcaacctgggacggtcgggtaagcgtgattgggacaggaaccaatgtcatcgtgtta

SEQ ID NO: 24103 - RNA, 432 nt, synthetic construct
  misc_feature 1..432: note = derived and/or modified sequence opt3 from anti-HIV_CAP256-VRC26.02_HeavyChain
  source 1..432: mol_type = other RNA
gaggtgcagctggtcgaaagcggcgggggagttgtgcaacccggtagatccctcaggctttcttgcgccgcttcacagttcagttttggcaactacgggatgcactgggtacggcaggcacctggaaagggcctggagtgggtggccgcgatcagcttcgctggtaccaaaacaaattatgccgactccgtcaaggggcgctttactatttctcgagataactcgaaaaatacggtgtacttgcagatgaactcattacgtgcagaagacaccgccctgtatttctgtgctaaggatataagagagtacgaatgcgagtattggacaagcgactactatgattttggaaggccacaaccgtgtatcgacagtcggggcgttgtgggcactttcgatgtctgggggcagggaaccatggtgacagtatcctct

SEQ ID NO: 24104 - RNA, 333 nt, synthetic construct
  misc_feature 1..333: note = derived and/or modified sequence opt3 from anti-HIV_CAP256-VRC26.03_LightChain
  source 1..333: mol_type = other RNA
cagagcgtgctgacccaacccccttccgtctctgccgctccaggccagaaggttacaatctcatgcagtgggagctcctctaacattggaaataacttcgtgtcgtggtaccagcagagaccgggtactgcacccaaaatactcatctatgagaataacaagaggccttcagaaacgccagaccggtttagcggcagtaaatccgggacctctgccacacttgcgattactggactgcaaaccgctgatgaggccgaatactattgtgcaacatggagcgcctccttgtcaagtgctcgcgtattcggcaccggtactcgaatcacagtgtta

SEQ ID NO: 24105 - RNA, 432 nt, synthetic construct
  misc_feature 1..432: note = derived and/or modified sequence opt3 from anti-HIV_CAP256-VRC26.03_HeavyChain
  source 1..432: mol_type = other RNA
gaggtgcagctggtcgaaagcggcgggggagttgtgcaacccggtaagtccctcagactttcttgcgccgcttcaaggttcagttttaaccggtacggcatgcactgggtacgccaggcacctgggaaaggactggagtgggtggccgcgatcagctatgacggcaccgataagtaccatgctgacaaagtctggggtcgattcacaatttcccgtgataattctaagaacactttgtatttacagatgaatagcctgagagccgaagacacggcactatactattgtgccaaagatctcagggaggacgaatgcgaggagtggtggtcagattactatgactttgggaagcagctgccatgtcggaagtcgcgcggagtggctggcatattcgatggctgggggcaaggaaccatggttacagtgagttcc

SEQ ID NO: 24106 - RNA, 333 nt, synthetic construct
  misc_feature 1..333: note = derived and/or modified sequence opt3 from anti-HIV_CAP256-VRC26.04_LightChain
  source 1..333: mol_type = other RNA
cagcccgtgctgacccaacctccaagcgtctccgccgctccgggccagaaggttacaatctcttgctcagggagtagctccaacattggaaataacttcgtgtcttggtaccagcagagacccggtactgcaccttcgctccttatatatgagacgaataaaaggccatcaggcatccccgaccggtttagcgggagtaagtccgccacctctgcgacactggctattactggattgcaaaccggcgatgaagccgactactattgtgcaacatgggccgctagcttaacctccgcacgcgtattcggtactgggacaaaagtgatcgtctca

SEQ ID NO: 24107 - RNA, 432 nt, synthetic construct
  misc_feature 1..432: note = derived and/or modified sequence opt3 from anti-HIV_CAP256-VRC26.04_HeavyChain
  source 1..432: mol_type = other RNA
gaggtgcagctggtcgaaagcggcgggggagttgtgcaacccggtaagtccctcagactttcttgcgccgcttcacagttcagttttaacaggtacggcatgcactgggtacggcaggcacctgggaaaggactggagtgggtggccgcgatcagctatgacggcaccgataagtaccatgctgacaaagtctggggtcgcttcacaatttcccgagataattctaagaacactttgtatttacagatgaatagcctgcgtgccgaagacacggcactatactattgtgccaaagatctcagagaggacgaatgcgaggagtggtggtcagattactatgactttgggaagcaactgccatgtaggaagtcgcggggagtggctggcatattcgataaatggggccaggggaccatggttatcgtgagttcc

SEQ ID NO: 24108 - RNA, 324 nt, synthetic construct
  misc_feature 1..324: note = derived and/or modified sequence opt3 from anti-HIV_CAP256-VRC26.05_LightChain
  source 1..324: mol_type = other RNA
cagagcgccctgacccaacccccttccgtgtctgctgcaccaggccagaaggtcacaatctcatgcagtgggaacattggaaataactacgttagctggtatcaacaggtgccgggtactgcccccaaactccttatatacgagaataacaagagaccttccggcatcccagacaggttctctgggtcgaaatcaggaacgagcgcgaccctggtaattacaggcttgcagactggtgatgaagctgacttttattgtgggacctggggaggcagtttacggacaggcggggtgctgggaaccggtactcgcgtcacagtgcta

SEQ ID NO: 24109 - RNA, 432 nt, synthetic construct
  misc_feature 1..432: note = derived and/or modified sequence opt3 from anti-HIV_CAP256-VRC26.05_HeavyChain
  source 1..432: mol_type = other RNA
gaggtgcagctggtcgaaagcggcgggggagttgtgcaacccggtagatccctcaggctttcttgcgccgcttcacacttcagtctgagctcctacggcatgcattgggtacggcaggcacctgggaagggattggagtgggtgaccggcatctcttttgccggtacaaaaacttattacggggactcggtccgcggacgattcacggtgtcacgtgatattagcaagaacaccttatttctgcagatgaatagtctaagaccagacgatacagcgatgtattactgtgctagggaccagcggtattacgaatgcgaggaatgggcctccgattattacgacttcggccgcgagcaaccgtgtctcgatcccagaggcgttgtggggatatttgacctgtggggacagggtactatggtcaccgtgtctagc

SEQ ID NO: 24110 - RNA, 324 nt, synthetic construct
  misc_feature 1..324: note = derived and/or modified sequence opt3 from anti-HIV_CAP256-VRC26.06_LightChain
  source 1..324: mol_type = other RNA
cagagcgtgctgacccaacccccttccgtctctgccgctccaggccagaaggttacaatctcatgcagtgggagcacttccaaaattggacagaactctgtgtcgtggtaccagcaactcccgggtacggcacccaaacttctgatatatgagaatgacagaaggccttcaggcaccccagatcggttcagcgggagtaagtccggaacatctgccactttggcgatcaccggcttacagacaggtgacgaagctgagtactattgtgaaacctgggatgggagcggaggcgtatttggcactgggacaaaggtgaccgtcctg

SEQ ID NO: 24111 - RNA, 435 nt, synthetic construct
  misc_feature 1..435: note = derived and/or modified sequence opt3 from anti-HIV_CAP256-VRC26.06_HeavyChain
  source 1..435: mol_type = other RNA
gaggtgcagctgatcgaaagcggcgggggagtcgttcaacccggtagatccctcaggctttcttgcggcgcctcagggttcagttttaacaattacggaatgcactgggtgcggcaggctcctggcaagggtctggagtgggtagcagggattagcttcgccggaatcaaaaagtattacggcacctccgtgaaaggccgctttacaatatctcgagacaactcgaagaataacttctatttgcagatgaactcattacgtgtcgaagatactgcgctgtactattgtgctagagacctaagggagctcgaatgcgaggagtggacgctgtacaattattacgattttgggagccggggaccatgtgtggacccgcgcggtgttgccggcagtttcgatgtgtgggggcagggaaccatggtcacagtgtcctct

SEQ ID NO: 24112 - RNA, 333 nt, synthetic construct
  misc_feature 1..333: note = derived and/or modified sequence opt3 from anti-HIV_CAP256-VRC26.07_LightChain
  source 1..333: mol_type = other RNA
caggccgtgctgacccaaccccctagcgtctccgctgcaccaggccagaacgttacaatctcttgctcagggagtggaagcaatattggtaacaatttcgtgtcctggtaccagcagagaccgggcactgcccccaagctccttatatatgagtctaacaaaaggccttcggggatcccagaccggttttcaggaagcaagagtggcacgtccgcgaccctggctattacaggtttgcaaactggggatgaagcctactattactgtgcaacctgggccgctcgcttaaattctgcacgagtattcggaacaggcaccatggtgactgtcctg

SEQ ID NO: 24113 - RNA, 432 nt, synthetic construct
  misc_feature 1..432: note = derived and/or modified sequence opt3 from anti-HIV_CAP256-VRC26.07_HeavyChain
  source 1..432: mol_type = other RNA
gaggtgcagctggtcgaaagcggcgggggagttgtgcaacccggtagatccctcaggctttcttgcgtaggctcacagttcagttttaaccggtacgggatgcactgggtgcgccaggcccctggaaagggcctggagtgggtcgctggtatcagcttcgacgggaccgatcgatatcatgcagacaatgtgtggggacgttttacaatttccagagataactctaaaaatactttgtacttacagatgtcgtcactgagggccgaagacacggcgctatattactgtgctaaggatctccgggaggacgaatgcgaggagtggtggagcgattattacgacttcggcaaaaagctgccatgtcgcaaaagtagaggcgttgccggggtgtttgataagtggggacaaggtaccatggtcacagtgtcctct

SEQ ID NO: 24114 - RNA, 333 nt, synthetic construct
  misc_feature 1..333: note = derived and/or modified sequence opt3 from anti-HIV_CAP256-VRC26.08_LightChain
  source 1..333: mol_type = other RNA
cagagcgccctgacccaacccccttccgtgtctgctgcaccaggccagaaggtcacaatctcatgcagtgggaacagctccaatattggaaacaatttcgtttcttggtaccaacaggtgccgggtactgcccccaaactccttctgtatgagacgtacagaaggccttcgggcataccagaccggttttcagggagcaagagtggaacctccgcgacattggctatcactggcttacagaccggtgatgaagccgactattactgtacagtatggggagtgcgcaaaggggtcggcgcagtgttcggcaccgggactaaggttacagtgctg

SEQ ID NO: 24115 - RNA, 438 nt, synthetic construct
  misc_feature 1..438: note = derived and/or modified sequence opt3 from anti-HIV_CAP256-VRC26.08_HeavyChain
  source 1..438: mol_type = other RNA
gaggtgcagctggtcgaaagcggcgggggagttgtgcaacccggtagatccctcaccctttcttgcgccgcttcacagttcacatttagtaactacggcatgcactgggtaaggcaggcacctgggaagggactggagtgggtggccagcgtctccaatgacggcactaaaaagtatcatggtgattctgtgtgggggcggttcacgatctcgcgcgacaacagcaaaaataccttgtttttacagatgtcaagtctgcgagcggaagatacagctgtttacttctgtgtgcgtgaccaaagagaggatgaatgcgaggagtggtggtccgactattacgattttggaagggaactaccatgtcggaagttccgcggcctcggcctggccgggatttttgacatatggggacacggtactatggtcaccgtgtctagc

SEQ ID NO: 24116 - RNA, 333 nt, synthetic construct
  misc_feature 1..333: note = derived and/or modified sequence opt3 from anti-HIV_CAP256-VRC26.09_LightChain
  source 1..333: mol_type = other RNA
cagagcgccctgacccaacccccttccgtgtctgctgcaccaggccagaaggtcacaatctcatgcagtgggaacagctccaatattggaaacaatttcgtttcttggtaccagcagctcccgggtactgcccccaaacttctgatatatgagaacaatagaaggccttcgggcatcccagaccggttttcagggagcaagagtggaacgtccgcgaccttggctatttctggcttacaaacaggtgatgaagccgactactggtgtgcagtgtggggagtacgccgaggggccggcgctgtgttcggcgcagggactaaagtcaccgtgctg

SEQ ID NO: 24117 - RNA, 438 nt, synthetic construct
  misc_feature 1..438: note = derived and/or modified sequence opt3 from anti-HIV_CAP256-VRC26.09_HeavyChain
  source 1..438: mol_type = other RNA
gaggtgcagctggtcgaaagcggcgggggagttgtgcaacccggtagatccctcaccctttcttgcgccgcttcacagttcaactttgcaaattacggcatgcactgggtaaggcaggcccctgggaagggactggagtgggtggcgagtatcagcaacgacggcactaaaaagtatcatgaagagtccgtctggggtcggttcacaatttctaaagataattcgaagtcaacgttgtttttacagatgaacagcctgcgcatagaagacaccgctctatacttctgtgtgaaagatcaacgagaggacgagtgcgaagagtggtggagtgattattacgactttgggcgtgaactcccatgtagaaagtccaggggactgggccttgccggcatcttcgatatgtgggggcacggaacaatggttactgtgtctagc

SEQ ID NO: 24118 - RNA, 333 nt, synthetic construct
  misc_feature 1..333: note = derived and/or modified sequence opt3 from anti-HIV_CAP256-VRC26.10_LightChain
  source 1..333: mol_type = other RNA
cagagcgtgctgacccaacccccttccgtctctgccgctccaggccagaaggttacaatctcatgcagtgggagctcctctaacattggagacaattacgtgtcgtggtatcagcacctcccgggtactgcacccaaacttctgatatacgagaacacgagaaggccttcaggcatcccagatcggttcagcgggagtaagtccggaacctctgccacattggcgattactggcttacagaccggtgacgaagctgattattactgtgggacatgggacgtacgccccaatcgaggagccgtgtttggcaccggcactaaagtcacagtgctg

SEQ ID NO: 24119 - RNA, 432 nt, synthetic construct
  misc_feature 1..432: note = derived and/or modified sequence opt3 from anti-HIV_CAP256-VRC26.10_HeavyChain
  source 1..432: mol_type = other RNA
caggccatcctggtggagagcggcgggggagtcgttcaacccggtagatccctcaggctttcttgcgctgcatcacagttcacctttagtggccacgggctgcattgggtgcggcaggcccctggaaagggcttggaatgggtagcgagcatttccttcgctggtacaaaaatggactacgccgattctgtgaaggggcgctttgcaatatcgcgagacaacagcaaaaatactttatatctgcagatgaactcactacgtgtcgaggatacggccctctactattgtgctaaggacatgagagaatacgagtgcgaatattggaccagtgattactatgacttcggaaggccacaaccgtgtatcgatcggcgcggcgtggttggcatttttgacatgtgggggcagggaacaatggtgactgtctccacc

SEQ ID NO: 24120 - RNA, 321 nt, synthetic construct
  misc_feature 1..321: note = derived and/or modified sequence opt3 from anti-HIV_CAP256-VRC26.11_LightChain
  source 1..321: mol_type = other RNA
cagagcgtgctgacccaacccccttccgtctctgccgctccaggccagaacgttacaatctcatgcagtgggccgcccagccacattgagaagaatgacgtgtcctggtaccagagactccctggaatggcaccaaaaatggtaatatatgaatctaagaggcggccccttggtatccctgtgcgcttctcggcctcacgaagcggcagttccgcgactctggtcattacggggttgcagaccgctgatgaggccgactactattgtggaacatgggatggccgtatgaactttggtactgggaccacagtgtctgtttta

SEQ ID NO: 24121 - RNA, 429 nt, synthetic construct
  misc_feature 1..429: note = derived and/or modified sequence opt3 from anti-HIV_CAP256-VRC26.11_HeavyChain
  source 1..429: mol_type = other RNA
gaggtgcagctggtcgaaagcggcgggggagttgtgccccctggtaagtccctcaccctttcttgcgtagcctcaaggttcacatttagtgctttcggcatgcactgggtgaggcaagcaccagggaaaggactggagtgggtcgccagcatctcctttgcgggcattaagaaatactatgctgactctgtgaagggtcggttctcgatatcacgcgataacagcaatactttgtttttacagatgaacgggctgcgaggagaagacacgggcctataccattgtgttaaagatatgcgtgagctcgaatgcgaggagtgggccagtgactattacgatttcggcaagccgcagccctgtctggacagaagaggggtgtccggaatctctgcatggtggggtcctggcaccatggtcacagtgagctcc

SEQ ID NO: 24122 - RNA, 321 nt, synthetic construct
  misc_feature 1..321: note = derived and/or modified sequence opt3 from anti-HIV_CAP256-VRC26.12_LightChain
  source 1..321: mol_type = other RNA
cagagcgtgctgacccaacccccttccgtctctacagccccaggccagactgttacggtgtcatgcagtgggggaaccagcaacacaggtaataacttcgtatcctggtaccagcacctcccgggcactgctcccaaacttctgatctatgagaataacaagagacctttgggggtgccagacaggttttctggagcaaagtcgggcacctcagccacattagcgattaccggtctgcagactggggatgaaggagactactattgtgctacatggagcggcagtctaaatataggcaccgggacgaaagtctccgtgctc

SEQ ID NO: 24123 - RNA, 432 nt, synthetic construct
  misc_feature 1..432: note = derived and/or modified sequence opt3 from anti-HIV_CAP256-VRC26.12_HeavyChain
  source 1..432: mol_type = other RNA
gaggtgcagctggtccaaagcggcgggggagttgtgcagcccggtagatccctcaggctttcttgcgccgctccttacttcgaatttggccggtatgggttccactgggtacgccaggcaccaggaaagggcctggagtgggtggcctcaatcagttttgcgggtcgagactactatcatagcccgtccgtctgggggcgtttcaccatttctagagataactcgaaaaatacattgtacttacagatgaactcactgaggatagaagacactgctctatatttttgtgcccgggatctccgcgagagcgaatgcgaggagtgggaaagtgactactatgatttcggaaagaaaggcccctgtgtgaagcctagaggcgttgcagggggactggacctttggggtcaaggcacgatggtgatcgtctcctct

SEQ ID NO: 24124 - RNA, 333 nt, synthetic construct
  misc_feature 1..333: note = derived and/or modified sequence opt3 from anti-HIV_CAP256-VRC26.I1_LightChain
  source 1..333: mol_type = other RNA
cagagcgtgctgacccaacccccttccgtctctgccgctccaggccagaaggttacaatctcatgcagtgggagctcctctaacattggaaataactacgtgtcgtggtatcagcagctcccgggtactgcacccaaacttctgatatacaagaataacgagagaccttcaggcatcccagacaggttcagcgggagtaaatccggaacgtctgccaccttgggcattacaggtttacaaactggggatgaagcggactattactgtggaacctgggatacaagcctgtccgctggcggcgtatttgggaccggaactaaggtgacagtccta

SEQ ID NO: 24125 - RNA, 432 nt, synthetic construct
  misc_feature 1..432: note = derived and/or modified sequence opt3 from anti-HIV_CAP256-VRC26.I1_HeavyChain
  source 1..432: mol_type = other RNA
caggtgcaactggtcgagagcggcgggggagttgtgcagcccggtagatccctcaggctttcttgcgccgcttcaggcttcacctttagtaactacgcaatggactgggtacggcaggcccctgggaagggactggaatgggtggcggtcatcagctccgatggctctaataaaaactatgctgactcggtgaagggtcgcttcacaatttcacgagataatagcaaaaacactttgtacttacagatgaatagtctgcgtgccgaggacacggcagtttattactgtgccaaggatctaggggaaaacaaaaatgacgagtgggctaccgattattacgacctctccatagcatatccagtgcaagatccgagagccgtcgtgggagcttttgacatctggggccagggcacaatggtaactgtttctagc

SEQ ID NO: 24126 - RNA, 333 nt, synthetic construct
  misc_feature 1..333: note = derived and/or modified sequence opt3 from anti-HIV_CAP256-VRC26.I2_LightChain
  source 1..333: mol_type = other RNA
cagagcgtgctgacccaacccccttccgtctctgccgctccaggccagaaggttacaatctcatgcagtgggagctcctctactattggaaacaattacgtgtcgtggtatcagctccttccgggtacggcacccaaactgttgatatacaagaacgacaaaagaccttcaggcatcccagataggttcagcgggagtaagtccggaacctctgccacattaggcattactggtctgcagaccggggacgaggcggattattactgtggaacatgggacaccagcctatccgctggcggcgtatttgggactggaacaaaagtgaccgtcctc

SEQ ID NO: 24127 - RNA, 432 nt, synthetic construct
  misc_feature 1..432: note = derived and/or modified sequence opt3 from anti-HIV_CAP256-VRC26.I2_HeavyChain
  source 1..432: mol_type = other RNA
caggtgcaactggtcgagagcggcgggggagttgtgcagcccggtagatccctcaggctttcttgcgccgcttcaggcttcacctttagtaacttcgcaatggggtgggtacggcaggcccctggaaagggcctggaatgggtggcgtttatcagctccgacggttctaataaaaactacggggattcggtcaagggacgcttcacaatttcacgagacaatagcaaaaacactttgtttttacagatgaatagtctgcgtgctgaggatacggccctatattactgtgcaaaggacgtgggcgaatataaatccgatgagtgggccaccgactactatgatctctctatagcttacccaatccaagacccgagagcaatggttggcgccttcgatatttgggggcagggaacaatggtgactgtcagctcc

SEQ ID NO: 24128 - RNA, 333 nt, synthetic construct
  misc_feature 1..333: note = derived and/or modified sequence opt3 from anti-HIV_CAP256-VRC26.UCA_LightChain
  source 1..333: mol_type = other RNA
cagagcgtgctgacccaacccccttccgtctctgccgctccaggccagaaggttacaatctcatgcagtgggagctcctctaacattggaaataactacgtgtcgtggtatcagcagctcccgggtactgcacccaaacttctgatatacgagaataacaagagaccttcaggcatcccagacaggttcagcgggagtaaatccggaacgtctgccaccttgggcattacaggtttacaaactggggatgaagcggactattactgtggaacctgggatagctccctgtcagctggcggcgtatttgggacaggaaccaaggtgactgtccta

SEQ ID NO: 24129 - RNA, 432 nt, synthetic construct
  misc_feature 1..432: note = derived and/or modified sequence opt3 from anti-HIV_CAP256-VRC26.UCA_HeavyChain
  source 1..432: mol_type = other RNA
caggtgcaactggtcgagagcggcgggggagttgtgcagcccggtagatccctcaggctttcttgcgccgcttcaggcttcacctttagtagctacgggatgcactgggtacggcaggcacctggaaagggcctggaatgggtggccgtcatctcctatgacggttctaacaaatactatgcggattcggtgaaggggcgcttcacaatttcacgagacaatagcaaaaacactttgtacttacagatgaatagtctgcgtgctgaggatacggccgtttattactgtgcaaaggacctaggagaatccgagaacgaagagtgggccaccgattattacgacttttctataggctacccaggccaagatccgagaggggtggtcggagctttcgacatctggggtcagggcacaatggtgactgtaagctcc

SEQ ID NO: 24130 - RNA, 324 nt, synthetic construct
  misc_feature 1..324: note = derived and/or modified sequence opt3 from anti-HIV_CH01_LightChain
  source 1..324: mol_type = other RNA
gagatcgtgctggcccagagccccggcaccctctccctttctcctggggaaagagctacactgtcatgcagggcaagtcacaacgtccatccaaagtacttcgcctggtatcaacagaaaccgggacagagcccccggttgttaatttacggtggctccactcgcgcggctgggatacctggaaagttttctggctcgggttcagggacggacttcaccctgacaatcagccgagttgatccagaggactttgccgtgtattactgtcagcaatatggaggcagtccctacactttcggccaggggaccaaagtagaaattaag

SEQ ID NO: 24131 - RNA, 399 nt, synthetic construct
  misc_feature 1..399: note = derived and/or modified sequence opt3 from anti-HIV_CH01_HeavyChain
  source 1..399: mol_type = other RNA
gaggtgcagctggtcgaaagcggcgccaacgttgtgagacccgggggatccctcaggctttcttgcaaggcttcaggtttcatctttgagaatttcggctttagttgggtacggcaagcacctgggaaaggactgcagtgggtggccggcttgaactggaatggtggggacacacgctacgcggatagcgtcaagggacgattccgtatgtccagagacaactctaggaattttgtgtatttagatatggacaaagttggcgtggatgacacagctttctactattgtgcccggggcactgattacacgattgacgatgcagggatacactatcagggatcgggtaccttttggtacttcgacctgtggggccgcgggaccctagtctcagtgagcagt

SEQ ID NO: 24132 - RNA, 324 nt, synthetic construct
  misc_feature 1..324: note = derived and/or modified sequence opt3 from anti-HIV_CH02_LightChain
  source 1..324: mol_type = other RNA
gagatcgtgctgacccagagccccgccacactctccgtctctcctggcgaaagagctactctttcatgcagggcaagtcaaaacgttcacccacggtacttcgcctggtatcagcagaagcgcgggcagagcccgcgactgttgattcattccggatctacgcgtgcggctggtatagccgacagattttcgggcgggggatcaggcatgcacttcaccttaacaatcactagggtggagcccgaagattttgcagtatacttctgtcaacagtatggtgggagcccttacacctttggacagggcacacgggtggagctgcgc

SEQ ID NO: 24133 - RNA, 399 nt, synthetic construct
  misc_feature 1..399: note = derived and/or modified sequence opt3 from anti-HIV_CH02_HeavyChain
  source 1..399: mol_type = other RNA
gaggtgcagctggtcgaaagcggcgggtccgttgtgagacccggaggttctctcaggctttcatgccgggccagtggcttcatctttgagaactacgggctgacctgggtacgccaagtgcctggaaagggcttgcactgggtcagcggtatgaattggaacgggggagacacacgatatgctgattccgtgcgtggcagattctctatgtcgagggacaattcaaacaatattgcatacttacagatgaacaatctgcgggttgaagatactgccctatattactgtgcgcgcggcacggactataccatagatgaccaggggagattttaccagggaagcggtacattctggtattttgatttctggggcagggggactctcgtgaccgtcagttcc

SEQ ID NO: 24134 - RNA, 324 nt, synthetic construct
  misc_feature 1..324: note = derived and/or modified sequence opt3 from anti-HIV_CH03_LightChain
  source 1..324: mol_type = other RNA
gagatcgtgctgacccagagccccgccacactctccctttctcctggcgaaagagctactctgtcatgcagggcaagtcaaagcgtccacccaaagtacttcgcctggtatcagcagaaaccggggcagtctccccggttgttaatttactccggatcgacgcgcgcggctggtatagccgaccgattttcaggcgggggaagcggcatccatttcaccctgacaattactcgtgttgagcctgaagattttgcagtgtatttctgtcaacagtacggtgggagtccatatacctttggacagggcacaaaggtagagctaaga

SEQ ID NO: 24135 - RNA, 399 nt, synthetic construct
  misc_feature 1..399: note = derived and/or modified sequence opt3 from anti-HIV_CH03_HeavyChain
  source 1..399: mol_type = other RNA
gaggtgcagctggtcgaaagcggcgggggagttgtgagacccggtggctccctcaggctttcttgcgccgcttcagggttcatctttgagaactacggactgacctgggtacggcaagtgcctggcaagggtttgcactgggtcagtgggatgaattggaacggaggcgacacacgctatgcagatagcgtgcgaggccgtttctccatgtctagagacaattcgaacaatattgcctacttacagatgaaaaacctgagggttgatgacactgcgctatattactgtgctcgggggacggattataccatagacgatcagggaatcttttacaagggttcaggcacattctggtattttgacctctgggggcgcggaactctggtgaccgtcagcagt

SEQ ID NO: 24136 - RNA, 324 nt, synthetic construct
  misc_feature 1..324: note = derived and/or modified sequence opt3 from anti-HIV_CH04_LightChain
  source 1..324: mol_type = other RNA
gagatcgtgctgacccagagccccgacacactctccctttctcctggcgaaagagccactctgtcatgcagggctagtcaaagcgtccactcccggtacttcgcatggtatcagcataagccagggcagccgccccgcttgttaatttacggaggttctacgcgagccaccggcatacctaaccgtttttcggctgggggatcaggcacacagttcactctgaccgttaatagactagaggcggaagattttgccgtgtattactgtcaacagtatggtaggagcccatacacattcgggcagggaaccaaagtagagatccgg

SEQ ID NO: 24137 - RNA, 399 nt, synthetic construct
  misc_feature 1..399: note = derived and/or modified sequence opt3 from anti-HIV_CH04_HeavyChain
  source 1..399: mol_type = other RNA
gaggtgcagctggtcgaaagcggcgggggactcatcagacccggtggctcccttaggctgtcttgcaaggggtcaggattcatttttgagaacttcggctttggttgggttcggcaagggcctggaaaaggcttggaatgggtgagtggcaccaattggaacgggggagacagccgctacggtgattccgtaaagggccgattcacaatatctcgtgacaattcgaacaattttgtgtatttacagatgaactcactgagaccagaggatactgccatctactattgtgctagggggacggactacaccattgatgaccagggaatccggtatcagggcagcggtacattctggtactttgatgtctgggggcgcggaactctagtgaccgttagttcc

SEQ ID NO: 24138 - RNA, 627 nt, synthetic construct
  misc_feature 1..627: note = derived and/or modified sequence opt3 from anti-HIV_CH103_LightChain
  source 1..627: mol_type = other RNA
tacgagctgacccagccccctagcgtgtccgtctctccaggccaaacagccactatcacgtgctcaggggctagtaccaacgtttgttggtatcaggtgaagccgggacagagccccgaagtagtgattttcgagaattacaaaagaccttccggtataccagacaggttttctggctcgaagtcagggagcacagcaactctcaccatccggggaacacaggccattgatgaagcggactattactgccaagtctgggatagtttctccacctttgtgttcggctctggtactcaggttacagtgcttcgccagcccaaagctaaccctaccgtcacgctgtttccacccagctccgaggaattgcaggccaataaggcaactttagtgtgtctgatctcagacttctatcctggggccgtaaccgttgcttggaaagcagatagtagcccagtgaaggccggagtcgagacaactaccccgtctaagcaatccaacaataaatacgctgcctcaagctatctaagtctcacacccgagcagtggaagtctcaccgatcctacagctgccaggtgacccatgaaggctcgacggtggagaaaactgtcgcgcctacagaatgttct

SEQ ID NO: 24139 - RNA, 678 nt, synthetic construct
  misc_feature 1..678: note = derived and/or modified sequence opt3 from anti-HIV_CH103_HeavyChain
  source 1..678: mol_type = other RNA
caggtgcaactgcaggagagcggccccggggtcgttaagtcctctgaaaccctctcacttacatgcactgtgagtggaggtagcatgggcgggacgtactggtcctggctgagattgtctcctggaaaaggcttagagtggatcggttatattttccacaccggggaaacaaactactcgccatcactgaagggaagggtaagcataagtgtggacacttccgaggatcagttttctctacggctccgcagcgtcaccgccgctgacacagcagtgtatttctgtgcctccctgccgcgaggccagcttgttaatgcgtactttcgtaactggggcagagggtcactggtgagtgtcaccgctgccagcactaaaggaccctctgtgttccctttggcaccatcctcaaagagcacaagtggtggcaccgccgctctcgggtgcctggtaaaagattattttcccgaacctgttacggtgtcttggaactccggagcactgactagcggcgtccataccttcccagccgtgctccaatcgtctggtttatactccctgtcaagtgtggtcacagttcccagctcctctcttgggactcagacctatatctgtaatgtgaatcacaagcctagcaacacaaaggtagacaaaaaggtggagccaaaatcatgcgataag

SEQ ID NO: 24140 - RNA, 321 nt, synthetic construct
  misc_feature 1..321: note = derived and/or modified sequence opt3 from anti-HIV_M66.6_LightChain
  source 1..321: mol_type = other RNA
gacatccagctgacccaaagcccctcctctctctcagccagtgtgggcgatagagtcacaattacttgcagggctagccagtccatagggtcttaccttaactggtatcagcagaagcctggaaaagcaccaaagctgttgatctacgccgcgtcgacgttacaatcaggtgttccgagccggttcagtggctccgggtctggaaccgactttacactgactattagctccctacagcccgaggattcagctacctattactgtcagcagagttatagcacacctttcacctttggcccaggtactaaagtggacatccgc

SEQ ID NO: 24141 - RNA, 390 nt, synthetic construct
  misc_feature 1..390: note = derived and/or modified sequence opt3 from anti-HIV_M66.6_HeavyChain
  source 1..390: mol_type = other RNA
caggtgcaactggtccagagcggcgccgaggttaagaaacccggggaatccctcaagatctcttgcaaagtgtcaggatacaacttcgctagtgagtggattggttgggtaagacagatgcctggcaaggggcttgaatggatgggaataatctatccaggcgacagcgataccaaatactccccgtcttttcagggtcaagtgattatctcggcagacaagtcaattaatacagcctatctgcagtggagcagtttgaaggcgtccgatactgctatctactattgtgccaggcagaaccactacgggtctggaagctatttctaccggacggcatactattacgccatggacgtctggggccagggcaccacagtgactgtttcctca

SEQ ID NO: 24142 - RNA, 327 nt, synthetic construct
  misc_feature 1..327: note = derived and/or modified sequence opt3 from anti-HIV_NIH45-46_LightChain
  source 1..327: mol_type = other RNA
gaaatcgtgctgacccagagccccgccacactctccctttctcctggcgaaactgctattatatcatgcagaacgagtcaaagcgggtccctggcatggtaccagcagaggccaggacaggccccgcggttggtcatctattctggttcgacccgcgcggctggcattcccgaccgattctcagggagccgttggggagccgattacaacttaagtatctccaatctggagtctggcgactttggtgtttattactgtcaacagtatgagttctttgggcagggaacaaaggtgcaggtagatattaaaagaactgtggcagcccct

SEQ ID NO: 24143 - RNA, 399 nt, synthetic construct
  misc_feature 1..399: note = derived and/or modified sequence opt3 from anti-HIV_NIH45-46_HeavyChain
  source 1..399: mol_type = other RNA
caggtgagactgagccaatccggcgggcagatgaagaaacccggagagtctatgaggctctcatgccgggccagtggttacgagttccttaactgtcctatcaattggattcgcctggctccaggccgacgtccggaatggatggggtggttgaagcccagaggaggcgcagtcaactatgccaggaaatttcagggtcgggttaccatgacacgcgacgtgtacagcgatactgcgttcttagaactgagatccctaacgtctgacgataccgctgtatatttttgcacaagggggaagtactgtactgcccgggactattacaattgggatttcgagcactggggacgcggcgcacctgtgaccgtctcgtcagccagcacaaaaggcccaagtgtg

SEQ ID NO: 24144 - RNA, 330 nt, synthetic construct
  misc_feature 1..330: note = derived and/or modified sequence opt3 from anti-HIV_PG16_LightChain
  source 1..330: mol_type = other RNA
cagagcgccctgacccaacccgcttccgtgtctggctcacctgggcagacaatcactattagttgcaacggaacgagctccgacgtcggtggcttcgattctgtttcgtggtaccagcagtcaccagggaaggcaccgaaagtgatggtatttgacgtgagccacagacccagtggaatatccaataggttctctggcagcaagtccggtaacaccgcctcactcacaatcagtgggcttcatattgaggatgaaggagactatttttgtagctctctgactgatcggtcccaccgcatcttcggcggcgggaccaaagtcacagtgttg

SEQ ID NO: 24145 - RNA, 411 nt, synthetic construct
  misc_feature 1..411: note = derived and/or modified sequence opt3 from anti-HIV_PG16_HeavyChain
  source 1..411: mol_type = other RNA
caggagcaactggtggaaagcggcgggggagtcgttcagcccggtggctccctcagactttcttgcctggcctcagggttcacctttcacaagtacggaatgcattgggtgaggcaggctcctggcaaaggtttggagtgggtagcattaatcagtgacgatgggatgcggaagtatcacagcgactccatgtggggacgcgtgacaatttctcgagataactcgaaaaatactctgtacctacagttctcaagcctcaaggtcgaagacacggccatgtttttctgtgcgcgtgaggctggcggcccaatatggcatgatgacgtgaaatattacgattttaacgacgggtattacaattatcactacatggatgtttggggaaagggtaccacagtgactgtcagttcc

SEQ ID NO: 24146 - RNA, 315 nt, synthetic construct
  misc_feature 1..315: note = derived and/or modified sequence opt3 from anti-HIV_PGT122_LightChain
  source 1..315: mol_type = other RNA
accttcgtgagcgtcgcccccggccagacagctagaatcacttgcggggaggaatccctgggatctaggtcagttatttggtaccaacagcggcctggtcaggcaccaagtctcataatctataacaataacgaccgcccgagcggcattcccgatcgattttccgggtctcctggatcgacgttcggcaccacagccactcttaccatcacatcagtggaggcgggtgacgaagctgattactattgtcacatttgggacagccgtagaccaaccaattgggtatttggggagggaactacactgatcgtgttg

SEQ ID NO: 24147 - RNA, 396 nt, synthetic construct
  misc_feature 1..396: note = derived and/or modified sequence opt3 from anti-HIV_PGT122_HeavyChain
  source 1..396: mol_type = other RNA
caggtgcatctgcaagagagcggccccgggctcgtcaagccttccgaaaccctttctctgacatgcaacgtttcaggaactttggtgagagacaattactggagttggatcaggcagccattaggtaaacagccggagtggattggctatgtacacgatagcggggacacgaactacaatccctccctgaagtctcgggtgcacctatcgctcgataaatcaaagaacctggtcagccttcgcctgaccggagtgacagccgctgacagtgcaatatattactgtgccactaccaaacatggccgacgtatctatggtgttgtggcgttcaaggaatggtttacatacttctatatggatgtctgggggaagggaacctccgtgactgtatctagc

SEQ ID NO: 24148 - RNA, 315 nt, synthetic construct
  misc_feature 1..315: note = derived and/or modified sequence opt3 from anti-HIV_PGT123_LightChain
  source 1..315: mol_type = other RNA
agctccatgtctgtgtcacccggcgagaccgccaagatcagttgcgggaaagaaagcattggatccagagctgtccagtggtaccaacagaagcctggtcagccaccgtctctgataatctataacaatcaggacaggcccgcaggcgttcctgagcggttctcggcctcaccagattttcgccccgggacaactgcgacgctcaccattacaaacgtggacgctgaagatgaggccgactactattgtcacatctacgatgcacgaggaggcactaattgggtattcgaccgtggtaccacacttaccgtgctg

SEQ ID NO: 24149 - RNA, 396 nt, synthetic construct
  misc_feature 1..396: note = derived and/or modified sequence opt3 from anti-HIV_PGT123_HeavyChain
  source 1..396: mol_type = other RNA
cagctgcacctccaagagagcggccccgggcttgtgaagcctccagaaaccctgtccttgacatgctctgtctcaggagccagtatcaacgacgcttactggagctggattagacagtccccgggtaaaaggcccgagtgggttggctatgtgcatcactctggggatactaattacaacccttcgttaaagcggcgcgtaacgttctcactggacaccgccaaaaatgaagtgagcctaaagctcgtcgatctgacagcagcggacagtgctacttatttttgtgcccgagcacttcatggaaaacgtatatacggcatcgtggccctgggtgagttgttcacctatttttacatggatgtttgggggaagggaacagctgtgaccgtctcctct

SEQ ID NO: 24150 - RNA, 315 nt, synthetic construct
  misc_feature 1..315: note = derived and/or modified sequence opt3 from anti-HIV_PGT125_LightChain
  source 1..315: mol_type = other RNA
cagagcgccctgacccaacccccttccgcttctggctcaccagggcagagtatcacaattagctgcaacggaactgcaacgaatttcgtgtcctggtaccagcagtttccggacaaggcccccaaactcataatcttcggtgtcgataagagacctccaggcgttcccgacaggttttctgggtcgcggtcaggaaccacagcgagccttactgtgagtcgcctgcaaaccgatgacgaggctgtatattactgtggctccttggtgggtaactgggatgtcattttcgggggaggcacaaccttaactgtgctg

SEQ ID NO: 24151 - RNA, 411 nt, synthetic construct
  misc_feature 1..411: note = derived and/or modified sequence opt3 from anti-HIV_PGT125_HeavyChain
  source 1..411: mol_type = other RNA
cagagccaactgcaggagtccggccccagactcgtggaagcctctgagaccctttcactgacatgcaacgtcagtggggaaagcactggagcttgtacgtacttctggggttgggttaggcaggcacctggcaaggggttggagtggatcggatccttatctcactgccagtcgttttggggctcaggttggaccttccataatccaagcctgaaaagtcggctaacaatttccctcgacactccgaagaaccaagtgtttctgaaacttacctctctgacagccgcggataccgctacttattactgtgcccgcttcgacggggaagtattggtgtataatcactggcccaagcctgcatgggtcgatctctggggacgaggcataccagtgacagttaccgtgagctcc

SEQ ID NO: 24152 - RNA, 315 nt, synthetic construct
  misc_feature 1..315: note = derived and/or modified sequence opt3 from anti-HIV_PGT126_LightChain
  source 1..315: mol_type = other RNA
cagagcgccctgacccaacccccttccgcttctggctcaccagggcagagtatcagcatttcctgcacaggaacttctaacagattcgtgtcgtggtaccagcagcacccgggtaaggcacccaaactcgtcatatatggcgttaataagaggccttcaggggtgccagaccggtttagcggaagtaaatccggcaacacggcctctcttaccgtaagcggtctgcaaacagatgacgaggcggtgtactattgttcctcattggtcgggaattgggatgtgatcttcggaggcggcactaagttaaccgttctg

SEQ ID NO: 24153 - RNA, 411 nt, synthetic construct
  misc_feature 1..411: note = derived and/or modified sequence opt3 from anti-HIV_PGT126_HeavyChain
  source 1..411: mol_type = other RNA
cagccccaactgcaggagagcggccctgggctcgtggaagcctccgagaccctttctctgacatgcactgtctcaggagacagtacggctgcatgtgattacttctggggttgggttagacagccaccgggcaaggggttggaatggatcggaggcttaagccactgcgccggttattacaacaccgggtggacatatcataatccctccctgaaatctaggctaactatttcgctcgacacccctaagaaccaggtgtttctgaaacttaattcagtaacagcggctgataccgccatatactattgtgcacggttcgacggagaggtgctggtctaccacgattggccaaagcccgcctgggtggacttgtggggccgcggcactctcgttacagtgaccgtcagcagt

SEQ ID NO: 24154 - RNA, 315 nt, synthetic construct
  misc_feature 1..315: note = derived and/or modified sequence opt3 from anti-HIV_PGT127_LightChain
  source 1..315: mol_type = other RNA
cagagcgccctgacccaacccccttccgcttctggctcaccagggcagagtatcacaattagctgcactggaacgtccaacaatttcgtgtcttggtaccagcagtatccgggtaaggcacccaaactcgtcatatacgaggttaacaagagaccttcgggcgtgccagacaggttttcagggagcaaaagtggatccaccgcctctcttacagtaagcggcctgcaagcggatgacgaaggtgtgtattactgttcctcattggtcgggaattgggatgtgatcttcggaggcggcactaagttaaccgttctg

SEQ ID NO: 24155 - RNA, 405 nt, synthetic construct
  misc_feature 1..405: note = derived and/or modified sequence opt3 from anti-HIV_PGT127_HeavyChain
  source 1..405: mol_type = other RNA
cagccccaactgcaggagagcggccctgggctcgtggaagcctccgagaccctttctctgacatgcactgtctcaggagacagtacgggtagatgtaactacttctggggctgggttaggcagccaccggggaagggattggaatggatcggcagcttatcccactgccggtcttattacaataccgattggacatatcataacccctcgctgaaatcacgcctaactattagcctcgacacccctaagaatcaggtgtttctgcgacttacaagtgtaaccgctgcagatactgccacatactattgtgcgcgtttcggtggggaggtgctggtctacagagactggccaaaacccgcttgggtggatttgtggggaaggggcaccctcgttacggtgtcctct

SEQ ID NO: 24156 - RNA, 315 nt, synthetic construct
  misc_feature 1..315: note = derived and/or modified sequence opt3 from anti-HIV_PGT128_LightChain
  source 1..315: mol_type = other RNA
cagagcgccctgacccaacccccttccgcttctggctcaccagggcagagtatcacaattagctgcactggaacgtccaacaatttcgtgtcttggtaccagcagcacgcaggtaaggccccgaaactcgtcatatatgacgttaacaagagaccctcgggcgtgcctgataggttttcagggagcaaaagtggaaataccgcgtcccttacagtatctggcctgcaaactgacgatgaggctgtgtactattgtggtagcttggtcgggaactgggacgtgatcttcggaggcggcaccaagttaacagttctg

SEQ ID NO: 24157 - RNA, 405 nt, synthetic construct
  misc_feature 1..405: note = derived and/or modified sequence opt3 from anti-HIV_PGT128_HeavyChain
  source 1..405: mol_type = other RNA
cagccccaactgcaggagagcggccctaccctcgtggaagcctccgagacactttctctgacttgcgctgtctcaggggacagtacggcagcctgtaacagcttctggggatgggttagacagccaccgggtaagggcttggaatgggtggggtccttatctcactgcgcgtcgtactggaataggggatggacctatcataacccctcactgaaaagccggctaacactcgctctggatactcctaagaatcttgtatttctgaaattgaacagtgtgaccgccgcagacacagccacctactattgtgctcgcttcggcggtgaggtcctccgatacactgattggccaaagcccgcatgggtggacctgtgggggcgtggaacactggttaccgtgtcctct

SEQ ID NO: 24158 - RNA, 330 nt, synthetic construct
  misc_feature 1..330: note = derived and/or modified sequence opt3 from anti-HIV_PGT130_LightChain
  source 1..330: mol_type = other RNA
cagagcgccctgacccaacccccttccgcttctggctcactcgggcagagtgtgacaatcagctgcaacggaacttcctctgacattggtggctggaatttcgtctcgtggtaccagcagtttccagggagagcaccgaggcttataatcttcgaggttaacaagcggccctcaggagtgcctggccgctttagcggtagtaaatccggaaattctgccagcctgacggtatccgggttgcaatcagatgacgaaggccagtatttctgtagtagcttatttggccgatgggatgtggtcttcgggggaggtaccaagctgacagtgcta

SEQ ID NO: 24159 - RNA, 387 nt, synthetic construct
  misc_feature 1..387: note = derived and/or modified sequence opt3 from anti-HIV_PGT130_HeavyChain
  source 1..387: mol_type = other RNA
caggtgcaactgcaggagagcggccccgggctcgtcaagcctgccgaaaccctttccctgacatgctctgtttcaggagagagtatcaacactggtcactactattggggctgggtgagacaggtaccagggaaaggattggaatggattggccatatacactacacgaccgctgtgttacataatccgagcctgaagtccaggctaacaatcaaaatttatactctccggaaccagatcaccctgcgcctttctaatgtcacagcagccgacaccgcggtgtaccactgtgttcgatcgggtggggatattctgtattactatgagtggcaaaagccccattggttctcaccttggggaccaggcatccacgtgactgtcagcagt

SEQ ID NO: 24160 - RNA, 330 nt, synthetic construct
  misc_feature 1..330: note = derived and/or modified sequence opt3 from anti-HIV_PGT131_LightChain
  source 1..330: mol_type = other RNA
cagagcgccctgacccaacccccttccgcttctggctcactcgggcagagtcttacaatcagctgctccggaactggttctgacattggctcgtggaacttcgtgtcatggtaccagcagtttccagggagagcaccgaatctgataatcttcgaggtcaacaggcggcgcagcggagttcccgatcgatttagtggctccaagtctggtaatacggccagcttgaccgtgtccgggttacgttcagaagacgaggcggaatatttctgtagtagcctgtctggaagatgggatattgtatttggcggcgggacaaaagtgactgtccta

SEQ ID NO: 24161 - RNA, 387 nt, synthetic construct
  misc_feature 1..387: note = derived and/or modified sequence opt3 from anti-HIV_PGT131_HeavyChain
  source 1..387: mol_type = other RNA
caggtgcaactgcaggagagcggccccgggctcgtcaagccttccgaaaccctttctctgacatgcactgtttcaggagacagtatcaacacgggtcaccattactggggctgggtgagacaggtaccagggaaaggaccggagtggattgcccacatacattataataccgctgtgttgcacaaccccgcattaaagagcagggtcacaatctccattttcactctgaaaaatctaatcaccctctctctgtcgaacgtgacagccgcggataccgctgtttacttttgtgtgcggtcaggcggtgacattctttattacatcgaatggcagaagcctcattggttctatccatgggggcccggaatactggtcactgtgagcagt

SEQ ID NO: 24162 - RNA, 321 nt, synthetic construct
  misc_feature 1..321: note = derived and/or modified sequence opt3 from anti-HIV_PGT135_LightChain
  source 1..321: mol_type = other RNA
gagatcgtgatgacccagagccccgacacactgtccgtctctcctggcgaaactgttacgctctcatgcagagccagtcaaaacattaataagaaccttgcttggtaccagtataaaccagggcagagcccgaggctggtgatattcgagacctactccaagatcgcagcctttcccgcgcggttcgtagcttctggatcgggtacagaatttactttgaccattaataacatgcagtcagaggatgtggccgtctattactgtcaacagtatgaagagtggcctcgcacattcggccaggggaccaaagtggacatcaag

SEQ ID NO: 24163 - RNA, 399 nt, synthetic construct
  misc_feature 1..399: note = derived and/or modified sequence opt3 from anti-HIV_PGT135_HeavyChain
  source 1..399: mol_type = other RNA
cagctgcaaatgcaggagagcggccccgggctcgtgaagccttccgaaaccctttctctgtcatgcacagtcagtggagacagcatcagaggtggcgagtggggagataaagactaccactgggggtgggttaggcattccgccggcaagggtttggaatggattgggtctatacactggcggggaactacgcattataaagagtcgttacgccgacgtgtgtcaatgagcatcgataccagtagaaactggttctccctgaggctagcttctgtaacagcagccgacactgcggtgtacttttgtgctcggcaccgccatcacgatgtcttcatgctcgtgccaattgccggctggtttgacgtttggggcccgggggtgcaggtcaccgtgagctcc

SEQ ID NO: 24164 - RNA, 321 nt, synthetic construct
  misc_feature 1..321: note = derived and/or modified sequence opt3 from anti-HIV_PGT136_LightChain
  source 1..321: mol_type = other RNA
gagatcgtgatgacccagtcaccccctacactgtccgtctctccaggcgaaactgccacgctctcatgcagagctagtcaaaacgttaagaataaccttgcatggtaccagctgaaaccggggcaggcccccaggttgttaattttcgacgcgagctcccgggctggaggtatacctgatcgcttttctggctcggggtatggaaccgacttcacactgactgtgaatagcgtacagagcgaggattttggcgactacttctgtcaacagtatgaagagtggccacgaacctttggtcaggggacaaaggtggatatcaaa

SEQ ID NO: 24165 - RNA, 402 nt, synthetic construct
  misc_feature 1..402: note = derived and/or modified sequence opt3 from anti-HIV_PGT136_HeavyChain
  source 1..402: mol_type = other RNA
cagctgcaactccaggagagcggccccgggcttgtgaagccttccgaaaccctgtctttgacatgcactgtctcaggaggtagtatgagaggcacggactggggagagaacgatttccactacgggtggatcaggcagagctccgccaaaggcttagaatggattggttctatacattggcgggggcgcaccacacactataagacttcgtttcgatcacgtgctaccctgagcatcgacacaagtaataacagattctccctaaccttttctttcgttactgcagccgatacagcggtgtactattgtgctaggcataaataccacgacatttttcgggtagtgccagtcgccggatggttcgatccgtggggccagggcctcctggtgaccgttagctcc

SEQ ID NO: 24166 - RNA, 321 nt, synthetic construct
  misc_feature 1..321: note = derived and/or modified sequence opt3 from anti-HIV_PGT137_LightChain
  source 1..321: mol_type = other RNA
gagatcatgatgacccagagccccgccattctgtccgtgtctcctggcgacagagctacactctcatgcagggcaagtcaaagcgtcaagaacaatcttgcctggtaccagaaacggccagggcaggcgccgcgcctgttgatattcgatacttcctctcgagcttcgggaatccccgcccgtttttcaggtggcgggagcggaacggagttcaccttaacagttaacagtatgcagtccgaagactttgcaacttattactgtcaacagtatgaagagtggcctagaaccttcggccagggtacaaaggtggaaattaaa

SEQ ID NO: 24167 - RNA, 399 nt, synthetic construct
  misc_feature 1..399: note = derived and/or modified sequence opt3 from anti-HIV_PGT137_HeavyChain
  source 1..399: mol_type = other RNA
gaggtgcacctggaagagagcggccccgggctggtcagaccttccgaaaccctttctctgacatgcactgcctcaggaggtagtatcaggggcggggagtggggagacagcgattaccattggggctgggttcggcactccccagaaaagggtttggagtggattgggtctatacattggcgcggaacgacccactataacgctccgttccgaggccgtggcagattatcgatcgacctgtcaaggaatcagtttagcctacggctcacaagtgtgactgcagaggataccgccgtatactattgtgtgaaacataagtaccacgacattgtcatggtggttcccatcgcggggtggttcgatccttggggacaaggtctccaggtgacagtctcctct

SEQ ID NO: 24168 - RNA, 336 nt, synthetic construct
  misc_feature 1..336: note = derived and/or modified sequence opt3 from anti-HIV_PGT141_LightChain
  source 1..336: mol_type = other RNA
gacaccgtggtcacacagagccccctgtccctccctgttactccaggcgaggccgcttctatgtcatgcagtagcacgcaatcccttagacactctaacggggcaaattacctggcctggtatcagcataagccgggacagtcgcccaggttgttaatccggctgggttcacagcgcgcgagcggcgtgcctgatcgattcagtgggtccggatctggcacccactttacactaaaaattagccgtgtagaagctgaggacgccgcaatatactattgtatgcaaggtctcaacagaccatggactttcgggaagggaaccaaactggaaatcaag

SEQ ID NO: 24169 - RNA, 423 nt, synthetic construct
  misc_feature 1..423: note = derived and/or modified sequence opt3 from anti-HIV_PGT141_HeavyChain
  source 1..423: mol_type = other RNA
caggtgcaactggtccagagcggccccgaggttaagaaacctgggtcctctgtgaaggtatcatgcaaagccagtggaaacaccttcagcaagtacgacgtgcactgggtcagacaggctacaggtcagggcctcgaatgggtggggtggatgtcccatgagggagataaaactgaatctgcacaaaggtttaagggccgggttacgttcacccgcgacacatcggcctcaactgcgtatatggagcttcgaggtctgaccagcgatgacacagctatctactattgtacccgtgggagtaagcacagattgagggattacgtgttatatgacgattacggactgattaattatcaggaatggaacgactacctagagtttctcgatgtctggggccatggcactgccgtgacagtatcctct

SEQ ID NO: 24170 - RNA, 336 nt, synthetic construct; identical to SEQ ID NO: 24168
  misc_feature 1..336: note = derived and/or modified sequence opt3 from anti-HIV_PGT142_LightChain
  source 1..336: mol_type = other RNA

SEQ ID NO: 24171 - RNA, 423 nt, synthetic construct
  misc_feature 1..423: note = derived and/or modified sequence opt3 from anti-HIV_PGT142_HeavyChain
  source 1..423: mol_type = other RNA
caggtgcaactggtccagagcggccccgaggttaagaaacctgggtcctctgtgaaggtatcatgcaaagccagtggaaacaccttcagcaagtacgacgtgcactgggtcagacaggctacaggtcagggcctcgaatgggtggggtggatctcccatgagagggataaaactgaatctgcacaacggtttaagggacgcgttacgttcacccgagacacatcggccactaccgcgtatatggagcttcgtggcctgacatcagatgacaccgctatttactattgtactagaggtagcaagcacaggttgcgggattacgtgttatatgacgattacgggctgataaattatcaggaatggaacgactacctagagtttctcgatgtctggggacatggcacagccgtgaccgtaagttcc

SEQ ID NO: 24172 - RNA, 336 nt, synthetic construct
  misc_feature 1..336: note = derived and/or modified sequence opt3 from anti-HIV_PGT143_LightChain
  source 1..336: mol_type = other RNA
gacaccgtggtcacacagagccccctgtccctccctgttactccaggcgaggccgcttctatgtcatgcacgagtacccaaagccttagacactccaacggggcaaattacctggcctggtatcagcataagccgggacagtctcccaggttgttaatccggctgggttcgcagcgcgcgtcaggcgtgcctgatcgattcagcgggagtggatccggcacacactttactctaaaaatttctcgtgtagaaccagaggacgctgccatatactattgtatgcaaggtctcaacagaccctggaccttcgggaagggaacaaaactggaaatcaag

SEQ ID NO: 24173 - RNA, 423 nt, synthetic construct
  misc_feature 1..423: note = derived and/or modified sequence opt3 from anti-HIV_PGT143_HeavyChain
  source 1..423: mol_type = other RNA
caggtgcaactggagcagagcggcgccgaagtcaagaaacccgggtcctctgttaaggtgtcatgcaaagctagtggaaacaccttcagcaagtacgacgtacactgggtgagacaggcaacaggtcagggcctcgagtgggtcgggtggatgtcccatgaaggagataaaactgagtctgcccaaaggtttaagggccgggtgacgttcacccgcgacacatcggcgtcaactgcttatatggaacttcgaggtctgaccagcgatgacacagccatctactattgtacccgtgggagtaagcacagattgagggattacgttttatatgacgattacggactgattaattatcaggagtggaacgactacctagagtttctcgatgtgtggggccatggcactgcagtcacagtgtcctct

SEQ ID NO: 24174 - RNA, 336 nt, synthetic construct
  misc_feature 1..336: note = derived and/or modified sequence opt3 from anti-HIV_PGT144_LightChain
  source 1..336: mol_type = other RNA
gacaccgtggtcacacagagccccctgtccctctctgttactcctggcgaggccgcttcaatgagttgcacgagcacccaatcccttagacactctaacggggcaaattacctggcctggtatcagcataagccaggacagtcgccgaggttgttaatccggctgggttcacagcgcgcgagcggcgtgcccgatcgattcagtgggtccggatctggcacacactttactctaaaaattagccgtgtagaagctgacgatgccgcaatatactattgtatgcaaggtctcaacagaccttggaccttcgggaagggaacaaaactggagatcaag

SEQ ID NO: 24175 - RNA, 423 nt, synthetic construct
  misc_feature 1..423: note = derived and/or modified sequence opt3 from anti-HIV_PGT144_HeavyChain
  source 1..423: mol_type = other RNA
caggtgcaactggtccagagcggcgccgaggttaagaaacccgggtcctctgtgaaggtatcatgcaaagctagtggaaacaccttcagaaagtacgacgtgcactgggtcaggcaggcaacaggtcagggcctcgaatgggtggggtggatgagccatgagggagataaaactgaatccgcccaacggtttaagggccgcgtttctttcacgcgagacaattcggcgtcaaccgcttatatcgagcttcgtggtctgacaagcgatgacactgccatttactattgtaccgggggaagtaagcacagattgagggattacgtgttatatgacgattacggcctgataaaccagcaggaatggaatgactatctagagtttctcgatgtctggggccatgggacagcagtgaccgtatcctct

SEQ ID NO: 24176 - RNA, 336 nt, synthetic construct
  misc_feature 1..336: note = derived and/or modified sequence opt3 from anti-HIV_PGT145_LightChain
  source 1..336: mol_type = other RNA
gaggtggtcatcacccagagccccctgttcctccctgttacaccaggcgaagccgcttccctttcttgcaagtgttcacacagtctgcaacatagcactggggcaaactacttggcctggtatttacagagaccgggacagacgcccaggctgctaattcacctcgcgacccatcgggcttccggtgtgcctgaccgcttttctggctcggggtcaggaacagatttcactctgaaaataagccgagtagagagtgacgatgtgggcacctactattgcatgcagggtcttcactccccatggacatttgggcaaggaaccaaggtcgaaatcaaa

SEQ ID NO: 24177 - RNA, 420 nt, synthetic construct
  misc_feature 1..420: note = derived and/or modified sequence opt3 from anti-HIV_PGT145_HeavyChain
  source 1..420: mol_type = other RNA
caggtgcaactggtccagagcggcgccgaggttaagaaacccgggtcctctgtgaaggtatcatgcaaagctagtggaaacagcttctccaatcacgacgtgcattgggtcagacaggcaaccggtcagggcctcgaatggatggggtggatgtctcacgagggagataagacaggccttgcccaaaaatttcagggtagggtgactatcacgcgggactcgggggcgtcaaccgtttacatggaactgcgcggattgacagctgatgacactgccatttattactgtttaaccggcagcaagcatcgactgcgtgattatttcctatacaacgagtatggccctaattacgaagagtggggagactatctcgcaacactggatgtgtgggggcacggtaccgccgtcactgtgagttcc

SEQ ID NO: 24178 - RNA, 657 nt, synthetic construct
  misc_feature 1..657: note = derived and/or modified sequence opt3 from anti-HIV_PGT151_LightChain
  source 1..657: mol_type = other RNA
gacatcgtgatgacccagacacccctgagcctctccgtcactcctggccaaccagcctctatttcatgcaagagtagcgagtcccttagacagtctaacgggaaaacgtcgctgtactggtataggcagaagccgggacagtcaccccaattgttagttttcgaagtgagcaatcggtttagtggtgtatccgatcgcttcgtgggctctgggagcggaaccgactttacactgcgaatatcccgtgtcgaggctgaagatgtgggcttctactattgtatgcagtcaaaagactttcctctaactttcggtgggggaaccaaggttgatctcaaaagaacagtggcagccccaagtgtctttatctttccccctagcgacgagcagctgaagtctggcaccgcgtccgtggtatgccttctgaacaatttctacccaagggaagctaaggttcagtggaaagtggataacgccttgcaatcaggcaatagccaggagagtgtcactgagcaggactctaaggattccacatatagcctctcgtctaccctgacgctgtccaaagcagactacgaaaagcacaaagtgtatgcctgtgaggtgactcatcaggggctctcaagtcccgtcaccaagagcttcaaccggggagaatgc

SEQ ID NO: 24179 - RNA, 720 nt, synthetic construct
  misc_feature 1..720: note = derived and/or modified sequence opt3 from anti-HIV_PGT151_HeavyChain
  source 1..720: mol_type = other RNA
agagtgcagctggtcgagagcggcgggggagttgtgcaacccggtaagtccgtaaggctctcttgcgtggtctcagacttcccttttagtaaatacccaatgtattgggtgcggcaggccccgggcaaggggcttgaatgggttgctgcaatcagcggagatgcctggcacgtggtctactccaactctgtgcagggccgcttcctggtatcgcgagacaatgttaaaaacaccttgtatttagagatgaactcactgaagattgaagatacagcggtgtaccgttgtgctagaatgtttcaggagagcggtccccctaggctagaccggtggagtgggcgcaattattactattactccggaatggatgtctggggccaaggcactacggtgaccgtgtctagcgcctccacaaaagggccatcagtcttccccctcgcacctagtagcaagtctacttccggaggtaccgccgctctgggctgccttgttaaggactactttccagaacccgtgacagtatcatggaatagcggggcactgaccagtggagtgcatactttccctgccgtcttgcagtcttccggcctctatagcctgtcgtctgtggttacagtgccatcctcaagtctgggtacccagacgtacatatgtaacgtcaatcacaaaccgagcaacactaaggtggataaaagagtagagcccaagtcctgcgacaaa

SEQ ID NO: 24180 - RNA, 657 nt, synthetic construct
  misc_feature 1..657: note = derived and/or modified sequence opt3 from anti-HIV_PGT152_LightChain
  source 1..657: mol_type = other RNA
gacatcgtgatgacccagacacccctgagcctctccgtcgatcctggccaaccagcctctatttcatgcaagagtagccagtcccttagacagtctaacgggaaaacttcgctgtactggtatcagcaaaagccgggacagtcaccccagttgttaatattcgaggttagcaataggtttagtggtgtgtccgaccggttcgtaggctctgggagcggaacggattttaccctgcgcatctcccgagtggaagctgaggacgtcggcttctactattgtatgcagtcaaaagattttcctctaacattcggtgggggaactaaggtggacctcaaacgtaccgttgcagccccaagtgtgtttatttttccccctagcgatgaacaactgaagtctggcacagcgtccgtcgtgtgccttctgaacaatttctacccaagagaggctaaggtacagtggaaagttgacaacgccttgcagtcaggcaatagccaggaaagtgtgaccgagcaagattctaaggactccacttatagcctctcgtctacactgaccctgtccaaagcagattacgagaagcacaaagtctatgcctgtgaagtgacgcatcaggggctctcaagtcccgtgactaagagcttcaacaggggagagtgc

SEQ ID NO: 24181 - RNA, 720 nt, synthetic construct
  misc_feature 1..720: note = derived and/or modified sequence opt3 from anti-HIV_PGT152_HeavyChain
  source 1..720: mol_type = other RNA
agagtgcagctggtcgagagcggcgggggagttgtgcaacccggtaagtccgtaaggctctcttgcgtggtctcagacttcccttttagtaaatacccaatgtattgggtgcggcaggccccgggcaaggggcttgaatgggttgctgcaatcagcgccgatgcgtggcacgtggtctactccggatctgtgcagggccgcttcctggtatcgcgagacaacagcaaaaatattttgtatttagagatgaacaccctgaagatagaagatacagctgtttaccgttgtgccagaatgtttcaggagtcaggtccccctaggttcgacagttggtccgggcggaattattactattactctggaatggatgtgtggggccaaggcactacggtcaccgtgagctccgcatcaacaaaagggccaagtgtgtttcccctagcccctagctctaagtccacttcaggaggtaccgctgcactcggctgcctggtcaaggactacttcccagaacccgttacagtgagctggaacagtggggcccttacctctggagtacatacttttcctgctgtgctgcagtccagcggcttgtattcgctctcttccgtcgtgacagttccatcaagtagcctgggtacccagacgtacatctgtaatgtgaaccacaaaccgtccaatactaaggtcgataaacgcgtggagcccaagtcttgcgacaaa

SEQ ID NO: 24182 - RNA, 309 nt, synthetic construct
  misc_feature 1..309: note = derived and/or modified sequence opt3 from anti-HIV_VRC-CH30_LightChain
  source 1..309: mol_type = other RNA
gacatccagatgacccaaagcccctcctctctgtcagccagtctcggcgatagagtgacaattacttgccaggctagcagggggataggaaaggaccttaactggtaccagcagaaacctggtaaggcaccaaaactgttggtctccgatgcctctatcttagagggcggggttccgtcgcggttctcaggaagcggctttcaccaaaatttcagtctgacgatttcctctctacagcccgaagacgtggcgacctatttttgtcagcagtacgagacattcggtcaagggactaaggtagatatcaaa

SEQ ID NO: 24183 - RNA, 393 nt, synthetic construct
  misc_feature 1..393: note = derived and/or modified sequence opt3 from anti-HIV_VRC-CH30_HeavyChain
  source 1..393: mol_type = other RNA
caggtgcaactggtccagagcggcgccgctgttagaaagcccggggcatccgtgaccgtatcttgcaaattcgccgaggacgatgactactcacctcactgggtgaacccagcgccggaacattatatccactttctcaggcaggctcccggacagcaacttgagtggctggcctggatgaatcctacaaacggtgcagtcaattacgcctggcagttgcatggccggttaactgctacgcgcgatgggagtatgaccacagcattcctggaagtgcgaagcctacgttccgacgatactgccgtttattactgtgctagagcccagaagaggggacggtctgagtgggcgtatgcacactggggccagggtaccccagtggccgtctcgtca

SEQ ID NO: 24184 - RNA, 309 nt, synthetic construct
  misc_feature 1..309: note = derived and/or modified sequence opt3 from anti-HIV_VRC-CH31_LightChain
  source 1..309: mol_type = other RNA
gacatccagatgacccaaagcccctcctctctgtcagccagtctcggcgatagagtgacaattacttgccaggctagcagggggataggaaaggaccttaactggtaccagcagaaagcaggtaaggcccctaaactgttggtctccgatgcgtctacgttagagggcggggttccatcgcggttctcaggaagcggctttcaccaaaatttcagtctgaccatctcctctctacaggctgaagacgtggccacatatttttgtcagcagtacgagactttcggtcaagggaccaaggtagatattaaa

SEQ ID NO: 24185 - RNA, 393 nt, synthetic construct
  misc_feature 1..393: note = derived and/or modified sequence opt3 from anti-HIV_VRC-CH31_HeavyChain
  source 1..393: mol_type = other RNA
caggtgcaactggtccagagcggcgccgctgttagaaagcccggggcatccgtgaccgtatcttgcaaattcgccgaggacgatgactactcaccttattgggtgaacccagcgccggaacactttatccatttcctcaggcaggctcccggacagcaacttgagtggctggcctggatgaatcctacaaacggtgcagtcaattacgcctggtatttgaacggccgggtgactgctacgcgcgatcgaagtatgaccacagcatttttagaagttaagagcctgcgttccgacgatactgccgtgtactattgtgctagagcccagaaaagggggcggtctgagtgggcgtacgcacactggggacagggcaccccagtcgtggtatcgtca

SEQ ID NO: 24186 - RNA, 309 nt, synthetic construct
  misc_feature 1..309: note = derived and/or modified sequence opt3 from anti-HIV_VRC-CH32_LightChain
  source 1..309: mol_type = other RNA
gacatccagatgacccaaagcccctcctctctgtcagccagtctcggcgatagagtgacaattacttgccaggctagcagggggataggaaaggaccttaactggtaccagcagaaacctggtcgggcaccaaagctgttggtctccgatgcctctatcttagagggcggggttccgacgcgcttctcgggatcaggctttcaccaaaatttcagcctgaccattagttccctacaggcggaagacgtggctacatatttttgtcagcagtacgagactttcggtcaagggaccaaagtagatatcaag

SEQ ID NO: 24187 - RNA, 393 nt, synthetic construct
  misc_feature 1..393: note = derived and/or modified sequence opt3 from anti-HIV_VRC-CH32_HeavyChain
  source 1..393: mol_type = other RNA
caggtgcaactggtccagagcggcgccgctgttagaaagcccggggcatccgtgaccgtatcttgcaaattcgccgaggacgatgacttttcacctcactgggtgaacccagcgccggaacattacatccacttcctcaggcaggctcccggacagcaacttgagtggctggcctggatgaagcctacaaatggtgcagtcaactatgcctggcagttgcagggccgggtgactgttacgcgcgatcgaagtcagaccacagcatttttagaagtgaaaaatctgcgtagcgacgatactgctgtctactattgtgccagagctcaaaagagggggcggtccgagtgggcctacgcgcattggggacagggcaccccagtggtaatttctgca

SEQ ID NO: 24188 - RNA, 309 nt, synthetic construct
  misc_feature 1..309: note = derived and/or modified sequence opt3 from anti-HIV_VRC-CH33_LightChain
  source 1..309: mol_type = other RNA
gacatccagatgacccaaagcccctcctctctgtcagccagtctcggcgatagagtgacaattacttgccaggctagcagggggataggaaaggaccttaactggtaccagcagaaacggggtcgcgcacctcgactgttggtctccgatgcctctgttttagagggcggggtgccatcgcgtttctcaggaagcggctttcaccaaaatttcagtctgacgatctccaccctacagccggaagacgtagcgacatatttttgtcagcagtacgagactttcggtcaagggaccaaggtggatattaaa

SEQ ID NO: 24189 - RNA, 393 nt, synthetic construct
  misc_feature 1..393: note = derived and/or modified sequence opt3 from anti-HIV_VRC-CH33_HeavyChain
  source 1..393: mol_type = other RNA
caggtgcaactggtccagagcggcgccgctgttagaaagcccggggcatccatctctgtgtcatgcaaattcgccgacgcggatgactacagtcctcactggatgaacccagctccggagcattatattcactttctcaggcaggcccccggacagcaacttgaatggctggcatggatgaatcctaccaacggtgccgtaaattacgcttggtatttgaacggccgggtgacagcaactcgcgatcgaagcatgacgaccgccttcttagaggtccgttccctgagatctgacgatacagctgtgtactattgtgccagggcgcagaagcgggcacgctcggaatgggcctacgctcattgggggcagggaactccagttgtggtctcaagc

SEQ ID NO: 24190 - RNA, 309 nt, synthetic construct
  misc_feature 1..309: note = derived and/or modified sequence opt3 from anti-HIV_VRC-CH34_LightChain
  source 1..309: mol_type = other RNA
gacatccagatgacccaaagcccctcctctctgtcagccagtctcggcgatagagtgacaattacttgccaggctagcagggggataggaaaggaccttaactggtaccagcagaaagcaggtaaggcccctaaactgttggtctccgatgcgtctatcttagagggcggggttccatcgcggttctcaggaagcggctttcaccaaaatttcagtctgacgatttcctctctacagccggaagacgtggctacctatttttgtcagcagtacgagacattcggtcaagggactaaggtagatatcaaa

SEQ ID NO: 24191 - RNA, 393 nt, synthetic construct
  misc_feature 1..393: note = derived and/or modified sequence opt3 from anti-HIV_VRC-CH34_HeavyChain
  source 1..393: mol_type = other RNA
caggtgcaactggtccagagcggcgccgctgttagaaagcccggggcatccgtgaccgtatcttgcaaattcgccgaggacgatgactggtcacctcactgggtgaacccagcgccggaacattacatccactttctcaggcaggctcccggacagcaacttgagtggctggcctggatgaatcctacaaacggtgcagtcaattatgcctggcagttgaacggccggttaactgctacgcgcgataccagtatgacaactgcattcctggaagttaagagcctacgatccgacgataccgccgtgtactattgtgctcgtgcccagaaaagagggaggtctgagtgggcgtacgcacattggggacagggcacaccagtggtcgtgtcgtca

SEQ ID NO: 24192 - RNA, 306 nt, synthetic construct
  misc_feature 1..306: note = derived and/or modified sequence opt3 from anti-HIV_VRC-PG04_LightChain
  source 1..306: mol_type = other RNA
gagatcgtgctgacccagagccccggcacactctccctttctcctggggaaactgcctcactgagttgcacggctgcaagctacggacacatgacctggtatcaaaagaaaccaggtcagccgcccaagttgttaattttcgccacatccaaaagagcgtctggcatacctgacaggttttcggggtcacagttcggaaagcagtacactctgaccatcacacggatggagccagaagattttgctcgctattactgtcaacagctagagttctttggccagggtacccgactcgaaattcgtaga

SEQ ID NO: 24193 - RNA, 375 nt, synthetic construct
  misc_feature 1..375: note = derived and/or modified sequence opt3 from anti-HIV_VRC-PG04_HeavyChain
  source 1..375: mol_type = other RNA
caggtgcaactggtccagagcggctccggggttaagaaacccggagcctctgtgagagtatcatgctggaccagtgaggacatcttcgaaaggacagagctcattcactgggtgcggcaggctcctggtcagggccttgaatggatagggtgggtcaagactgtgacgggagcagttaactttggcagcccagatttccgccaacgagtgtccctgacccgtgacagagatttgtttacagcccatatggacatcaggggtttaactcagggggataccgcgacatacttctgtgctcggcagaaattttataccggaggccagggctggtacttcgacctgtgggggcgcggaactctaattgtcgtgtcttcg

SEQ ID NO: 24194 - RNA, 303 nt, synthetic construct
  misc_feature 1..303: note = derived and/or modified sequence opt3 from anti-HIV_VRC-PG04b_LightChain
  source 1..303: mol_type = other RNA
gagatcgtgctgacccagagccccggcacactctccctttctcctggggaaactgcctcactgagttgcacggctgcaagctacggacacatgacctggtatcaaaagaaaccaggtcagccgcccaagttgttaattttcgccacatccaaaagagcgtctggcatacctgacaggttttcggggtcacagttcggaaagcagtacactctgaccatcacacggatggagccagaagattttgctggctattactgtcaacaggtcgagttctttggtcaggggacccgcctagaaattcga

SEQ ID NO: 24195 - RNA, 375 nt, synthetic construct
  misc_feature 1..375: note = derived and/or modified sequence opt3 from anti-HIV_VRC-PG04b_HeavyChain
  source 1..375: mol_type = other RNA
caggtgcaactggtccagagcggctccggggttaagaaacccggagcctctgtgagagtatcatgctggaccagtgaggacatcttcgaaaggacagagctcattcactgggtgcggcaggctcctggtcagggccttgaatggatagggtgggtcaagactgtgacgggagcagttaactttggcagcccaaatttccgccatcgagtgtccctgacccgtgatagagacttgtttacagcccacatggatatcaggggtttaactcaaggggacaccgcgacatacttctgtgctcggcagaaatttgagcgcggaggccagggctggtatttcgatctgtgggggagaggaaccctaattgtcgtgtcttcg

SEQ ID NO: 24196 - RNA, 612 nt, synthetic construct
  misc_feature 1..612: note = derived and/or modified sequence opt3 from anti-HIV_VRC-PG20_LightChain
  source 1..612: mol_type = other RNA
cagagcgccctgacccaacccccttccgtgtctggctcaccagggcagagtatcacactcagctgcactggagcttccacgtctgtcgcatggtaccagcagtatgccgacaaggcgccgagacttattgttttcgatggtaacaaaaggccctcggacatatcaagccggtttagtggctcccaatctgggggaaccgctagcctgacaatctccggcttgcagtcagaggatgaagcctactatcactgtaatgcattcgagtttttcggtgggggaactaagttaaccgtgctgagtcagcctaaagccgctccaagcgtaacactatttcccccttcttccgaggaactccaggcaaacaaggccaccctggtgtgccttatttcagacttctacccaggcgctgtcactgtggcctggaaagcggatagcagtcccgttaaggcaggcgtggaaacaaccacgccttctaagcaatccaataacaaatatgccgctagctcgtacctgtctttgactccagagcagtggaagtcccataaatcatatagttgtcaggtcacccacgaggggagcacagtggaaaagactgtagccccgaccgagtgc

SEQ ID NO: 24197 - RNA, 681 nt, synthetic construct
  misc_feature 1..681: note = derived and/or modified sequence opt3 from anti-HIV_VRC-PG20_HeavyChain
  source 1..681: mol_type = other RNA
gaggtgcacctgatgcagagcggcaccgaaatgaagaaacccggggcctccgtcagagttacatgccaaacttctggatacacgttctcagactattttatccattggctcaggcaagtgcctggtcggggcttcgagtggatggggtggatgaacccacagtggggacaggtaaattacgctcgcacctttcagggccgagtgacaatgactcgtgatgtctatagagaagtggcataccttgacctgaggagtttgaccttcgccgatacagcggtttatttttgtgctcggcgcatgagaagccaggacagggagtgggatttccagcactggggtcaggggacccggattatagtgtcctctgcctcgactaagggaccgtcagtctttcccttagcacctagcagtaaatccacatctggcggcaccgccgctctggggtgcctagtgaaggactacttcccagaacccgtaacggttagctggaactccggagcactcacttcaggtgtgcatacctttcctgccgtcctgcaaagtagcggcctttattctctgtcctcagtggtgacagtcccaagcagttctttggggactcagacctacatctgtaatgttaaccacaaaccctccaatacaaaggtggataagaaagtagagcctaagagctgcgacaaa

SEQ ID NO: 24198 - RNA, 1059 nt, synthetic construct
  misc_feature 1..1059: note = derived and/or modified sequence opt3 from anti-HIV_VRC-PG20_G-Chain
  source 1..1059: mol_type = other RNA
gtgtggaaggacgccgataccacactgttctgcgctagcgacgcaaaagcccacgagactgaagtccataacgtttgggcgacgcacgcttgtgtgcccaccgatcctaatccacaggagatccatctcgaaaacgtaacagagaattttaacatgtggaagaataacatggtggaacaaatgcaggaggacgtcatttccctttgggatcagtctctgcagccgtgcgtgaaattgactggcgggtcagttataaagcaagcctgtcccaaaatcagtttcgaccctattccaatccactactgcacccccgcaggatatgtgattttaaagtgtaatgataagaactttaatggtacaggcccttgcaaaaacgtcagctccgtgcagtgtacccatgggatcaagccagtagtttctactcagctgctactcaatggatcgctggccgaggaagagataatcattagatcagaaaaccttacaaataacgctaaaaccatcattgtgcacctgaataagagcgtcgagatcaactgcacgaggcccagtaacggcggttccgggtctggaggcgacatacggaaagcatactgtgagattaatggcactaagtggaacaaggtgttgaaacaggtgaccgaaaagctcaaagagcacttcaataacaagacaatcatttttcaacctccaagcgggggagatctggaaatcactatgcatcacttcaattgccgcggtgagtttttctattgtaacaccacacagctgtttaataatacctgcatcggcaacgaaacgatgaaagggtgcaacggaactattacactcccgtgtaagataaaacagatcattaatatgtggcagggcaccggtcaagccatgtacgctccccctatcgacgggaagataaactgcgtctccaatattactggaatcttactgacacgagatggcggcgccaacaatacctcaaacgagacgttccgtccagggggaggtaacatcaaggacaattggagaagtgagctttataaatacaaggttgtgcagattgaa

SEQ ID NO: 24199 - RNA, 312 nt, synthetic construct
  misc_feature 1..312: note = derived and/or modified sequence opt3 from anti-HIV_VRC02_LightChain
  source 1..312: mol_type = other RNA
gaaatcgtgctgacccagagccccggcacactctccctttctcctggggaaactgccattatatcatgcagaacgagtcaatacggaagcctggcttggtatcagcagaggccaggtcaggcaccgcggttggtcatctactccggctctacccgcgccgcggggattcccgaccgattctcgggatcacgttggggccctgattataacttaacaatcagaaatctggagagcggtgactttgggctatactattgtcaacagtacgagttctttggacagggcactaaggttcaggtggatattaaaagg

SEQ ID NO: 24200 - RNA, 363 nt, synthetic construct
  misc_feature 1..363: note = derived and/or modified sequence opt3 from anti-HIV_VRC02_HeavyChain
  source 1..363: mol_type = other RNA
caggtgcaactggtccagagcggcgggcagatgaagaaacccggagagtccatgagaatctcttgccaggcctcaggttacgagttcattgactgtaccctcaactgggttaggcttgctcctggccggcgcccagaatggatggggtggctgaagccgcgaggaggcgcagtgaattatgcccgtcccttgcaaggtagagtaacaatgactagggatgtgtacagtgacacggcgtttttagaactgcggagcctaaccgctgatgacacagccgtctattactgcactcgcgggaaaaactgtgattataattgggacttcgagcactggggaagaggcacccctgtgacagtttcctct

SEQ ID NO: 24201 - RNA, 309 nt, synthetic construct
  misc_feature 1..309: note = derived and/or modified sequence opt3 from anti-HIV_VRC03_LightChain
  source 1..309: mol_type = other RNA
gagatcgtgctgacccagagccccggcattctctccctttctcctggggaaacagccactctgttctgcaaggcttcacaaggaggtaacgcaatgacgtggtaccagaaaagaaggggccaggtcccacggttgttaatatatgacaccagtcgccgagccagcggggttccggatcgttttgtgggatccggctctggtacagacttctttctgactatcaataagctagatagagaggacttcgcggtatactattgtcagcaatttgagttctttgggctcggatcggaactggaagtgcacagg

SEQ ID NO: 24202 - RNA, 390 nt, synthetic construct
  misc_feature 1..390: note = derived and/or modified sequence opt3 from anti-HIV_VRC03_HeavyChain
  source 1..390: mol_type = other RNA
caggtgcaactggtccagagcggcgccgttatcaagacccccgggtcctctgtgaaaatttcatgcagagctagtggatacaacttcagggactatagcatacactgggtacggctcatccctgataagggttttgagtggattggctggatcaaaccactttggggagcagtgtcctacgcccgccagctgcaggggcgagtctctatgacacgtcaattgtcgcaggacccggatgaccccgattggggcgtggcgtatatggagttctcaggtttaactcctgctgacacggccgaatacttttgtgttagaagggggagctgcgattattgtggagacttcccatggcagtactggggccagggcaccgtggtcgtggtaagttcc

SEQ ID NO: 24203 - RNA, 630 nt, synthetic construct
  misc_feature 1..630: note = derived and/or modified sequence opt3 from anti-HIV_VRC23_LightChain
  source 1..630: mol_type = other RNA
gagatcgtgatgacccagagccccgtcacagtttccgtgtctagaggcgggactgccacgctgtcatgcagggctagtcaaggagtaggtagcgacgtggcatggtaccagcacaagcctggccagaccccacggctccttatttatggggcctccacacgcgcgtctggagtcccggaacgattctcgggctcaggttttcatgtggatttcactctgagcataagtgggttgcagcccgaggacgttgctatctactattgtcaacagtacgaaacctttggacagggcacaaaagtggagattaagcgtaccgtcgccgcaccttccgtgttcatctttccaccctctgatgaacagttaaaaagcggcactgcctccgtagtttgcctgctaaacaatttctatcctagagaggctaaggtgcaatggaaagtcgacaacgcactccagtcagggaatagtcaggagagcgtgacagaacaggattctaaggactccacctactcactgagcagtacgcttactctgtctaaggccgattatgagaaacacaaggtgtacgcttgtgaagtcacccatcaaggattgtccagcccagttacaaaatcgtttaacaggggtgagtgc

SEQ ID NO: 24204 - RNA, 672 nt, synthetic construct
  misc_feature 1..672: note = derived and/or modified sequence opt3 from anti-HIV_VRC23_HeavyChain
  source 1..672: mol_type = other RNA
gaggtgcagttcgtccaaagcggcgccgaagttaagaaacccggggcttccgtgagagtatcttgcgaggcatcaggatacagttttaccgactatgtgctgcagtggatcaggcaggcccctggtcagcggccagaatggatgggctggattaagccggagcgcggggcggtcagctacgctccccaattccagggacgactcacacttactcgtgatctgtatacggaaaccgcctacatgcactttaaaaacttgagatccgacgatacagcaatatattactgtgccaggggcgtgcggcgcgacgcttcttggtggttacagttctggggtcaggggactctggttaccgtgtcgtcagcaagcacaaagggacctagtgtctttccactagccccctcctctaaaagcacctccggcggcactgctgccctcgggtgcctggtgaaggattatttccctgagccagtaacagtttcatggaatagtggagcgcttaccagcggtgtgcatacgtttcccgcagtcctgcaatcttccggcttgtactcactcagcagtgtggtgactgtcccttcttccagcctggggacccagacatacatctgtaacgttaatcacaagccatcgaacactaaagtggacaagaaagtagagccgaagtcttgc

SEQ ID NO: 24205 - RNA, 1077 nt, synthetic construct
  misc_feature 1..1077: note = derived and/or modified sequence opt3 from anti-HIV_VRC23_G-Chain
  source 1..1077: mol_type = other RNA
gtgtggagagacgccgataccacactgttctgcgctagcgacgcaaaggcctacgagactgaaaaacacaacgtctgggcgacgcatgcttgtgttcccaccgatcctaatccacaggagatccacctcgacaacgtgacagaaaagtttaatatgtggaaaaacaatatggtagagcaaatgcatactgatattatatccctttgggaccagtctctgaagccgtgcgtgaaattgaccggcgggtcagccatcacacaggcatgtcccaaggtcagtttcgaacctattccaatccactattgcacccccgccggatttgctattttaaagtgtaaagatgagggtttcaacggcactgggctgtgcaagaatgtgagcacagttcagtgtacccatggaatcaaacctgtggtctccacgcaactactcctgaacggctctcttgcagagaagaatataactatcaggtcggaaaacattaccaataacgccaaaatcattatcgtgcagctggtacagccagttacaataaagtgcattcggcccaataacggtgggtcaggaagcggcggcgacatccgccaggctcactgtaatgtgactcgaagtcgttggaacaagaccttgcaagaggtcgccgaaaaactcagaacatactttgggaacaagaccattatcttcgcaaattcctctggaggtgatctggagatcacgactcacagctttaactgcggcggggagttcttttattgtaatacatccggactgttcaactcaacctggtacgtgaatagtacttggaacgacacagatagcacccaggaatctaatgacacgattaccctcccttgcaggataaaacagatcattaacatgtggcagcgggcgggccaagccatgtatgctccaccgatccccggtgtgataaagtgcgagtccaatattacagggttactgcttactcgcgatggaggcaaagacaacaatgtcaacgaaacctttagacctggcgggggagacatgagggataattggcggtcagagttgtacaagtataaagttgtggaaatcgag

SEQ ID NO: 24206 - RNA, 648 nt, synthetic construct
  misc_feature 1..648: note = derived and/or modified sequence opt3 from anti-HIV_5CCK_LightChain
  source 1..648: mol_type = other RNA
cagagcgccctgacccaacccgcttccgtgtctgcatcacctggccagagtatcacaattagctgctccgggactagatctgacgtcggaggttacgatttcgtttcgtggtatcagcagcacccaggcaaggtgccgaaactcataatctacgaggtaacgaagaggccctcagggattcctcaacggtttagcggaagtaaatccggcaacaccgcctctcttacaatcagcggtctgcaggcggacgatgaagctgactattactgttgctcctatgccaattacgataagttgattttagggggaggcactaaactgaccgtgctaggccagccaaaggcaaaccccacagtcaccctcttccctccatcaagtgaggaactgcaggccaataaggctactcttgtgtgtctgatcagcgacttttatcccggggcagttacagtggcctggaaagctgatggatctcctgtcaaggccggtgtggagaccacgaaaccatccaagcaatcaaacaataaatacgcggcaagcagttacttgtctctcactccggaacagtggaagtcccatcgcagctattcgtgccaggtaacccacgagggctctacagttgagaagactgtggcccccaccgaatgttcc

SEQ ID NO: 24207 - RNA, 696 nt, synthetic construct
  misc_feature 1..696: note = derived and/or modified sequence opt3 from anti-HIV_5CCK_HeavyChain
  source 1..696: mol_type = other RNA
caggtgcaactggtccagagcggcgccgagatgaaggaccccggggcttccgttaaagtgtcttgcagagcatcaggatacaagttcaccgattattacatgcactgggtaaggcaggcccctggtcagggcctcgaatgggtggggtgggtcaacacaaatggaggctttactaaatatggtgcgaagttccaagggcgggtgacggttacccgcgacacaagtactaacaccgtgtttcttgagctgagccgattgacattcggagataccgctatgtacttttgtgcccgtccaatgagaccggtctcccatggcatcgactattctggcttattcgtgtttcagttctgggggaggggaactatggtaacagtttcgtcagcaagcaccaaaggtcccagtgtgtttcctctggccccatcctctaagagcacgtccggcgggactgctgcactaggatgcctcgtcaaggattacttccccgaacctgtgaccgtgtcatggaatagtggcgccctgacaagcggtgtccacacttttccagctgttcttcagtcttccgggctgtattcattgagcagtgtggtaaccgtgccctcttccagcctcggaacacagacctacatttgtaacgtcaatcataaaccttcgaacacgaaggtggacaaaaaggttgagccaaaatcttgcgat

SEQ ID NO: 24208 - RNA, 648 nt, synthetic construct; identical to SEQ ID NO: 24084
  misc_feature 1..648: note = derived and/or modified sequence opt3 from anti-HIV_5AWN_LightChain
  source 1..648: mol_type = other RNA

SEQ ID NO: 24209 - RNA, 696 nt, synthetic construct
  misc_feature 1..696: note = derived and/or modified sequence opt3 from anti-HIV_5AWN_HeavyChain
  source 1..696: mol_type = other RNA
caggtgcaactgatgcagagcggcgcccagctcagagaccccggggattcccttaagatctcttgcaaggcttcaggatacaacttcattgactatcacatacattgggtcaggctggcacctggtcggggcttggagtggatggggtggatcgatccagttggaggcattaccaaatacgccggtcagtttcaagggcgcttaagtctgacacgagacactagcacgaataccctattcctcgaactgtcccgtcttacagcgggagatactgctgtgtatttttgtgccagatctatgaggccggtagaccacggcatcgattactcgggcctgttcgtgtttcatttctgggggcggggatcagacgtcttggtgagcagtgcatccaccaaaggtccctctgtttttcctctcgccccaagctccaagtcaacaagtggcgggaccgctgcactgggatgcctggtgaaagattatttccccgagcctgtcactgtgagctggaactctggcgccctcacatccggtgtacacacctttccagctgttttacagtcaagcgggctgtacagtctttcttccgtggtcacggtgcccagctcgtctttgggaactcagacctatatttgtaatgtgaaccataagccttccaatacaaaggtcgacaaaaaggttgaaccaaaatcatgcgat

SEQ ID NO: 24210 - RNA, 645 nt, synthetic construct
  misc_feature 1..645: note = derived and/or modified sequence opt3 from anti-HIV_3QEG_LightChain
  source 1..645: mol_type = other RNA
gagatcgtgatgatgcagagccccggcaccctgtccctctctcctggggaaagagccacactttcatgcagggctagtcaaagcgtctcctcttcgtacctggcatggtatcagcagaaaccaggacaggccccgcggttgttaatttacggtgcgtcaagccgcgctactggcatacccgaccgattcagtgggtccggatctggcacggattttaccctgacaatcagccgtctagagcctgaagacttcgccgtttattactgtcaacagtatggttcctcaccagagacttttgggcagggaaccaaagtggaaattaagagaacagtagcagcccccagtgtgttcatctttcctccaagcgatgagcagctcaaatctggcaccgcttccgtcgtgtgcctgcttaacaatttctaccccagggaggcaaaggttcaatggaaagtggacaacgccctgcagtcaggcaatagccaggaaagtgtcactgagcaggattctaaggactccacatatagcttgtcgtctaccctcacgctgtccaaggctgattacgaaaaacacaaggtgtacgcctgtgaggtaactcatcaagggctgtcaagtcctgttaccaagagctttaaccggggagagtgc

SEQ ID NO: 24211 - RNA, 717 nt, synthetic construct
  misc_feature 1..717: note = derived and/or modified sequence opt3 from anti-HIV_3QEG_HeavyChain
  source 1..717: mol_type = other RNA
caggtgcaactggtccagagcggcgccgaggttaagaaacccgggtcctctgtgaaggtatcatgcagagctagtaggggaaccttcagctcctacggtatcacatgggtgcggcaggcacctggccaggggctcgaatggatgggaggcattataccaatctttgacgtcactaactatgcccaaaatttccagggtcgcgtggcgattacgaccgatgctgagatgtctacagcctacatggaacttcgatcgctgaaatcagaggacagcgcagtttattactgtgccagtgattcccgtgacttttcttattacgaaccggggactagctattcccactactacaacatcatggatgtgtggggacagggcaccacagtcaccgtgtcaagtgctagcactaagggcccctctgtattccctttggcaccatcctcaaaaagcacaagtgggggaaccgccgctttaggttgcctggttaaggactattttcccgagcctgtgacggtctcttggaactccggcgccctaactagcggggtgcataccttcccagcggtgctccagtcgtctggactgtactccctttcaagtgtcgttacagtgcccagctcctctctgggcactcaaacctatatttgtaatgtaaatcacaagcctagcaacacaaaagtggataagagagtcgagccaaaatcatgcgacaagacccat

SEQ ID NO: 24212 - RNA, 690 nt, synthetic construct
  misc_feature 1..690: note = derived and/or modified sequence opt3 from anti-HIV_1N0X_K-Chain
  source 1..690: mol_type = other RNA
caggtgcaactggtccagagcggcgccgaggttaagaaacccggggcttccgtgaaggtatcttgccaggcatcaggatacagattcagtaactttgtgatccactgggtcaggcaggcccctggtcaacggttcgaatggatgggctggattaatccatataacgggaataaagagtttagcgcgaagttccaggaccgcgtgacctttacagctgatacttccgccaacacggcatacatggaactccgatctcttcgttcggccgacaccgctgtttattactgtgcaagagtgggaccgtattcatgggatgacagcccccaggataattactatatggacgtctggggcaaaggtacaactgtgatagtaagttccgcctctaccaaggggcctagcgttttcccactggctccctcctcaaagagtacaagcggaggcaccgccgcgttgggctgcttagtgaaagattactttcctgagccagtcactgtgtcttggaactccggggcactgacatcaggagtgcataccttccccgccgtcctacagagcagtggtctctactctctgtccagcgttgtgacggtaccttcgtcttcccttggcactcaaacctatatctgtaatgtgaaccacaagccatcaaatacaaaagtcgacaagaaagtggaaccgaagagttgc

SEQ ID NO: 24213 - RNA, 645 nt, synthetic construct
  misc_feature 1..645: note = derived and/or modified sequence opt3 from anti-HIV_1N0X_M-Chain
  source 1..645: mol_type = other RNA
gagatcgtgctgacccagagccccggcacactctccctttctcctggggaaagagccactttctcatgcaggagtagccactccattcggtctcgccgagtcgcttggtaccaacataagccaggacaggcaccgcgtctggttatacacggtgtgtcgaacagagcctcaggcatcagcgacaggtttagtgggtccggatctggcacggatttcaccttgacaattactcgggtagagcccgaagactttgcgttatattactgtcaggtgtatggtgctagctcctacaccttcgggcagggaacaaaactggagcgcaagagaaccgtcgccgcaccttcagtgtttatcttcccacccagtgatgaacaactaaaaagcggcactgcctctgttgtgtgcctcctgaataacttttatcctagggaggctaaggtccagtggaaagtggacaatgcacttcagtccggcaactcacaggagagcgtaacagaacaagatagtaaggactctacctactccctgagctcgacgttgactctctctaaggccgattatgagaaacataaggtttacgcttgtgaagtgacccaccaggggctgcggtccccagtcacaaaatcattcaatcgcggagagtgc

SEQ ID NO: 24214 - RNA, 654 nt, synthetic construct
  misc_feature 1..654: note = derived and/or modified sequence opt3 from anti-HIV_3QEH_HeavyChain
  source 1..654: mol_type = other RNA
gacatcgtgatgacccagagccccctgtccctccctgtcacaccaggcgaggccgcttctatttcatgcagaagtagccaatcccttctgcacactaacgggttccagtacttggattggtatttacagaagccgggacagtctccccaactgctaatatacctcggttcgaatagggcaacgggcgttcctcatcggttttcagggagcggaagtggcaccgagttcacactgaaaatctcccgcgtggaagccgaagacgtaggtgtgtattactgtatgcaggcgaaggagtctccaacttttgggcagggaaccaaagtcgaaattaagcgaacagtggctgcccccagcgttttcatctttcctccatccgatgagcagcttaaatcaggcaccgcaagtgtggtctgcctgttgaacaatttctatccccgtgaggccaaggtgcaatggaaggtagacaacgctctccagagcggcaattctcaggaatccgttactgagcaggattcaaaagacagcacatacagtctgtcttccaccctgacgctcagcaaggcagattatgaaaaacacaaggtgtacgcctgtgaggtcactcatcaagggttatcgtctcctgtgaccaaatcctttaacagaggagagtgc

SEQ ID NO: 24215 - RNA, 696 nt, synthetic construct
  misc_feature 1..696: note = derived and/or modified sequence opt3 from anti-HIV_3QEH_G-Chain
  source 1..696: mol_type = other RNA
caggtgcaactggtccagagcggcgccgaggttagaaagcccggggcttccgtgaccgtatcttgcaaaacatcaggatacactttcgtgaacttttatatcgtctgggtgaggcaggcacctggtcagggcctcgaatggatgggggttattaatccattccggggagacacgtactttgcccaaaagttcaaaggccgcgtgacccttacacgagataccagtactagcacagtctttatggagctgtcctctttgcgttcggacgataccgcgatatattactgtgctagagacttagaaatgagggatggtaacaatcacgggtcacatctggagttctggggacagggcactctagtgacagtaagcagtgcctccaccaagggcccgtctgtttttcccctcgcacctagctccaaatcaacgagtgggggaactgccgctctgggttgccttgtgaaggactatttcccagaacccgtcaccgtgagctggaactctggcgcactgacatccggggtgcacacttttcctgccgtcttgcagtcaagcggactctacagtctgtcttccgttgtgaccgtaccaagctcgtctctgggcacacagacctatatctgtaatgtgaaccataagccctccaatacgaaagtcgataagcgggtggagcctaaatcatgcgacaagactcac

SEQ ID NO: 24216 - RNA, 678 nt, synthetic construct
  misc_feature 1..678: note = derived and/or modified sequence opt3 from anti-HIV_2B1H_HeavyChain
  source 1..678: mol_type = other RNA
gagatccagctggaacaaagcggcgccgaggtgaagaaatccggggaatctctcaagatttcatgccagaccagtggatacagcttctccgactattggataggttgggtcagacagatgcccggcaaagggcttgagtggatgggaatcttttaccctggcgattctgactcgaggtattcaccgagcttcgaaggtcaggttacaatgagtgctgatcggtccactaacacggcacatctgcaatggtctagcttgaagccatccgacaccgccttatactattgtgcgcgcctagggggagattacgaggactcaggcgctgatgcctttgacttctggggccaggggacactggtgactgtaagtagcgcatctaccaaaggaccctccgtgtttcctctcgccccatcaagcaagagtacatctggtggcaccgctgcactggggtgccttgtcaaggattatttccccgagcctgtgactgtttcctggaatagcggagccctgacatcgggcgtgcacacctttccagctgtcttgcagtcttccggtctctactcactgagtagcgtggtaacggttccctcctctagcctggggactcagacctacatttgtaacgtgaatcacaaaccttcaaacacaaaggtcgacaaaaaggtggaaccaaaaagt

SEQ ID NO: 24217 - RNA, 645 nt, synthetic construct
  misc_feature 1..645: note = derived and/or modified sequence opt3 from anti-HIV_2B1H_LightChain
  source 1..645: mol_type = other RNA
cagagcgtgctgacccaacccccttccgcctctggcacaccagggcagagaatctcaattagttgcagcggaacttcctctaacgtcgagaataactacgtttattggtaccagcacctcccgggtacggctcccaaacttctgatatataggaatgaccatcggtcgtcaggcatccctgatcgcttcagcgcaagtaagtccgggacctctgccagcttggcgatttccggattacgaccagaagacgagggcgattactattgtgctgcctgggacgattcacgtggtgggcccgactgggtgtttggaggcggcacaaagctgactgtactagcacagcctaaagccgctccaagtgtgaccctctttccccctagctctgaggaactgcaagcaaacaaggccacacttgtctgcctgatctccgatttctacccaggggctgtgaccgttgcctggaaagcggactcaagcccggtgaaggcaggagtcgaaactacaacccccagtaagcagtctaataacaaatatgccgcttccagctacttgtcgctcacgcctgagcagtggaagtctcacaaatcctactcatgtcaggtgactcatgagggtagtaccgtagaaaagacagttgccccaact

SEQ ID NO: 24218 - RNA, 648 nt, synthetic construct
  misc_feature 1..648: note = derived and/or modified sequence opt3 from anti-HIV_3TNM_B-Chain
  source 1..648: mol_type = other RNA
cagagcgtgctgacccaacccccttccgcctctggctcaccagggcagagtgtcacaatcagctgcactggaacgtcctctgacgttggtggctacaactatgtgtcgtggtaccagcaccatccggggaaggctcccaaactcattatatcagaggtaaataacagacctagcggagtgccagataggttcagtggctccaagtctggtaataccgcaagccttacagtctccgggctgcaggccgaagacgaggcggaatattactgttcaagttatactgatatccacaactttgtgttcggaggcggcaccaaattgacagttttagggcaacccaaggctgcccctagcgtgaccctgtttccaccctcttccgaggaactacaggcaaataaagccactctcgtctgcctgatttcagacttctaccctggagctgtgacagtagcatggaaggccgatagcagtccagttaaggctggtgtggagaccacgactccgtctaaacagtccaacaataagtatgccgcgagctcgtacctttctctgacccccgagcagtggaaatcccatcggtcatacagttgtcaagtcacacacgaaggcagcactgtggagaagaccgtggcacctacagaatgctcc

SEQ ID NO: 24219 - RNA, 693 nt, synthetic construct
  misc_feature 1..693: note = derived and/or modified sequence opt3 from anti-HIV_3TNM_A-Chain
  source 1..693: mol_type = other RNA
caggtgcaactgcaggagagcggccccgggctcgtcaagccttcccagaccctttctctgtcatgcacagttagtggaggtagctcctcttcgggcgcccactactggtcatggatcagacagtatccagggaaaggattggaatggattggctacatacattatagcggtaacacttactataatccgagtttaaagtccaggatcacgatttctcaacacaccagcgagaaccagttctccctgaaactaaattcagtgacagtagctgacactgcagtgtactattgtgcccgggggacccgcctccgaacactgcgtaacgcgtttgatatctggggacagggcaccatggtcactgtgagtagcgcttctacaaagggcccctccgttttccctcttgccccatcaagcaaaagtacctctgggggaacggcagccctgggttgcttggtgaaggactactttcccgaacctgtcactgtgtcctggaatagcggcgctctcacctcgggggtacatacattcccagcagttctgcagtcttccggactgtactcactcagtagcgtggtcactgtgccctcctctagcttaggcacccaaacatatatttgtaacgtgaatcacaagccttcaaacaccaaagtcgataagagagttgagccaaaaagttgcgacaagacgcatact

SEQ ID NO: 24220 - RNA, 690 nt, synthetic construct
  misc_feature 1..690: note = derived and/or modified sequence opt3 from anti-HIV_3UJJ_HeavyChain
  source 1..690: mol_type = other RNA
gaggtgcagctggtccaaagcggcgccgaagttaagaaacccggggagtccctcaagatctcttgcaaagcttcaggatacagtttcagctcctattggattgcatgggtgagacagatgcctggtaagggccttgaatggatggggtttatatacccagccgactctgataccaggtattcgccgtcattccagggacagggcacaatcagcgcggacaaaagtatttccactgcttacctgcaatggtctagcttgaaggcctccgatacggcaatgtattactgtgccatcttaggtttttggggggctaaccggggaggcggcgggatggacgtatggggacagggtaccacagtgattgtctcaagtgcaagcactaagggcccctctgtgttccctctggccccatcctcaaaaagcaccagtgggggaacagctgccctaggctgcctcgttaaggattattttcccgagcctgtgaccgtctcttggaattccggtgcgctgactagcggggtgcacacattcccagcagtacttcagtcgtctggactgtactccttgtcaagtgttgtgaccgtccccagctcctctctcggcacgcagacttacatctgtaacgtgaatcataaacctagcaacaccaaggtggacaaaaaggtcgaaccaaagtcatgcgataaaaca

SEQ ID NO: 24221 - RNA, 639 nt, synthetic construct
  misc_feature 1..639: note = derived and/or modified sequence opt3 from anti-HIV_3UJJ_LightChain
  source 1..639: mol_type = other RNA
agctacgagctgacccagcccccttccgtgtctgtctcaccaggccaaacagccagaatcacttgcagtggggacgctctcccggaaaagtatgcatactggtatcagcagaaaagcggacaggcccccgttcttattatatacgaggattccaagaggccttctggtatcccagaacggttctcgggctcacgcagcgggacgatggcgaccctgacaattagtggagctcaagtggacgatgaggccgactattactgttattccactaactctggcggtacctttttcgtatttgggacaggaaccaaagtgactgtcttgggccagcccaaggcaaatcctacagtgaccttattcccacccagctccgaggaactgcaggccaacaaagctacgctagtttgcctcatctcagatttttaccctggcgcagtgactgtcgcctggaaggctgacagtagcccagtgaaggccggggtagagaccacaactccgtctaaacagtccaataacaagtacgcggcatcaagctatctgagtcttacccccgaacaatggaaatctcaccgatcctacagctgtcaggttacacatgagggatcgaccgtggaaaagacggtcgcccctactgagtgc

SEQ ID NO: 24222 - RNA, 669 nt, synthetic construct
  misc_feature 1..669: note = derived and/or modified sequence opt3 from anti-HIV_3UJI_HeavyChain
  source 1..669: mol_type = other RNA
caggtgcaactggtccagagcgccgctgaggttaagaaacccggcgaagcactcaagatctcctgcaaagggtctggatactcattcagtaactattggattgcctgggtgagacagatgcctggtaagggccttgagtggatggggatagtatacccagacgatagcgactcctcttataattcgtcatttcagggacaaatcaccttcagcgcggataaaagtatttccacagcttacctgcactggacttctttgcaggccagcgacacggcaatgtattactgtgccaggttaggctttgaaggtgattattccgggtcattctttgactactggggacagggcaccctgctaatcgtgagtagcgcttctacaaagggcccgtccgtcttccccctcgcaccttcaagcaagagtacttctgggggaaccgccgctctgggttgccttgtgaaagattactttccagagcccgttacagtgtcctggaacagcggcgccctgacctcgggggtccatactttccctgcggtgttgcagtcttccggactctattcactgagtagcgtagttacagtgccatcctctagcctgggcacccaaacgtacatttgtaatgtcaaccacaagccctcaaatactaaagtggacaagaaagtggaacct

SEQ ID NO: 24223 - RNA, 627 nt, synthetic construct
  misc_feature 1..627: note = derived and/or modified sequence opt3 from anti-HIV_3UJI_LightChain
  source 1..627: mol_type = other RNA
agctacgagctgacccagcccccttccgtgtctgtctcaccaggccaaacagccagtatcacttgcagcggggacattctcggagataagtatgtttcctggtaccagcagaaatctggtcagtcgccgcttctggtgatatatgaagacacgaagagaccctcaggcatccctgataggttcagcgggagtaaatccggaaacaccgctacattgactatttctggcacccaagcaatggacgaggccgattactattgtcaggcgtgggacagcacattaggtgtagtgtttgggggaggcaccaaggtcactgtgctgggccagccaaaagctgccccctccgttacactattccctccatcaagtgaggaactccaggcaaataaggccaccctggtgtgccttatcagcgatttttaccccggggctgtcacggtggcatggaaggccgactcttcccctgtaaaagctggagttgaaactaccacaccatcaaagcaaagcaacaataaatatgccgcgagttcttacctgtccttgactccggagcagtggaaaagccacaagtcgtactcttgtcaggtgacccatgagggttccacagtcgaaaagaccgtggcaccc

SEQ ID NO: 24224 - RNA, 666 nt, synthetic construct
  misc_feature 1..666: note = derived and/or modified sequence opt3 from anti-HIV_2QSC_HeavyChain
  source 1..666: mol_type = other RNA
caggtgcaactggtccagagcggcgggggactcgttcagcccggtggctcccttagactgtcttgcgccgctttcgggtttaacttctcaagttacgtgatgcactgggtaaggcaggcacctggacaaggcttggagtatttaagcgccatctcctctgacggtgaaaccacataccatgctaattcggtgaaggggcggtttacttcaagccgcgataacagtaaaaatacgctgttcctacagatgggatccctccgaaccgaggacgtcgcggtgtattactgtgcccgtgatagatattacgaaacatctggcagcaacgcatttgacgtttggggccaggggactatggtggtcgtgtcctcagccagtaccaagggaccaagcgtattcccgctggctccctgctctaggtccacatcagagagcaccgcagcccttggttgtctggttaaagattattttcctgaaccagtgactgtcagttggaactctggcgctttgacatccggggtgcacaccttccccgccgtgctccagagctcgggactgtactctctgtcctcagtcgttacggtgcctagtagcaattttggcactcaaacctacacatgcaatgtagaccataagccatccaacactaaagtggataagaccgtcgag

SEQ ID NO: 24225 - RNA, 645 nt, synthetic construct
  misc_feature 1..645: note = derived and/or modified sequence opt3 from anti-HIV_2QSC_LightChain
  source 1..645: mol_type = other RNA
aacagcgtgctgacccagtccccctcttcactcagtgccagcgtcggcgacagagttacaatcacttgccaggcttcccaagatatttctaattaccttaactggtatcagcacaagcctgggaaagcaccaaagctgttgatatacacggcctcgaatttagagaccggagtgccgtcaaggttcagcggtggcgggagtggaacacatttttccttcactatcacctctctgcagcccgaagacgcggctacatatttttgtcaacagtacgataacctaggcgacctcagcttcggtgggggaaccaaagtagagattaagcggactgtggccgcaccttccgtctttatcttcccaccctcagatgaacagctgaaaagtggcacagccagcgtggtttgccttctgaataacttttatcctcgcgaggctaaggtgcagtggaaggtcgacaatgcattgcaatctggcaactcccaggaatcagtgaccgagcaggatagcaaagacagtacgtactctctctccagcactctgaccctgtcgaaggccgattatgagaaacacaaggtatacgcttgtgaagttacacatcaggggctctcttccccagtgactaaatcattcaatcgaggagagtgc

SEQ ID NO: 24226 - RNA, 690 nt, synthetic construct
  misc_feature 1..690: note = derived and/or modified sequence opt3 from anti-HIV_3MLZ_HeavyChain
  source 1..690: mol_type = other RNA
caggtgcaactgcaggagagcggccccgggctcgtcaagccttccgaaaccctttctctgacatgcactgtttcaggaggtagtatcagcggcttccactggtcctggattagacagccaccggggaaaggattggagtacataggctatatctactattctggttcgacgtcatacaaccccagcttaaagagtagggtgtccatgtctgtagacaccagccggaatcagttttccctggaactatcaagtgtgacagccgctgatactgcagtctattactgtgcccgcgacttcggggagtatcattacgatggacgaggctttcaatgcgaaggcttcgacctctgggggcagggaaccctggtgacagttagctctgcgtccaccaaaggtccttcagtgtttccacttgctcccagcagtaagtctacttccggcgggacagccgcactgggatgtttggtcaaagattacttccctgagccagtgaccgtaagctggaactcgggcgccctcacgtctggtgttcacacttttcccgctgtgctgcagtcctcagggctgtatagtctcagctccgtcgtgaccgtgccttctagctcattaggaacacagacttacatttgcaatgtcaaccataagccaagtaataccaaggttgacaaaaaggtggagccgaaatcctgt

SEQ ID NO: 24227 - RNA, 642 nt, synthetic construct
  misc_feature 1..642: note = derived and/or modified sequence opt3 from anti-HIV_3MLZ_LightChain
  source 1..642: mol_type = other RNA
cagagcgtgctgacccaacccccttccgtctctgccgctccaggccagaaggttacaatctcatgcagtgggagctcctctaacattggaaataacatggtgtcgtggtaccagcagcacccgggtactgcacccaaactccttatatatgaaaattcaaagagacctagcggcatcccagacaggttcagtgggtcccggtctggaacgagcgccaccctgggcattatcggtttgcaaacaggggatgaagcggagtactattgtgctacttgggacggatccttacgcaccgtatttggcggcgggacaaaactgaccgtgctatcacagcccaaggccgcacctagtgtcactctcttcccacccagctctgaggagctgcaggccaacaaagctacacttgtgtgcctgatttccgatttttaccctggagcagttaccgtggcctggaaggctgactcaagcccagtccgagccggtgtggaaacgactaccccgagtaagcagtctaataacaaatatgcggcatccagctacttgtcgctcacacccgagcaatggaagtctcatcgttcctattcatgtcaggtaactcacgagggcagtaccgttgagaaaacagtggcccctaccgaatgc

SEQ ID NO: 24228 - RNA, 684 nt, synthetic construct
  misc_feature 1..684: note = derived and/or modified sequence opt3 from anti-HIV_3MLX_I-Chain
  source 1..684: mol_type = other RNA
caggtgcaactgcaggagagcggccccgggctcgtcaagccttccgaaaccctttctctgacatgcactgtttcaggaggtagtatcagcggcttccactggtcctggattagacagccaccggggaaaggattggagtacataggctatatctactattctggttcgacgtcatacaaccccagcttaaagagtagggtgtccatgtctgtagacaccagccggaatcagttttccctggaactatcaagtgtgacagccgctgatactgcagtctattactgtgcccgcgacttcggggagtatcattacgatggacgaggctttcaatgcgaaggcttcgacctctgggggcagggaaccctggtgacagttagctctgcgtccaccaaaggtccttcagtgtttccacttgctcccagcagtaagtctacttccggcgggacagccgcactgggatgtttggtcaaagattacttccctgagccagtgaccgtaagctggaactcgggcgccctcacgtctggtgttcacacttttcccgctgtgctgcagtcctcagggctgtatagtctcagctccgtcgtgaccgtgccttctagctcattaggaacacagacttacatttgcaatgtcaaccataagccaagtaataccaaggttgacaaaaaggtggagccgaaa

SEQ ID NO: 24229 - RNA, 633 nt, synthetic construct
  misc_feature 1..633: note = derived and/or modified sequence opt3 from anti-HIV_3MLX_M-Chain
  source 1..633: mol_type = other RNA
agcgtgctgacccagcccccttccgtctctgccgctccaggccaaaaggttacaatctcatgcagtgggagctcctctaacattggaaataacatggtgtcgtggtaccagcagcacccgggtactgcacccaaactccttatatatgaaaattcaaagagacctagcggcatcccagacaggttcagtgggtcccggtctggaacgagcgccaccctgggcattatcggtttgcagacaggggatgaagcggaatactattgtgctacttgggacggatccttacgcaccgtatttggcggcgggacaaaactgaccgtgctatcacaacccaaggccgcacctagtgtcactctcttcccacccagctctgaggagctgcaggccaacaaagctacacttgtgtgcctgatttccgatttttaccctggagcagttaccgtggcctggaaggctgactcaagcccagtccgagccggtgtggaaacgactaccccgagtaagcagtctaataacaaatatgcggcatccagctacttgtcgctcacacccgagcagtggaagtctcatcgttcctattcatgtcaagtaactcacgagggcagtaccgttgagaaaacagtggcccctacc

SEQ ID NO: 24230 - RNA, 684 nt, synthetic construct
  misc_feature 1..684: note = derived and/or modified sequence opt3 from anti-HIV_3MLW_I-Chain
  source 1..684: mol_type = other RNA
caggtgcaactggtccagagcggcgccgaggttaagaaagctggggaatccctcgagatctcttgcaagggatcaggttacaccttcacagaccactggattgcatgggtgagacaggtacccggcaaagggcttgaatggatgggaatgatatatcctggcgatagtgacactaggtacagcccatccctgcagggtcgggtgacgatgtctgccgataagaccttgtcgacagcgtatttacaatggtcacgcctggaggctagcgacactgccatgtactattgtgcacgactacattacagtgatcgttccgggtcttattttaacgacgtcttccacatgtggggacagggcaccacagtgaccgttagctccgcctcaactaaaggcccgagtgtgtttcccctcgctcctagctctaagtccacatcagggggaaccgcagccctgggttgccttgtcaaggattacttcccagaacccgtgacggtaagctggaatagtggcgctctgacttctggggttcatacctttcctgccgtgttgcagtccagcggactctactcgctgtcttccgtcgtgacagtgccatcaagtagcctgggcactcagacctatatctgtaacgtcaatcacaaaccctccaacacaaaggttgacaaaaaggtggagcctaaatct

SEQ ID NO: 24231 - RNA, 645 nt, synthetic construct
  misc_feature 1..645: note = derived and/or modified sequence opt3 from anti-HIV_3MLW_M-Chain
  source 1..645: mol_type = other RNA
cagagcgtgctgacccaacccccttccgcctctggcacaccagggcagagagtcactatctcatgcagtggaaacagctccaatattgagaacaattacgtttattggtaccagcagctcccgggttctacgcccaaacttctgatattcagggacgatcaacggccttcgggcgtgccagaccgcttttcagggagcaagagtggaacctccgcttctttggcaatcagcggcttacgatccgaagatgaggccgactattactgtgcgtcatgggatgacagtcgtggtgggcccgattatgtattcggaacaggcactaaggtgaccgtcctgggccagcctaaagctaacccaacagtgaccctatttccccctagctctgaggaactccaggccaataaggcaactctggtttgccttatttccgacttctacccaggggccgtgacagtcgcttggaaagcagatggatcaccggtgaaggccggtgtagaaaccacgaagcccagcaaacagagtaacaataagtatgctgcctcttcctacctgagcttgactcctgagcaatggaaatcgcacagatcttactcctgtcaggttacccatgagggctcaacagtggaaaagactgtcgcgccaacc

SEQ ID NO: 24232 - RNA, 678 nt, synthetic construct
  misc_feature 1..678: note = derived and/or modified sequence opt3 from anti-HIV_3MLV_N-Chain
  source 1..678: mol_type = other RNA
gaggtgcagctggtcgaaagcggcggggaggttaagcaacccggacagtccctcaaaatctcttgcaagtcaagtggttacaacttccttgacagctggattggctgggtgagacagatacctgggaaaggactggaatggatcggcattatctatccagatgactccgatgcccactactctccgtcgtttgagggtcaggtaaccatgtcagtggacaagagcattagtacagcttatttgcaatggactacgttacaggcatccgataccgggaaatacttctgtacaaggctgtatctatttgaaggagcccagtctagcaatgcgttcgacctctggggccagggcactatgatcctggtctcctcagggaccacaaagggacccagtgtgtttcctcttgctccaagctctaagtccacctcaggtggcactgccgcactggggtgcttggttaaagattacttccccgagcctgtgacagtcagctggaacagtggagccctcacctctggcgtgcatacgtttccagctgtactgcaatccagcggtctgtattcgctctcttccgttgtgactgtcccctcaagtagcttagggacccagacatacatatgtaatgtgaaccacaagccttccaatactaaagtggacaagaaagtcgagccaaagtct

SEQ ID NO: 24233 - RNA, 657 nt, synthetic construct
  misc_feature 1..657: note = derived and/or modified sequence opt3 from anti-HIV_3MLV_M-Chain
  source 1..657: mol_type = other RNA
agctacctgctcacccagcccccttccgtgtctgtctcaccaggccaaacagccagtatcagctgctccggggacaaacttgatgacaagtatgtttcttggtactatcagagaccgggacagtcgcccgtgctgttgatgtaccaggatttcaagaggccttcaggtattccagagcggttaagcggcagtaaatccgggaagactgctacgctgaccatatctggaacacaaagcctagacgaaggcgattattactgtcaggcatgggacgcctccactggtgtatcagggggaggcaccaaactcacagtgctgtttggcgaggggacccgccttactgtcctggcgcagcccaaggctgcccctagtgtgacattgttcccacccagctctgaggaactccaggcaaacaaggccaccctggtttgcctgatctccgatttttatcctggagctgtgacggtcgcatggaaagccgactcaagcccagtgaaggctggtgtagaaactaccacaccgagtaaacaatctaataacaagtacgccgcgtccagctacctctcgttaactcccgagcagtggaaatctcacaagtcctattcatgtcaggttacccatgagggcagtacagtggaaaagaccgtcgcacctacg

SEQ ID NO: 24234 - RNA, 654 nt, synthetic construct
  misc_feature 1..654: note = derived and/or modified sequence opt3 from anti-HIV_3MLU_LightChain
  source 1..654: mol_type = other RNA
tacctgctcacccagccccctagcgtgtccgtctctccaggccaaacagcctcaatcagttgcagcggggacaaacttgatgacaagtatgtttcctggtactatcagagaccgggacagtctcccgtgctgttgatgtaccaggatttcaagaggccttcgggtattccagagcggttatcaggcagcaaaagtgggaagactgctacgctgaccatatccggaacacaatctctagacgaaggcgattattactgtcaggcatgggacgccagcactggtgtatccgggggaggcaccaaactcacagtgctgtttggcgaggggacccgccttactgtcctggcgcagcccaaggctgccccttcagtgacattgttcccacccagtagcgaggaactccaggcaaacaaggccaccctggtttgcctgatctctgatttttatcctggagctgtgacggtcgcatggaaagccgactcctcaccagtgaaggctggtgtagaaactaccacaccgagcaaacaaagtaataacaagtacgccgcgtcttcctacctcagcttaactcccgagcagtggaaatcgcacaagtcttattcctgtcaggttacccatgagggctcaacagtggaaaagaccgtcgcacctacg

SEQ ID NO: 24235 - RNA, 657 nt, synthetic construct
  misc_feature 1..657: note = derived and/or modified sequence opt3 from anti-HIV_3MLT_G-Chain
  source 1..657: mol_type = other RNA
agctacgacctgacccagcccccttccgtgtctgtctcaccaggccaaacagccagtatcagctgctccggggataagctcgacgataaatatgtttcttggtactatcagagaccgggacagtcgcccgtgcttctgatgtaccaggacttcaagaggccttcaggtattccagagcggttgagcggcagtaaatccgggaagactgctacgttaaccatatctggaacacaaagcctggatgaaggcgactattactgtcaggcatgggatgcctccactggtgtatcagggggaggcaccaaactaacagtgctctttggcgacgggacccgcctgactgtccttggacagcccaaggcggctcctagtgtgacactgttcccacccagctctgaggaattgcaggccaacaaggcaaccctcgtttgcctgatctccgatttttatcctggtgccgtgacggtcgcttggaaagcagactcaagcccagtgaaggccggcgtagagactaccacaccgagtaaacaatctaataacaagtacgctgcctccagctacctgtcgctcactcccgaacagtggaaatctcacaagtcctattcatgtcaggttacccatgaggggagtacagtggagaagaccgtcgcgcctacg

SEQ ID NO: 24236 - RNA, 666 nt, synthetic construct
  misc_feature 1..666: note = derived and/or modified sequence opt3 from anti-HIV_3GO1_HeavyChain
  source 1..666: mol_type = other RNA
gaggtgcagctgcaagaaagcggccccgggctcgtcaagccttccgagaccctttctctgacatgcactgtttcaggaggtccaatcaacaatgcctactggacgtggattagacagccgcccggcaaagggttggaatatttaggatacgtgtatcacaccggcgtaacaaactacaatcctagtctgaagtctaggctaactataaccatcgacacatcccggaaacagctctctctgtcgcttaagttcgtgaccgctgcagattcagccgtctattactgtgcgcgcgagtgggctgaagacggtgattttgggaacgccttccatgtgtggggacagggcactatggttgcagtgagcagtgcctccacaaaaggcccatctgtctttcccctggctcctagctccaagtcaaccagtgggggaacggcagccttgggttgcctcgtgaaggactatttcccagagcccgtaactgttagctggaatagcggcgctctgacctccggggtgcacacatttcctgccgtcctgcaatcaagcggactctacagtttatcttccgtggtgactgtcccaagctcgtctctgggcacccagacatacatttgtaacgttaatcataaaccgtccaacaccaaggtggataaacgagtagagccc

SEQ ID NO: 24237 - RNA, 627 nt, synthetic construct
  misc_feature 1..627: note = derived and/or modified sequence opt3 from anti-HIV_3GO1_LightChain
  source 1..627: mol_type = other RNA
agctacgtgctgacccagcccccttccgtctctgtttcaccaggccaaacagccagaatcacttgcagtgctgaggcactcagcaaccagtatgcctactggtataggcagcggccggggcaggcgccccttctgattatatacaaggacacgaaacgcccttccggaatcccagaacgattctctggttcgacctcaggcacaactgtgaccttgacaattagcggggtacaagctgaggatgaagccgactattactgtcagagtgcagattcctctggagactatgtgtttggcggtgggaccaaggtcactgtgttaggacagcccaaagccaatcctacagttaccctgttcccacccagctccgaggaactacaggctaacaaggcaacgctcgtgtgcctgatctcagatttttaccctggcgccgtcactgtggcttggaaagccgacggcagtccagtaaaggcgggggttgagaccacaaagccgagcaaacaatctaataacaagtacgcagcctcctcatatcttagcctgactcccgagcagtggaaaagtcaccgttcttactcctgtcaggtgacccatgaaggaagcacagtcgagaagaccgtggctcct

SEQ ID NO: 24238 - RNA, 690 nt, synthetic construct
  misc_feature 1..690: note = derived and/or modified sequence opt3 from anti-HIV_4XCY_J-Chain
  source 1..690: mol_type = other RNA
caggtgcaactggtccagagcggcgccgaggttaagagacccgggtcctctgtgaccgtatcatgcaaagctagtggaggtagcttctccacatacgcactctcttgggtgaggcaggcccctggccgggggcttgaatggatgggaggcgtcatcccactgttgactattacgaactatgcgccgcgctttcagggtcgaataaccatcacagctgaccgttcgacttcaaccgcctacttagagctgaatagcctaagacccgaagatacagcagtgtattactgtgccagggaggggaccactggatggggctggctcggcaagcctattggggctttcgcacactggggacaaggtacactggttaccgtgagttccgcctctacgaaaggcccaagcgtctttccccttgctccttcctcaaagagtactagcgggggaaccgccgcgctgggctgcttggtgaaagactatttcccagaacccgtaacagtttcttggaactccggtgcactcacttcaggggtgcatacctttcctgccgtcctgcagagcagtggactgtactctctctccagcgtggtgacagtcccatcgtcttccttaggcacccagacgtatatctgtaatgttaaccacaagccgtcaaatactaaggtggataaaaaggtagagcccaaaagttgc

SEQ ID NO: 24239 - RNA, 645 nt, synthetic construct
  misc_feature 1..645: note = derived and/or modified sequence opt3 from anti-HIV_4XCY_K-Chain
  source 1..645: mol_type = other RNA
gagatcgtgctgacccagagccccggcacacaatccctctctcctggggaaagagccactctttcatgcagggctagtcagagcgtcggaaacaataagctggcatggtaccagcagcggccaggtcaagccccgcgcttgttaatttatggcgcgtcctctcgaccctcgggggttgctgaccgtttctcaggaagcggcagtggtacggattttaccctgacaatatccagactagagcctgaagacttcgccgtgtactattgtcagcagtacgggcagtctctcagcacttttggacaaggcaccaaagtagaggtgaagaggacagtcgcagccccatccgtgttcatctttcccccttcagatgaacagctgaaaagtggcaccgctagcgttgtgtgccttctgaacaatttctatccacgggaggcaaaggtccagtggaaagtggacaacgccttgcagtctggaaattcccaagagtcagtaactgaacaggatagcaaggacagtacatactctctctccagcaccctgacgctgtcgaaggctgattatgagaaacacaaggtttacgcctgtgaagtgactcatcaggggctctcttcccccgtcaccaaatcatttaaccgcggtgagtgc

SEQ ID NO: 24240 - RNA, 630 nt, synthetic construct
  misc_feature 1..630: note = derived and/or modified sequence opt3 from anti-HIV_4YBL_C-Chain
  source 1..630: mol_type = other RNA
gtgctgacccagccccctagcgcctccggctctccagggcaatcagtcacaatcagttgcactggaacgagctccgacgttggtggctacaactatgtgtcttggtaccagcaccatccggggaaggctcccaaactcattatatcggaggtaaataacagaccttcaggagtgccagataggttcagcggcagtaagtccggtaataccgcatctcttacagtcagcgggctgcaggccgaagacgaggcggaatattactgttcctcatatactgatatccacaactttgtgttcggaggcggcaccaaattgacagttttagggcagcccaaggctgcccctagtgtgaccctgtttccacccagctctgaggaactacaagcaaataaagccactctcgtctgcctgatttccgacttctaccctggagctgtgacagtagcatggaaggccgattcaagcccagttaaggctggtgtggagaccacgactccgagtaaacagtctaacaataagtatgccgcgtccagctacctttcgctgacccccgagcagtggaaatctcatcggtcctactcatgtcaggtcacacacgaaggcagtactgtggagaagaccgtggcacct

SEQ ID NO: 24241 - RNA, 672 nt, synthetic construct
  misc_feature 1..672: note = derived and/or modified sequence opt3 from anti-HIV_4YBL_B-Chain
  source 1..672: mol_type = other RNA
caggtgcaactgcaggagagcggccccgggctcgtcaagccttcccagaccctttctctgtcatgcacagttagtggaggtagctcctcttcgggcgcccactactggtcatggatcagacagtatccagggaaaggattggaatggattggctacatacattatagcggtaacacttactataatccgagtttaaagtccaggatcacgatttctcaacacaccagcgagaaccagttctccctgaaactaaattcagtgacagtagctgacactgcagtgtactattgtgcccgggggacccgcctccgaacactgcgtaacgcgtttgatatctggggacagggcaccatggtcactgtgagtagcgcttctacaaagggcccctccgttttccctcttgccccatcaagcaaaagtacctctgggggaacggcagccctgggttgcttggtgaaggactactttcccgaacctgtcactgtgtcctggaatagcggcgctctcacctcgggggtacatacattcccagcagttctgcagtcttccggactgtactcactcagtagcgtggtcactgtgccctcctctagcttaggcacccaaacatatatttgtaacgtgaatcacaagccttcaaacaccaaagtcgataagagagttgagccaaaa

SEQ ID NO: 24242 - RNA, 630 nt, synthetic construct
  misc_feature 1..630: note = derived and/or modified sequence opt3 from anti-HIV_4R4N_X-Chain
  source 1..630: mol_type = other RNA
gacatccagatgacccaaagcccctccttcgtgtctgcctcagtcggcgatagagttacaattacttgcagggctagtcaggggataagctcctacctggcatggtatcagcagaagcctggaaaagccccaaagctcgtgatctacgcggcttctacgcttcaatcgggtgtaccgtcacggtttagcggcagtgggtccggaaccgagttcacactgactatttctagcttgcagcccgaagactttgccacctattactgtcagcacttaatcggcctgcgctccttcggtcaggggacaaaactagagattaagcgaaccgtggcagccccttcagtctttatcttcccacccagtgatgaacaactcaaaagcggaactgcttctgtggtttgcctgcttaacaatttttatcctcgtgaggcaaaggtgcagtggaaggtcgacaacgccctgcagtccggcaattcacaggaaagcgtgacagagcaagatagtaaagactctacctactccttgagctcgacgctcactctgtctaaggctgattatgagaaacataaggtatacgcctgtgaagttacccaccagggcctgtcctcaccagtgacaaaaagtttcaacaga

SEQ ID NO: 24243 - RNA, 660 nt, synthetic construct
  misc_feature 1..660: note = derived and/or modified sequence opt3 from anti-HIV_4R4B_F-Chain
  source 1..660: mol_type = other RNA
caggtgcaactgcagcagtggggcgccgggctccttaagcccagcgagaccctgtccttgacatgcggagtctacggtgaatctttatcaggccactattggagttgggttagacagcctccagggaaaaggctggagtggatcggagaaattaagcataacggcagcccgaattaccacccctccctaaaatctcgggtgactatatcgctcgacatgtcaaagaaccaattcagcctgaatcttacgagtgtaaccgctgcagatacagccgtgtatttttgtgcgcgccgatccaactggccttacctgccattcgacccctggggtcaggggactttggtcaccgtgtctagcgcttccacaaaaggaccttcagtttttccactcgcccccagtagcaagtctacctccggcggcactgcagccctggggtgcctggtgaaggattatttccctgagccagtcacagtgtcatggaatagcggagctctcaccagtggtgtacatacgtttccggcagttttacagtcttccggcctgtacagcctttcgtctgtggtcactgtgccctcctcaagtttggggacccagacatatatctgtaacgtgaatcacaaacctagcaacactaaggtcgacaaaaaggttgaaccaaaa

SEQ ID NO: 24244 - RNA, 750 nt, synthetic construct
  misc_feature 1..750: note = derived and/or modified sequence opt3 from anti-HIV_3JUY_D-Chain
  source 1..750: mol_type = other RNA
caggtgcaactggtccagagcggcgccgaggttaagaaacccggggcttccgtgaaggtatcttgccaggcatcaggatacagattcagtcactttaccgtgcattgggtcaggcaggcccctggtcaacggttcgaatggatgggctggatcaacccatataatgggaacaaagagtttagcgcgaagttccaggaccgcgtgacatttactgctgatacgtccgccaataccgcatacatggaactccgatctcttcgttcggccgacacagctgtttattactgtgcaagagtgggagagtggggctgggatgactcaccgtatgataactactatatggacgtctggggtaaagggactaccgtgattgtaagcagtggaggcggcgggtccggaggtggcgggtctggaggcggtgggagcgaaatagttctgacacaggcccccggaaccttgtccttatcacctggcgagagggctactttcagttgccggagctctcactccatccgctcaagaagggtggcctggtaccagcataagccaggccaagcgccccggctggtcattcacggggtgagcaatcgcgcaagtggaatctctgatcgattttccggtagcggctcggggacagacttcaccctaacgattactagagtggagcctgaagattttgccctctactattgtcaggtctacggagcttcttcctataccttcggccagggtacaaagctggagaggaaa

SEQ ID NO: 24245 - RNA, 369 nt, synthetic construct
  misc_feature 1..369: note = derived and/or modified sequence opt3 from anti-HIV_4KG5_HeavyChain
  source 1..369: mol_type = other RNA
cagctggtgcaaagcggccccgaggccaagagacctgggtcctctgtcaaagtttcatgcaaggctagtagggacaccttcaacaattacgtgctcaactgggtacggcaggcaccaggacagggtcttgaatggatgggcgggatcggaccgattatagagacagccgattatgcggaaaaatttcgcggccgactgagcatcactgctgacgagtccacgaccacagcctacatggaattgtcttcgttaacttcagatgacaccgcagtgtattactgtgcccgtagcccctatagttccctgacagatacctactattactacatggacctatggggtaaggggactacagtcaccgtgtctagc

SEQ ID NO: 24246 - RNA, 336 nt, synthetic construct
  misc_feature 1..336: note = derived and/or modified sequence opt3 from anti-HIV_4KG5_LightChain
  source 1..336: mol_type = other RNA
ctgacccagagccccgactccctcgccgtgtctcttggcgagagagctacaatcaactgcaagtcaagtcaaagcattctggattcctctaataacaggaattacttgacttggtatcagcagaaacctgggcagccaccgaagttactgatatactgggcatcgacgcgggaatcaggagtccccgaccgcttcagcggtagtggctcctctaccgattttacactaactatcagctccctccaagccgaggacgttgcggtgtattactgtcagcagtatttctcaacccctgggattacatttggacagggcacccgactggaaatcaaacgt

SEQ ID NO: 24247 - RNA, 309 nt, synthetic construct
  misc_feature 1..309: note = derived and/or modified sequence opt3 from anti-HIV-1_LightChain
  source 1..309: mol_type = other RNA
gagatcgtgctgacccagagccccgccacactctccctttctcctggcgaaagagctactctgtcatgcagggcaagtcaaagcgtctacacgaagttggcctggtatcagcagaaaccagggcagccgccccggttactgatttacgacgcgtccaaccgcgctgccggaatacctgcacgattctctggttcgggctcagggaccgagtttacactaactatcaagcgtatggaaagagaggatttcgccgtttattactgtcaaattctcgaatttttcggacagggcaccacaatcgacatgaat

SEQ ID NO: 24248 - RNA, 312 nt, synthetic construct
  misc_feature 1..312: note = derived and/or modified sequence opt3 from anti-HIV-1_LightChain
  source 1..312: mol_type = other RNA
gacatccagatgacccaaagcccctcctctgtgtcagccagtgtcggcgatagagttacaattacttgcagggctagccaggggatactgtcctctcagctcgcatggcaccagcaacggcgcggacagcctccacgacttctgatctacggtggctcgaaccgtgccccggggattcccgagagattcacgggatcaggcagcggtaccgactttgtgttgacaatcaagaggttacagcgggatgacttcgcggtatattactgtcagattctggaatttttcgggcgcggaactagagtggagatgaat

SEQ ID NO: 24249 - RNA, 312 nt, synthetic construct
  misc_feature 1..312: note = derived and/or modified sequence opt3 from anti-HIV-1_LightChain
  source 1..312: mol_type = other RNA
ggcctgctccttacccagagccccgggcctgtgtccttctttccaggagagagagccacagtctcttgcagggcttcacacagtgttaacagcgcagccatcaattggtaccaacagaagcggggtcagccgccccgcctgattatagtggacggctccactcgagcgacggctgtacctgaacgtttctctgccaccgggtcgggaacagagtttactttggtgatctcaagattagaaccagaggatttcgcagtctatttttgtcagcatctgcaattctttggcctaggtaccaaagtggacattaag

SEQ ID NO: 24250 - RNA, 312 nt, synthetic construct
  misc_feature 1..312: note = derived and/or modified sequence opt3 from anti-HIV-1_LightChain
  source 1..312: mol_type = other RNA
gccttcgtgatgacccagagccccggcacactggctctctcccctggggagagagcaactctttcttgcaggacgtcacaagaaatcctgagtaaccagttggcctggcaccagcagcggcgcggacaaccaccgcgattactgatttacggtggcagcaatcgtgcgcccgggatacctgagagatttaccggatccggctctggtacagacttcgtcctaactatcaacaggctcgaacgggatgactttgctgtttattactgtcagattctggagttctttgggcgcggaaccagagtggaaatgaat

SEQ ID NO: 24251 - RNA, 312 nt, synthetic construct
  misc_feature 1..312: note = derived and/or modified sequence opt3 from anti-HIV-1_LightChain
  source 1..312: mol_type = other RNA
ggcatcgtgctgacccagagccccgacacactctccctttctcctggggatagagccactctgtcatgcaagacgagtcaaagcattgcttccgagcacttggcatggtaccagcagaggccaggacagccgccccggttactgatattcggtgcctctaaccgcgcgtcgggcatccctacccgattttcagggagcggaagtggcgctgacttcacactatccattactcgtctcgaaccagaggattttgccgtctattactgtcaattctctgaatttttcggtagaggggcaagggttgaggtgaaa

SEQ ID NO: 24252 - RNA, 312 nt, synthetic construct
  misc_feature 1..312: note = derived and/or modified sequence opt3 from anti-HIV-1_LightChain
  source 1..312: mol_type = other RNA
cagttcgtgatgacccaaagccccgccacactgtcctcttcacctggcgggactgctacgctcagttgcagaaccagccactccatccttaactctcagctggcatggcatcagcagaggcggggacaaccattgcgcttactgatttacggtgcctcgaatcgagcgccgggcatacccgagcgtttttcagctagcgggagtggaacagagttcgtcctaactatcaagagaatggaaagggaagactttgccgtttattactgtcagattctcgagttctttggccagggtaccacaatcgatatgaac

SEQ ID NO: 24253 - RNA, 354 nt, synthetic construct
  misc_feature 1..354: note = derived and/or modified sequence opt3 from anti-HIV-1_HeavyChain
  source 1..354: mol_type = other RNA
agagtgcacctggtccagagcggcacccaagttaagaaacccggggcctccgtgaaggtatcttgcgagacatcaggattcaaatttctcgacagtcttatccattgggtgaggcaggctcctggtcagggcctgtactggatggggtggattaagccatatcggggaagcgtcaactacgatggctatttccgcggtcgagtgtccatgactcgtgacatatacacggataccgcatatttggaattatctgggctgagatcggacgatacagccatctactattgtgcgtttggagctggcgacggctgggatctagtttgggggcagggaactctcgtgattgtctcaagc

SEQ ID NO: 24254 - RNA, 354 nt, synthetic construct
  misc_feature 1..354: note = derived and/or modified sequence opt3 from anti-HIV-1_HeavyChain
  source 1..354: mol_type = other RNA
agagtgcacctggtccagagcggcacccaagttaagaaacccggggcctccgtgaaggtatcttgcgagacatcaggattcaaatttctcgacagtcttatccattgggtgaggcaggctcctggtcagggcctgtactggatggggtggattaagccattccggggaagcgtcaactatgatggctactttcgcggtcgagtgtccatgactcgtgacatatatacggataccgcatacatggaattgtctgggttaagatcggacgatacagccatctattactgtgcgttcggagctggcgacggctgggatctggtttgggggcagggaactctagtgattgtctcaagc

SEQ ID NO: 24255 - RNA, 354 nt, synthetic construct
  misc_feature 1..354: note = derived and/or modified sequence opt3 from anti-HIV-1_HeavyChain
  source 1..354: mol_type = other RNA
caggtgcacctggtccaaagcggcacccaggttaagaaacccggggcctccgtgagagtatcttgcgagacatcaggattcaagtttctcgacagtatcattcattggttcaggcaggctcctggtgaaggcttgttttggatggggtggataaaaccatacactggaagcgtgaactatgtccggcgctaccagggccgagtgtccatgacgcgtgatgtttattctgacaccgcatacatggatctgtcgggtcttaattcagacgatacagccgtgtatttctgtacttacggggcgggagacggctggaacttagtctggggccaagggaccctggtgatcgtaagcgct

SEQ ID NO: 24256 - RNA, 363 nt, synthetic construct
  misc_feature 1..363: note = derived and/or modified sequence opt3 from anti-HIV-1_HeavyChain
  source 1..363: mol_type = other RNA
caggtgagactggtccaaagcggcaaccaggttaggaagcccggggcctccgtgcggatctcttgcgaggcttcaggatacaaattcattgaccactttatacattgggtacgccaggtgcctggtcacggcctcgaatggcttgggtggatcaatccacgaggaggcggtgtcaactatagtcgtgggttccagggaaagctgagcatgaccatgacaagagataattttgaggaaactgcatacttggacttatccaggctgaacccgggcgatacggccgtgtattactgtgcgcggggcttcgctgggtatgagtggtcttttctatggggacaaggtaccctcgttattgtgtcgtca

SEQ ID NO: 24257 - RNA, 357 nt, synthetic construct
  misc_feature 1..357: note = derived and/or modified sequence opt3 from anti-HIV-1_HeavyChain
  source 1..357: mol_type = other RNA
caggtgagcctggtccaatccggcaaccagctcaagaaacccggggcctctgttagaatctcatgcgagaccagtggatacaatttccttaaccactttattcattgggtgaggcaggtacctggtcacggcctggaatggttggggtggataaatccacggggaggcggtgtgaactatagccgcaatttccaggggaaggtctccttaacacgaaacatcgacatggagactgtgtacctggatgttcgtggactaacgccgggcgacaccgctgtgtattactgtgcaagaggctttgggggatctgattggaatttcgtctggggtcaaggcacaaggattactgtgtcggcc

SEQ ID NO: 24258 - RNA, 357 nt, synthetic construct
  misc_feature 1..357: note = derived and/or modified sequence opt3 from anti-HIV-1_HeavyChain
  source 1..357: mol_type = other RNA
agaatcaacctgcaccagagcggctcccaagtgaagaggtctggggcctcagtccggattagttgcgagaccagcggattcaaatttatggactcccatctccactgggttcgccaggtggctggtcagggcttcgaatggatggggtggatatttacatctggaggcggtgtaaattacgcacgacagttccaagggcgtcttactctgacgagagatgtgtttaccgacacagtcttcatggatttgtcgggagtgaacgttggcgacactggcgtgtattactgtgtcaaggggaccggaggtaatgagtggggcttttcatgggggcagggaacagtggtagttgtgagcccc

SEQ ID NO: 24259 - RNA, 357 nt, synthetic construct
  misc_feature 1..357: note = derived and/or modified sequence opt3 from anti-HIV-1_HeavyChain
  source 1..357: mol_type = other RNA
agaatcaacctggaccagagcggctcccaagtgaagaaatctggggcctcagtcaggattagttgcgagaccagcggattcaagtttatggattcccacctccattgggttcgccaggtggctggtcagcccttcgaatggatgggctggatatttacatctgggggaggcgtaaattacgcacggcagttccaaggtcgacttactctgacgcgtgacgtgttttcggagaccgtcttcatggatttgtcagggttaaacgccggagacacaggcgtgtatttttgtgttaaaggcactgggggaaatgaatggggtttcgtgtggggccaggggaccgtcgtggtagttagccct

SEQ ID NO: 24260 - RNA, 357 nt, synthetic construct
  misc_feature 1..357: note = derived and/or modified sequence opt3 from anti-HIV-1_HeavyChain
  source 1..357: mol_type = other RNA
agaatcgagctgcaccagagcggctcccaagtgaagaaatctggggcctcagtcaggattagttgcgaaaccagcggattcaagtttatggactcccatctccactgggttcgccaggtggctggtcagcggttcgagtggatgggctggatatttacatctgggggaggcgtaaactacgcacgacagttccaaggtcgtcttagactgactagggatgtgttttcggaatcagtcttcatggacttgagcgggttaaatagtggagatacgggcgtgtattactgtgttaaaggcaccgggggaaacgagtggggttttgtgtggggccaggggtccctggtcgtggtatctccc

SEQ ID NO: 24261 - RNA, 372 nt, synthetic construct
  misc_feature 1..372: note = derived and/or modified sequence opt3 from anti-HIV-1_HeavyChain
  source 1..372: mol_type = other RNA
caggccctggtgcaaagcggctcccagatgaagaaacccggggactctgtcagactctcatgccagaccagtgatagcgctatcacaaagtacttcattcactggataaggcaggcacctggaaaaggtcttgagtggatcgcctggatttccccatatggcgggcgggttaactacggatggcaagtgcgcgaccgagcgactctgacgcgtaatatccatatggaaaccgtatatatggatttgagaggcttaaggccggacgatacagctacttactattgtgccatgcgggactactgccgcgatgacaactgtaatagatgggatctgggtcactgggggcagggatctctaattgtggtctcggca

SEQ ID NO: 24262 - RNA, 357 nt, synthetic construct
  misc_feature 1..357: note = derived and/or modified sequence opt3 from anti-HIV-1_HeavyChain
  source 1..357: mol_type = other RNA
caggtgaccctggtccaaagcggcaaccagctcaagagacccggggcctccgttaggatctcttgcgagacatcaggatacaatttcatggaccactttattcattgggtgcggcaggtacctggtcacggcccagaatggcttgggtgggtgaacccgcgcggaggcggtgtcaattatagtcgaaaattccaggggcgttttagcatgactagagatgtgtacatggagacggcttatctggacgttaccggattgtcccccgcagatacagccgtgtactattgtgcgaggggcttcggcgggtctgactggtcgtttttatggggacaaggtactctgataatcgtctcaagc

SEQ ID NO: 24263 - RNA, 324 nt, synthetic construct
  misc_feature 1..324: note = derived and/or modified sequence opt3 from anti-HIV-1_LightChain
  source 1..324: mol_type = other RNA
gagatcgtgctgacccagagccccggcacactctccctttctgccggggaaagagcttcactgagttgcagggcaagccaaactttgaactccaatttctttgcctggtaccaccagaagcctggacaggcgccacggttactgatttatggtgcttctaaccgcgccacgggcataccggaccgattctcggggtcaggaagcggcagtgattttaccctaacaatctcccgtctcgagcccgaagacttcggtaaatactattgtgagcagtacgatgtctctcctagaacttttgggcaaggaaccaaggttgaaattaaa

SEQ ID NO: 24264 - RNA, 324 nt, synthetic construct
  misc_feature 1..324: note = derived and/or modified sequence opt3 from anti-HIV-1_LightChain
  source 1..324: mol_type = other RNA
gaggtggtcctgacccagagccccggcacactctccctttctcctggggaaagagccactctgtcatgcagggctagtcaaagcatcaactccaatttctttgcatggtaccaccagaagccaggacaggccccgcggttgttaatttatggtgcgtcttcgcgcgctacgggcatacccgaccgaatctcagggaccggaagcggcgccgatttcacactgactattaccggtctagagcctgaagactttgggctctactattgtcagcaatacgatttcagtccacgtacatttggacagggcaccagagttgagatcaaa

SEQ ID NO: 24265 - RNA, 324 nt, synthetic construct
  misc_feature 1..324: note = derived and/or modified sequence opt3 from anti-HIV-1_LightChain
  source 1..324: mol_type = other RNA
gaggtggtcctgacccagagccccggcacactctccctttctcctggggaaagagccactctgtcatgcagggctagtcaaacgatcaacagcaatttctttgcatggtaccaccagaagccaggacaggccccgcggttgttaatttatggtgcgtcctctcgcgctaccggcatacccgaccgaatctcggggtcaggaagcggcacagatttcactctgaccattacaggtctagagcctgaagactttgggctctactattgtcagcaattcgattttagtccacgtaccttcggacagggcactagagttgagatcaaa

SEQ ID NO: 24266 - RNA, 324 nt, synthetic construct
  misc_feature 1..324: note = derived and/or modified sequence opt3 from anti-HIV-1_LightChain
  source 1..324: mol_type = other RNA
gagatcgtgctgacccagagccccggcacactctcccttgcccctggggaaagagctactctgtcttgcagggcatcacaaagtattagcacgacctacttggcctggtatcagcagaagccaggacaggcgccgcggttactgatatacgagacatcctctcgcgcttcggacatccccgatcgattctcaggtagcggcagtgggactgactttaccctaacaatttcccgtctcgaacctgaggatttcgccgtctattactgtcaccaatatgacagatctccaaggacctttggacagggcactaaagttgaaatcaag

SEQ ID NO: 24267 - RNA, 336 nt, synthetic construct
  misc_feature 1..336: note = derived and/or modified sequence opt3 from anti-HIV-1_LightChain
  source 1..336: mol_type = other RNA
gacatcgtgatgacccagagccccgcctccctgtctgtcacacctggcgagactgcttcaattagttgcaagtgtagcagatccctcagggaagaggttgggtacaactatcttgattggtacctgcaacggccaggaaaatctccgcagttgttaatatatgtgggttcgttccgcgcacccggcgtatcagaacgatttcgtgggagcggagagcacaaggacttcacgctgaaaatcgccagagtggaacctggcgatgcgggtatttactattgcatgcaggggatcgacaccccaaggacatttggacagggcactaccctagagattaat

SEQ ID NO: 24268 - RNA, 321 nt, synthetic construct
  misc_feature 1..321: note = derived and/or modified sequence opt3 from anti-HIV-1_LightChain
  source 1..321: mol_type = other RNA
gacatccagatgacccaaagcccctcctctctgtcagccagtgtgggcgatagagtcacaattacttgcagggctagccaggcattccggaacgacctcgggtggtaccagcacaagcctggaaaagccccagagcgccttatatatgcgacgtccaccctggaatctggtgttccgtcgcgattttcaggcagcgggagtggaacaaatttcactttgaccatctcctctttacaggctgaggattttgccacatactattgtctgcaatacaacaccttcccccgtacttttggccagggtacaaaggtggaaattaaa

SEQ ID NO: 24269 - RNA, 333 nt, synthetic construct
  misc_feature 1..333: note = derived and/or modified sequence opt3 from anti-HIV-1_LightChain
  source 1..333: mol_type = other RNA
aacttcatgctgacccagccccacagcgtgtccgagtctcctggcaagacagtcactatctcatgcgccagaacgaggggagggattgacagtgcttacgttcattggtatcaacagcggccaggtagcgtgccgaccacagtaatatttgaagataatcgccgaccccctggcgtgccagaccgtttctccgggtctatcgatacttcgtcaaacaccgcaagcctcacaattagtggacttaaaaccgaggacgaagccgattactattgtcagtcctacgacgatacttatttttgggtcttcggcggtgggacaaagctgaccgtgttg

SEQ ID NO: 24270 - RNA, 333 nt, synthetic construct
  misc_feature 1..333: note = derived and/or modified sequence opt3 from anti-HIV-1_LightChain
  source 1..333: mol_type = other RNA
aacttcatgctgacccagccccacagcgtgtccgagtctcctggcaagacagtcactatctcatgcgccagaacgagggggaccattgacagtgcttacgttcattggtatcaacagcggccaggagcagtgccgacaactgtaatatttgaagatgaccgccgacccagcggtgtgcctgatcgtttctccggctctatcgactcgtcaagcaatagtgcctccctcaccatttctgggcttaaaacagaggatgaagcggactactattgtcagagctacgattccaactattactgggtctttggaggcggtaccaagctgactgtgttg

SEQ ID NO: 24271 - RNA, 396 nt, synthetic construct
  misc_feature 1..396: note = derived and/or modified sequence opt3 from anti-HIV-1_HeavyChain
  source 1..396: mol_type = other RNA
caggtgcaactgcagcagagcggccccgccctcgtcaagccttccgagaccctttctctgacatgctcagttagtagcgggagagtgtcctcttactattggtcgtggatcaggcagtcaccaggaaaaggtttggaatggattggctacatacactatgacccggatactaacacgaattaccggacccattatcaccccagcttacgcgggcgagtagtgatcagtgtcgactcctctaagagccaagtgtccctgaaagttcgttcagtgacagctgcagatagtgccctatactattgtgcgagacataggtacgacccttggagcaagggatacgatattcggtctccattcgacttttggggccagggtactctcgtcaccgtgtcctca

SEQ ID NO: 24272 - RNA, 396 nt, synthetic construct
  misc_feature 1..396: note = derived and/or modified sequence opt3 from anti-HIV-1_HeavyChain
  source 1..396: mol_type = other RNA
caggtgcatctgcaacagagcggccccgggctcgtcaagccttccgagaccctttctctgacatgcactgtttcaggaggtagagtgagtagctactattggtcctggatcaggcagtctccaggcaaagggttggaatggattggatacatacactatgacccggatacgtcgaccaactaccggacacactatcatccctcattacgcggccgagtagtgatcagcgtcgacaccagtaagaatcaggtgtccctgactgttcgttctgtgacagccgctgatagcgcactatactattgtgccagacacaggtacgacgtctggtccaacggttacgatattcggtcaccttatgacttctgggggcgcggaaccctcgtgactgtaagtagc

SEQ ID NO: 24273 - RNA, 396 nt, synthetic construct
  misc_feature 1..396: note = derived and/or modified sequence opt3 from anti-HIV-1_HeavyChain
  source 1..396: mol_type = other RNA
caggtgcacctggagcaaagcggccccgccctcgtcaagccttccgaaaccctttctctgacatgcactgtttcagggggaagagtgagtagctactattggtcctggatcaggcagtctccaggtaaaggcttggagtggattgggtacatacattatgacccggatacgtcgaccaactaccggacacactatcatccctcattacgcggacgagtagtgatcagcgtcgacagttccaagaatcaggtgtctctgaaagttcgtagcgtgactgctgcagattccgccctatactattgtgcgagacacaggtacgacgtctggtcaaagggctacgatattcggagtcctttcgacttttggggtcgcgggaccctcgtgacagtaagctct

SEQ ID NO: 24274 - RNA, 390 nt, synthetic construct
  misc_feature 1..390: note = derived and/or modified sequence opt3 from anti-HIV-1_HeavyChain
  source 1..390: mol_type = other RNA
caggtggtcttccaaaagcccggccctggggttgtgaaaccaagcgagaccctgtccctcacatgcactgtatctggaggtagagtgaggtcatactattggagttggatccggcttccgcccggccaggggctggaatggattggatacatacactatgacgagacgaccgaatacaagcgcagctataacccttccttgaaatctcgaatcacaatttcgatggatacttcaaagaatcaggtcagcttaaaactgagttccgtgaccgccgctgacgcagccgtttactattgtgcgcgtcatagatacgataggtggtctgacagctacgatatccggtccccatttgacatttggggccagggtacagtggtcaccgtgtcagct

SEQ ID NO: 24275 - RNA, 396 nt, synthetic construct
  misc_feature 1..396: note = derived and/or modified sequence opt3 from anti-HIV-1_HeavyChain
  source 1..396: mol_type = other RNA
caggtgcaactgcagcagtggggcgccgggctccttaagcccagcgagaccctgtccttgacatgcgctatctacggatcttcattcagtggtcactattggatgtggattagacagagccctgcaaaaactttagaatggatagccgagatcaaccatacgggcgggaccaggtacaatccatccctggcgtctcgggtccgcgtttttagtgacacatcaaagaaccaattcagcctaaatatgacttcgctcaccgctgccgatacaggaatttattactgtgtgcgaggccacctgtcccgtgacagacttggtcagtatgcattttggtctggggccctgatcgattacttggacccgtggggacagggcaccctcgtaactgtgagctcc

SEQ ID NO: 24276 - RNA, 387 nt, synthetic construct
  misc_feature 1..387: note = derived and/or modified sequence opt3 from anti-HIV-1_HeavyChain
  source 1..387: mol_type = other RNA
caggtgcaactgcaccagtggggcgccgggctccttaagcccagcgagaccctgtccttgacatgcgctgtctacggatctttcactggttttcagtggacgtgggttagacagacccctggcaaggggttagaatggatcggagagattaaccattcaggcctgctagtgacaggtaagactgactataatccaagtctcgaaagcagggtaaccatatccgtggatacatctaaaaaccaattctcgctgaaacttacctcagtcactgcagccgacacaggggtgtactattgtgcgcgggctggaggcatgagcgattgggcctacccgtattactatggcatggacgtttgggggcagggaaccatggtgacggtcagttcc

SEQ ID NO: 24277 - RNA, 357 nt, synthetic construct
  misc_feature 1..357: note = derived and/or modified sequence opt3 from anti-HIV-1_HeavyChain
  source 1..357: mol_type = other RNA
caggtgcaactggtcgagagcggcgggggagttgtgcagcccggtagatccctcaccctttcttgcgccacatcaggcttcgactttagtagctacgggttccactgggtaaggcaggctcctggaaagggcctgcagtgggtgtccatcatttctcatgatggttcgatcaaaaactatggggactcaatgaagggacggtttagcgtcagtcgcgataatgcaaaagacatattgtacttacaaatgaactccctgcgaccagatgacactgccctatatcactgtgtgcgtggcgatggcgaaaatgggggaacggactactggggtctcggcaccctggttacagtgtctgcg

SEQ ID NO: 24278 - RNA, 357 nt, synthetic construct
  misc_feature 1..357: note = derived and/or modified sequence opt3 from anti-HIV-1_HeavyChain
  source 1..357: mol_type = other RNA
caggtggacctggtcgagagcggcgggggagttgtgcaacccggtaagtccctcaaactttcttgcaccgcctcaggcttcacatttacgagttacgggatgcactgggtaagacagatccctggaaagggcctggaatgggtggctattataagccatgatggtactatcaaaaactatggggactccgtcaagggaaggttcaccatttctcgggataatgcaatgaacatcttgtacttacagatgaataacctgcgcggcgacgatacagccctatattactgtgtgcgaggcgacggggagaatggaggtactgattattggggccaggggaccgttgtgacagtctcgtca

SEQ ID NO: 24279 - RNA, 369 nt, synthetic construct
  misc_feature 1..369: note = derived and/or modified sequence opt3 from anti-HIV_V3_HeavyChain
  source 1..369: mol_type = other RNA
gaggtgcagctggtccaaagcggcgccgaagttaagaaacccggggagtccctcaagatctcttgccagggattcggttacaccttttcaacatattggattggctgggtgagacagatgcctgggaaaggacttgaatggctgggcataatctacccagaggacagtgaaactatttatagcccgtccttccagggtcaagctacgatctctgcagataagtcgttgtcaaccgcctacttacagtggagcgggctgagggcgagtgactccgctatttattactgtgcccggctaggatattgcggctctacaagctgttcctttttcgatttttggggccgcgggactctcgtaaccgtgtcaagt

SEQ ID NO: 24280 - RNA, 369 nt, synthetic construct
  misc_feature 1..369: note = derived and/or modified sequence opt3 from anti-HIV_V3_HeavyChain
  source 1..369: mol_type = other RNA
gaggtgcagctggtccaaagcggcgccgaagttaccaagcccggggagtccctcaaaatctcttgcaagggatcaggttacagtttcagcacacactggattgcttgggtgagacagatgcctggcagggggcttgaatggatgggatttatatatccagacgattccgacactcggtactctccgtcgctgcagggccatgtaatcatttcagcagataagagcttgagtacggcctatttacagtggtcctctctgaaagcgagcgacaccgctatgtactattgtgcccgcctaggtggggatgagtaccaatcctcaggaggcatggacgtgtggggccaggggacaactgtcatcgtgagtagc

SEQ ID NO: 24281 - RNA, 393 nt, synthetic construct
  misc_feature 1..393: note = derived and/or modified sequence opt3 from anti-HIV_V3_HeavyChain
  source 1..393: mol_type = other RNA
gaggtgcagctggtccaaagcggcgccgaagttaagaaacccggggctaccgtgaagatctcctgcaaagtatctggatacacactcactgactattacattcactgggtgcagcaggcacctggtagaggccttgagtggctggggttggtcgatccagaaaacggagagacgttatatgccgaaaagttccagggcagggtgaccctgacagcggacacttcaaccgatacagcttacatggagctaaaaagtctccggtatgaggacaccgccgtttactattgtgcaactgaaggtccgcccagctactacgattccgggacatatgccaagtctctgcctgcttcgtttgcatgctggggacaaggcacccttgtgacggtctcaagc

SEQ ID NO: 24282 - RNA, 369 nt, synthetic construct
  misc_feature 1..369: note = derived and/or modified sequence opt3 from anti-HIV_V3_HeavyChain
  source 1..369: mol_type = other RNA
caggtgcaactgcaggagagcggccccgggctcgtcaagccttccgaaaccctttctctgacatgcactgtttcaggaggtagtatcaacaattactattggagctggattagacagccaccgggcaaagggttggagtacataggatatatcttctactccggctctacgaactataatccctcgttaaagtcaagggtgacctttagcgtagacacaagtaaaaaccagttctccctgaagctaacttctgtgaccgccacagataccgctgtctactattgtgcacggggtcctctcctgtactttggggccccacgcactcacttcgactactggggacaaggcgcgcttgtgacagttagctcc

SEQ ID NO: 24283 - RNA, 372 nt, synthetic construct
  misc_feature 1..372: note = derived and/or modified sequence opt3 from anti-HIV_V3_HeavyChain
  source 1..372: mol_type = other RNA
gaggtgcagctggtccaaagcggcgccgaagttaagaaacccggggagtccctcaagatctcttgcaaaggatcaggttacagtttcagctcccactggattggctgggtgagacagcttcctgggaagggactggaatggatgggcataatctatccagacgattctgacaccaaatacaacccgtcgtttcagggtcaggtaacaatttcagctgataggagcatcagtactgcatatttgcaatggtcctctttaaaggccagcgacacggcgatgtactattgtgctcgggtggggtacgattcctatggatactcaggcagtaatttcgacgagtggggccaggggaccctggtcacagtgagctct

SEQ ID NO: 24284 - RNA, 357 nt, synthetic construct
  misc_feature 1..357: note = derived and/or modified sequence opt3 from anti-HIV_V3_HeavyChain
  source 1..357: mol_type = other RNA
gaggtgcagctggtccaaagcggcgccgaagttaagaaacccggggagtccctcaagatctcttgcaaaggatcaggttacaacttcaatagtgactggattggctgggtgagacagatgcctgggaagggacttgaatgggtaggcatgatatatccagatgactttgaggtgaggcacagcccgcccttccagggtcgggtcaccatgtccgtggataaatctatctcgacagcttacctgcagtggagctcattgaagagttccgacactgggatgtatttttgtgcacgcttagatggaaacgccgcggctttcgactactggggccaaggcacgcaggttaccgtgtctagc

SEQ ID NO: 24285 - RNA, 360 nt, synthetic construct
  misc_feature 1..360: note = derived and/or modified sequence opt3 from anti-HIV_V3_HeavyChain
  source 1..360: mol_type = other RNA
gacgtgcagctggtccaaagcggcgccgaggttaagaaagctggggaatccctcaagatctcttgcagaccctcaggatacaacttcgcagattattggattggttgggtgaggcagatgcctggcaaagggcttgagtggatgggaataatctttccagacgatagtgacacccggtacggcccgagcttcgaaggtcaggtaacaatttccgccgataagtctatcaatactgcgtatctgcagtggaactcgttgaaagcctcagacacggctatgtacttttgtgcacgccacgggggaagcggcgccgctcccggcgattattgggggcaaggaaccttagtgacagtcagttcc

SEQ ID NO: 24286 - RNA, 363 nt, synthetic construct
  misc_feature 1..363: note = derived and/or modified sequence opt3 from anti-HIV_V3_HeavyChain
  source 1..363: mol_type = other RNA
gaggtgcagctggtccaaagcggcgccgaagttaagaaacccggggctaccgtgaagatctcctgcaaagtatctggatacacattcactgactattttatgcactgggtgcaggaggcacctggtaagggcctcgcctggatggggcttgtcgatccagaaaacggagacacggtgtacgcggagaaactgcagggcagagttaccatgtcagctgatacaagtagggacactgcctatatggaattgaccagcttacggtccgaggatacagcagtgtactattgtgccattggtaagtctgtcgctgggacctcggcatacgacatatggggacagggcactatggtgacagtatcaagc

SEQ ID NO: 24287 - RNA, 369 nt, synthetic construct
  misc_feature 1..369: note = derived and/or modified sequence opt3 from anti-HIV_V3_HeavyChain
  source 1..369: mol_type = other RNA
caggtgcaactggtccagagcggcgccgaggttagaaagcccggggcttccgtgaaagtatcttgcaaggcatcaggagacaccttcaacaatcacgatatcaactgggtgaggcaggcccctggtcagggcccagaatgggtcgggtggatgaatccgaaaagtggaaacgcgggctacgctcaaaagtttcagggtcgggtgacaatgactcgcgacacgagcatttccaccgcctatatggagctccgatctcttacatcggaagatactggggtttactattgtgcacgtctgaccgtggactgcgatgacggaggctgttacggcgattattgggggcagggaacattggtcaccgtgtcaagc

SEQ ID NO: 24288 - RNA, 354 nt, synthetic construct
  misc_feature 1..354: note = derived and/or modified sequence opt3 from anti-HIV_V3_HeavyChain
  source 1..354: mol_type = other RNA
gaggtgtacctgcagcaaagcggcgccgaactcaaggagcccggggctaacgtcaaaatctcctgcaaggcattcggatttattttcaccgactattttatacactggcttagacaggcccctggtaaaggcccacagtgggttggggtggtagatccggaagacggatctacaacttacgcggaggctttccagggcagggtgtcaatcacggccgatcggagtaccgacacagcatatatggatctggccggtttgactagcgacgataccgctgtctactattgtgcattaatgtggaatgaatccgggcccgacaactggggacaaggcacactggtgattgtttcttcg

SEQ ID NO: 24289 - RNA, 393 nt, synthetic construct
  misc_feature 1..393: note = derived and/or modified sequence opt3 from anti-HIV_V3_HeavyChain
  source 1..393: mol_type = other RNA
gaggtgcaggtcgttgagttcggcggggaagtgaagaaacccggagccagcgtaaaggtgtcctgcgaggcttctggttacacctttgcaaaattcgccatccactgggtcagacaagcgcctaggcagggcctggaatggatggggtggattaacggagacgatggcaagacagaatattcacagaaatttcaggaccgggtgactatgacgcgcgataccagtgctagcacagtttacatggagctctcctctcttcgatcggaggacactgccctgtattactgtgcacgtgccatgtatccagataccgtgacaggtaatgacaacccggctccccctccattcgaaggggattactggggacaaggcaccttggtcactgtgtcaagc

SEQ ID NO: 24290 - RNA, 393 nt, synthetic construct
  misc_feature 1..393: note = derived and/or modified sequence opt3 from anti-HIV_V3_HeavyChain
  source 1..393: mol_type = other RNA
gaggtgcagctggtcgaaagcggcgggggactcgttaagcccggtggctcccttagactgacctgcgtggcctctgggttcacattttcagacgtatggttgaactgggtgaggcaagctcctggaaaaggcttagagtgggtcggtcggatcaagagtcgcactgatgggggaacgaccgactacgcagccagcgtgaaaggccgattcacaatttcccgtgatgactctaagaatactctgtatctacagatgaactcgctcaaaaccgaagatacagcggtttactcatgtaccactgacggctttataatgatcagaggggtgagcgaggattattactattactatatggacgtctggggaaagggtacaaccgtgacggtaagttcc

SEQ ID NO: 24291 - RNA, 387 nt, synthetic construct
  misc_feature 1..387: note = derived and/or modified sequence opt3 from anti-HIV_CD4bs_HeavyChain
  source 1..387: mol_type = other RNA
gaggaacagctggtggagagcggcgggggactcgtcaagcccggtggctcccaaagactttcttgcgccgcttcagagttcacctttagtaggtacacaatgaactgggttcggcaggcacctgggaaaggactggaatgggtgagctccatctctggcaatgacaacaatatttattacgccgattcggtaaagggtcgcttcactatatcacgagacaacgcgcgtaatagcttgtatttacagatcaacagtctgagagtggaagatacggctgtctactattgtgccagggggccactagactcctacgatttttggtctggaagccggcactattacggcctcgacgtgtggggccaggggaccacagttactgtgtcctca

SEQ ID NO: 24292 - RNA, 372 nt, synthetic construct
  misc_feature 1..372: note = derived and/or modified sequence opt3 from anti-HIV_CD4bs_HeavyChain
  source 1..372: mol_type = other RNA
caggtgcaactggtccagagcggctccgagctcaagaaacccggggcctctgttaaggtgtcatgcaaagctagtggatacaccttcacaagccacatcattaactgggtaagacaggcacctggtcagggccttgaatggatggggtggataaatactaacacgggaaatccaacctatgcccaaggctttacaggtaggttcgtgttttccctggacacttctgtctcgatggcgtacttgcagatcagctcattaaaggctgaggataccggggtgtattactgtgcccggggattccgccagtggctggttgcacgaattacatattttgactactggggccagggcaccctagtgactgtcagttcc

SEQ ID NO: 24293 - RNA, 369 nt, synthetic construct
  misc_feature 1..369: note = derived and/or modified sequence opt3 from anti-HIV_CD4bs_HeavyChain
  source 1..369: mol_type = other RNA
gagctgagactccaggccagcggccccgggcttgtgaagccttccgaaaccctgtctttggtctgctcagttagtggagtgagcatctccgactcttactggaactggattaggcaaccagctggtaaaggcttagagtggatagggcgggtatatacacgcggaactcacacgtacaatccgtcgctgggcggtcgagcaaccgtgtcaggggatacaaacaagaatgaagtcagcctaaaactcatgagtgtgactgccgcggacaccgctgtttattactgtgcccgtgcactgtccggagattggacaagaaggtatttctacatggacgtgtggggccggggcacccccgtcactgtgtctagc

SEQ ID NO: 24294 - RNA, 381 nt, synthetic construct
  misc_feature 1..381: note = derived and/or modified sequence opt3 from anti-HIV_CD4bs_HeavyChain
  source 1..381: mol_type = other RNA
cagctgcaactccaggagagcggccccagacttgtgaagccttccgaaaccctgtctttgacatgcactgtctcagggggaagtatcagctccggtgactactattggacgtggattaggcagccaccgggcgaggggttagaatacataggatatatctactctggcggttcgaccgattataacccctcactgaaaagccgggccagtatttcccaggacacatctactaatgagttcagcctaaagctcacctccgttacagctgcagataccgccgtgtacttttgtgcgcgcgaccgacgtgtactgctttggttcggggaacctagaaggggactggatttttggggcccaggcactttggtgacagtctcaagt

SEQ ID NO: 24295 - RNA, 396 nt, synthetic construct
  misc_feature 1..396: note = derived and/or modified sequence opt3 from anti-HIV_CD4bs_HeavyChain
  source 1..396: mol_type = other RNA
gaggtgcagctggtcgaaagcggcgggggactcgttaagcccggtggctcccttagactgtcttgcgccgcttcagggttcacctttagtagcgcatggatgtcctgggtgaggcaagcccctggaaaaggcttggagtgggtaggtcggatcaagtctaaatcggacggggaaacaactgattacgcggctccagtgaagggacgcttcacgatttcacgagacaacttagagagcaccctgtatctacagctcaatagtctgaaaacagaagatactgccgtctactattgtgcaaccgccacaccgtcctactatgacataatgaccggcaactacaagtattactactatatggatgtgtggggcaaggggactacagttaccgtgtctagc

SEQ ID NO: 24296 - RNA, 363 nt, synthetic construct
  misc_feature 1..363: note = derived and/or modified sequence opt3 from anti-HIV_CD4bs_HeavyChain
  source 1..363: mol_type = other RNA
caggtgcaactggtcgagagcggcgggggactcgttaagcccggtggctcccttagactgtcttgcgccgcttcagggttcatctttagggaccactacatgacctggattcggcaggcacctggaaaaggcttggaatgggtgagttatataagctcctcttcgaacaatatccagtacgccgattcagtaaagggtcgcttcacagtgagccgagacaacgcgaaaaatagtttatatctgcagatgaactccctacgtgctgatgacactgccgtctactattgtgcaagatctgggccattttacaattatggaccgcccaacaattggggccaaggcacgctcgtgaccgttagctcc

SEQ ID NO: 24297 - RNA, 378 nt, synthetic construct
  misc_feature 1..378: note = derived and/or modified sequence opt3 from anti-HIV_CD4bs_HeavyChain
  source 1..378: mol_type = other RNA
caggtgcaactggtcgagagcggcgggggagttgtgcagcccggtggctccctcaccctttcttgcacagcctcagggttcccttttaacagttacgctatgcactgggtaagacaggcaccaggaaagggcctggaatgggtgagcatgacttcccatgacggtgggaataaagatttcgtcgactctgtgaagggaaggtttacgatctcgcgggataactcacgcaataccttgttcttacagatgaacagcctgagtcaagacgatacaggcgtttattactgtgtgcgaggcaaactagaggactataatttttgggggcactaccgtgatttcgactcctggggacagggtactctcgtcaccgtgtctgcc

SEQ ID NO: 24298 - RNA, 405 nt, synthetic construct
  misc_feature 1..405: note = derived and/or modified sequence opt3 from anti-HIV_CD4bs_HeavyChain
  source 1..405: mol_type = other RNA
gagccccacgtggtcgaaagcggcgggggaatggccaagcctggtggctccctgagactctcttgcgctgggtcaggattcacctttacaaacgcatggatgaattgggttaggcaggccccaggcaaaggtcttgagtgggtggggctgatcaagagtaaaagcgacggaggcactacggattacgcggctgacgtagaaggccggttcaccatttcccgcgatgacttggagtctacaatgtttttagaaatgcattcgctgcaaatagaggatactgccgtgtatttctgtaccacacagtacccgcgatattacgacctaatgaccgggaactataagcgtagatacttttcaagcggaatggatgtctggggtcagggcactgcagtgacagttagttcc

SEQ ID NO: 24299 - RNA, 384 nt, synthetic construct
  misc_feature 1..384: note = derived and/or modified sequence opt3 from anti-HIV_CD4bs_HeavyChain
  source 1..384: mol_type = other RNA
caggtgcaactgcaggagagcggccccgggctcgtcaagccttcccagaccctttctctgacatgcactgtttcaggagacagtgtgagctccggtaactactattggtcttggatcagacagccagccggcaaaccgttggaatggattgggcacatatcgacgggaggcggtaccaagaataacccctcattacaaagcagggtaacaatcagtctggattcctctaaaaatcaggtgagcctatccctctcaagtgtcactgctgcagacaccgccgtgtacacatgtgcgcgggggcctccacgcagcctgtggttcggagatcccacctattcttacatggacgtttggggcaagggcactacagtgaccgtctcctca

SEQ ID NO: 24300 - RNA, 372 nt, synthetic construct
  misc_feature 1..372: note = derived and/or modified sequence opt3 from anti-HIV_CD4bs_HeavyChain
  source 1..372: mol_type = other RNA
caggtgcaactggtccagagcggcgccgaggttaagaaacccgggtcctctgtgaaggtatcatgcaaagctagtggaggtaccttcaacagccacgcatttacatgggtgagacaggcccctggccaggggctcgaatggatgggaggcatcattccaactcttggtctggcgaatgacgctcaaaagttccaggggaggtttacgataaccgccgatgagtccacaactaccgtctacatggaattgtcttcgttacggtcagaggacacagcagtgtattactgtgcccgccgaccgtattacgatcaggttagcggagtgggcgctttcgacatctggggccaggggacccgtgtcactgtgagttcc

SEQ ID NO: 24301 - RNA, 390 nt, synthetic construct
  misc_feature 1..390: note = derived and/or modified sequence opt3 from anti-HIV_V2_HeavyChain
  source 1..390: mol_type = other RNA
caggtgcaactggtccagagcggcgccgaggttaagaaacccgggtcctctgtgaaggtatcatgcgaagctagtggagtgaccagctcctcttacacaatctcgtgggtcagactcgcacctggtcagggccttgagtggatggggaggattactccaatattcgacatcacgaactatgcccagaaatttcaaggacgggtgaccctgacagcggataagtcaactggcaccacatacatggaattgagcagtttacgctccgacgataccgctgtttattactgtgcccgagacaaatctgatgtggtcgtggtaactagcattcgtccggcatattactatggtatggacgtttgggggcagggaacaaccgtgacggtctcctca

SEQ ID NO: 24302 - RNA, 366 nt, synthetic construct
  misc_feature 1..366: note = derived and/or modified sequence opt3 from anti-HIV_V2_HeavyChain
  source 1..366: mol_type = other RNA
caggtgcaactggtccagagcggcgccgaggttaagaaacccgggtcctctgtgaaggtatcatgcaaagctagtggaggtaccttcagaagctacgcaatctcctgggtgaggcaggcccctggccaggggctcgaatggatgggaggcattataccaatctttggtacagcggactatgctcaaaagttccaggggaaagtcactattacggccgatgagtctacctcgacagcatacatggaactttcaagcctgaccagtgaggacactgccatgtattactgtgctcggtcccgcgatcactttttcgacacacgagtgtttcagggatggggccagggcaccttggttactgtgtctagc

SEQ ID NO: 24303 - RNA, 363 nt, synthetic construct
  misc_feature 1..363: note = derived and/or modified sequence opt3 from anti-HIV_V2_HeavyChain
  source 1..363: mol_type = other RNA
caggtgcaactggtccagagcggcgccgaggttaagaaacccgggtcctctgtgaaggtatcatgcaaagctagtggaggtaacttcaatacctacacaatcagctgggtgagacaggcacctggccaggggctcgaatggatgggaaggattataccaatctttggcattgtcaacccggcccaaaagttccccggtcgggtgactatcaatgttgacaaatccacgaacaccgcgtatatggagctttcttcgctgcgctcagaagatacagctgtgtactattgtgccactagcggggtcggattgcactttggctacttcgactattggggccaggggacccaggtgacagtaagttcc

SEQ ID NO: 24304 - RNA, 378 nt, synthetic construct
  misc_feature 1..378: note = derived and/or modified sequence opt3 from anti-HIV_V2_HeavyChain
  source 1..378: mol_type = other RNA
caggtgcaactgcagcagtggggccccgggctccttaagcctagcgagaccctgtccttgacatgcgccgtctacggaggttctttcggcagatattactggtcatggatcaggcagagtagcggggaaggattagagtggctgggccaaattgaccacactggttccacgacctataacccatctctaaaagggcgggttacaatatcgatcgattcaagcactaatcagtttagtctcaaggtgacctccgtaattgctgcagacacagccgtgtactattgtgcgcgcgctccgtctggataccccggcgtcagcctgtatcagtactacggccttgatgtgtgggggcagggaaccactgttacagtgtcccct

SEQ ID NO: 24305 - RNA, 366 nt, synthetic construct
  misc_feature 1..366: note = derived and/or modified sequence opt3 from anti-HIV_V2_HeavyChain
  source 1..366: mol_type = other RNA
caggtgcaactggtccagagcggcgccgaggttaagaaacccgggtcctctgtgaaggtatcatgcaaagctagtggaggtaccttcagcaactacgcaatctcctgggtgagacaggcccctggccaggggctcgaatggatgggaggcattataccaatctttggtacaactgactatgcgcaaaagttccaggggagggtcacgattaccgctgatgcctctacatcgactgcatacatggagctttcaagcctgcggagtgacgataccgccgtgtattactgtgctcgctcccgaggacactattttgacacacgtgttttcgaaggctggggccaggggaccttggtgactgtctctagc

SEQ ID NO: 24306 - RNA, 372 nt, synthetic construct
  misc_feature 1..372: note = derived and/or modified sequence opt3 from anti-HIV_V2_HeavyChain
  source 1..372: mol_type = other RNA
caggtgcacctggtccaaagcggcaccgaggttaagaaacccggggcctccgtgacagtatcttgcaaggcttcaggatacagtttcactggttattacctccattgggtgagacaggcacctggccaggggcttgaatggatgggatggatcaacccaaatagcggcggtacgtattacgcccagaactttcaagcgagggtcaccatgacacgggacacttccatttctaccgtgtatatggatctgtcgcgcttgcgatcagacgatacagctgtttactattgtgtgcgtagagccgtcttaaccgcactgccgcccaggtactacttcgacttttgggggcagggaactctagtgacagtaagcagt

SEQ ID NO: 24307 - RNA, 318 nt, synthetic construct
  misc_feature 1..318: note = derived and/or modified sequence opt3 from anti-HIV_V3_LightChain
  source 1..318: mol_type = other RNA
agcctggagctcacccagcccccttccgtgtctgtctcaccaggccaaacagttagtatcacttgcagcgggaaccttctgggagacaaggatgcctcctggtaccagttgaaaccgggtcagtctcccattttagtgatatatctggacacggaaagaccttcgggcatcccagagaggttctcagggagcaagagtggaaataccgctacactaactatttccggcacccaggcaatggatgaagccgagtacttttgtcaagcgtgggacacaaccactgtactcttcggtgggggaacacggctgaccgtgctt

SEQ ID NO: 24308 - RNA, 324 nt, synthetic construct
  misc_feature 1..324: note = derived and/or modified sequence opt3 from anti-HIV_V3_LightChain
  source 1..324: mol_type = other RNA
agcgacgagctgacccagcccccttccgtgtctgtctcaccaggccaaacagccagaatcacttgcagtggggatgctctcccggaaaagtacgcatattggtaccagcagaaaagcggacaggcccccgttcttgtgattgacgaggataacaagaggcctttcggtacgccagaacggttttccggctctcgctcggggaccatggcgacactgactataaccggagctcaaatggaggacgaagccgattattactgttcaagcacagacagtcgaggcacctattgggtattcggtgggggaactaaattgacagtgtta

SEQ ID NO: 24309 - RNA, 336 nt, synthetic construct
  misc_feature 1..336: note = derived and/or modified sequence opt3 from anti-HIV_V3_LightChain
  source 1..336: mol_type = other RNA
cagagcgtgctgacccaacccccttccgtctctgccgctccaggccagaaggttacaatctcatgcagtgcagggaacagcaaaattggagacaattacatatcctggtatcagcacgtgccgggtgccgcgcccaagctccttatctacgagaacgataaaagaccttctggcattccagacaggttctcggggtcaaagagcggaacgagtgcttccctgggcatcactggtttgcagaccggggatgaagccgactattactgtgcagcctgggataattctttaagctccgctctgtatgtatttggaacaggcactaaagtgaccgtccta

SEQ ID NO: 24310 - RNA, 339 nt, synthetic construct
  misc_feature 1..339: note = derived and/or modified sequence opt3 from anti-HIV_V3_LightChain
  source 1..339: mol_type = other RNA
gacatcgtgatgacccagagccccgattccctggccgtctctctcggcgagagagctacaattaactgcaagtcaagtcaaaatgttttctacagctccaacaataggaactatcttgcatggtaccagcagcggcctgggcagccaccgaaactgttgttttattgggcctctactcgcgaatcgggagtgcccgaccgattctcaggtagcggcagtgggacggattttaccttaacaatatcctctctgcaaactgaggacgtagcgatctactattgtcagcagtactataatacccctccaacattcggacccggcaccaaggtggaaattaaa

SEQ ID NO: 24311 - RNA, 318 nt, synthetic construct
  misc_feature 1..318: note = derived and/or modified sequence opt3 from anti-HIV_V3_LightChain
  source 1..318: mol_type = other RNA
agctacgagctgacccaacccccttccgtgtctgtctcaccaggccaaacagccactatcacgtgcagtggggacctccttggagataagtatgctagctggtacagacagaaaccgggtcagtcccccgttctggtgatttatgaagacaccaagaggccttctggcttgccagagcggttctcggggtcaaacagcggaaatacagcaactttaaccataagtgaaacacaggccatggatgaggcggactactattgtcaggcttgggatacccgcactgtagtgtttggcggtgggacaaaactgaccgtccta

SEQ ID NO: 24312 - RNA, 327 nt, synthetic construct
  misc_feature 1..327: note = derived and/or modified sequence opt3 from anti-HIV_V3_LightChain
  source 1..327: mol_type = other RNA
cagagcgtgctgacccaacccccttccgtctctgccgctccaggccagaaggttacaatctcatgcagtgggagaagctccgacattgagaacaaattcgtgtcttggtaccagcagctcccgggaactgcacccaaacttctgatatatgaagataataagaggccttcgggtatcccagaccggttttcaggcagcaagagtgggacgtccgccaccttgggaattacaggcttacaaactggtgatgaggcggactactattgtgggacctgggataacaatctgcgcgctggattcggcggcgggacacacctaaccgtactc

SEQ ID NO: 24313 - RNA, 324 nt, synthetic construct
  misc_feature 1..324: note = derived and/or modified sequence opt3 from anti-HIV_V3_LightChain
  source 1..324: mol_type = other RNA
agctacgagctgacccagcccccttccgtgtctgtctcaccaggccaaacagccagaatcacttgcagtggggacgctctcccgaacaagtatgcattctggtaccagcagaaaagcggacaggcccccgttcttgtgatttttgatgacaataggcggcctgcgggtataccagaacgcttctccggctctcgatcggggacgctggctaccttgacaatctcaggagcccaagtagaggatgaagcagactattactgttatagcactgataacgacggcaagtactttgtgttcggtagtgggaccatggtcacagtgtta

SEQ ID NO: 24314 - RNA, 318 nt, synthetic construct
  misc_feature 1..318: note = derived and/or modified sequence opt3 from anti-HIV_V3_LightChain
  source 1..318: mol_type = other RNA
agctacgagctgacccagcccccttccgtgtctgtctcaccaggccaaacagccagtatcacttgcagcgggcacaagctcggagacaaatatgcttcctggtaccagcataagccgggtcagtctcccgttcttgtgatttatgaagatacgcagagaccttcgggcataccagagaggatctcagggagcaaaagtggaaacaccgcaacactgactatttccggcacccaagccatggacgaagcggattactattgtcaggcttgggactctcgggccgcagtattcggtgggggaacacgcttgaccgtgtta

SEQ ID NO: 24315 - RNA, 327 nt, synthetic construct
  misc_feature 1..327: note = derived and/or modified sequence opt3 from anti-HIV_V3_LightChain
  source 1..327: mol_type = other RNA
cagagcgccctgacccaacccgcttccgtgtctggctcacctgggcagagtatcacaattagctgcactggaatatcctctgacatcggtacggataactacgtctcgtggtatcagcagcacccaggcaaggcaccgaaactcattatctacgaggtttcaaatagacccagcgggattagtcataggttctccggatctaagagcggcaacaccgcctcccttatcatatcaggtctgcaagtggaagacgaggcgcactattactgtaatagttatcggagcgatacattggtatttgggggaggcactaaagtgaccgtctta

SEQ ID NO: 24316 - RNA, 333 nt, synthetic construct
  misc_feature 1..333: note = derived and/or modified sequence opt3 from anti-HIV_V3_LightChain
  source 1..333: mol_type = other RNA
cagagcgtgctgacccaacccccttccgcctctggcacaccagggcagagagtcactatctcatgcagtggaagctcctctaacattggttcgaatacggttaactggtaccagcacctcccgggcaccgctcccaaacttctgatatattcaaatgaccagaggcctagcggggtgccagatcggttcagtggatcctctagcggcacatccgcatcattggccatcagtggtttacaaagcgaggacgaagcggattactattgtgctgcctgggacgattctctgaacgggccctttgtattcggaactggcaccaaggtgacagtccta

SEQ ID NO: 24317 - RNA, 318 nt, synthetic construct
  misc_feature 1..318: note = derived and/or modified sequence opt3 from anti-HIV_V3_LightChain
  source 1..318: mol_type = other RNA
gacatccagatgacccaaagcccctcctctctgtcagccagtgtgggcgatagaattacaataacttgcaggacgagccagtccatcgacaaccacctcaattggtaccagcataagcctgggaaagctccaaaacttctgatttctgcagcctcgcggttgcagtcaggagtcccgagccgcttcaccggtagtggctccgggacagagtttactttaaccatctctagcctgcaacccgaagatttcgcggtttattactgtcagcagtcctatattacaatcacctttggacctggcactaaggtggacataaag

SEQ ID NO: 24318 - RNA, 321 nt, synthetic construct
  misc_feature 1..321: note = derived and/or modified sequence opt3 from anti-HIV_V3_LightChain
  source 1..321: mol_type = other RNA
gagatcgtgatgacccagagccccgccacactgtccgtctctcctggcgaaggggttactctctcatgcagagctagtcaaagcgtgtcctctaacattctttggtaccagcagaggccaggacaggcaccgcggctgttgttatatggtgcctcgacgcgcgcgaccggcatacccgctcgattctcagggagcggaagtggcacagagtttactctgaccatcaattccatgcaatctgaagacttcgccatttactattgtcagcagtaccacgattggctatggacactcggtcaggggacccaagtagagatcaag

SEQ ID NO: 24319 - RNA, 327 nt, synthetic construct
  misc_feature 1..327: note = derived and/or modified sequence opt3 from anti-HIV_V3_LightChain
  source 1..327: mol_type = other RNA
agctacgagctgacccagcccccttccgtgtctgtctcaccaggccaaacagccagtatcacttgcagcggggacaagatgggagaaagatatacgtcctggtaccagcagaaaccgggtcagtctcccgttctcgtgatgtcggagaacattaagaggcctgctggcataccagaacggttctcagggagcagttccggaaataccgcaatccttacaatttctggcactcaagccgtagatgaggcggactattactgtcaggtgtgggataccacaaccactagctatgtcatctttggtgggggaacaaaactgaccgtgttg

SEQ ID NO: 24320 - RNA, 321 nt, synthetic construct
  misc_feature 1..321: note = derived and/or modified sequence opt3 from anti-HIV_V3_LightChain
  source 1..321: mol_type = other RNA
gacatccagatgacccaaagcccctcctctctgtcagccagtgtgggcgatagagtcacaattacttgccaggctagccaggacatagggaactacctcaattggtatcaccagaagcctggaaaagcaccaaaacttctgatctacgatgcctccaacgttgagacgggtgtggcgtctaggttctcgggctcagggagcggaaccgactttacattgactattagttccttacaaccggaagatatcggcacctatttctgtcagcagtacgagtctctgccctgggcttttggtgggggaacaaaggtagaaattcgg

SEQ ID NO: 24321 - RNA, 333 nt, synthetic construct
  misc_feature 1..333: note = derived and/or modified sequence opt3 from anti-HIV_V3_LightChain
  source 1..333: mol_type = other RNA
aacttcaagctgacccagccccacagcgtgtccgagtctcctggcaaaacagtcactatctcatgcacgagaaccagtgggacaattgccactaattacgttcaatggtttcagcagaggccaggaagctccccgaccacaatgatatatgaaaacgacaagcggccctctggtgtgcctgatcgcttctcgggctcaatcgacaccagcagtaattccgcttctctcactattagcgggcttaaaacagaggatgaagcagactactattgtcagtcctacaactcaaccgatatcgtagtgtttggaggcggtacgaagctgactgtcttg

SEQ ID NO: 24322 - RNA, 327 nt, synthetic construct
  misc_feature 1..327: note = derived and/or modified sequence opt3 from anti-HIV_V3_LightChain
  source 1..327: mol_type = other RNA
cagagcgtgctgacccaacccccttccgtctctgccgctccaggccagaaggttacaatctcatgcagtgggagctcctctaacattggaaataacatggtgtcgtggtaccagcagcacccgggtactgcacccaaactccttatatatgaaaattcaaagagacctagcggcatcccagacaggttcagtgggtcccggtctggaacgagcgccaccctgggcattatcggtttgcaaacaggggatgaggcggagtactattgtgctacttgggacggatccttacgcaccgtatttggcggcgggacaaaactgaccgtgcta

SEQ ID NO: 24323 - RNA, 324 nt, synthetic construct
  misc_feature 1..324: note = derived and/or modified sequence opt3 from anti-HIV_V3_LightChain
  source 1..324: mol_type = other RNA
agctacgagctgacccagcccccttccgtgtctgtctcaccaggccaaacagccagaatcacttgcagtggggacgctctcccgaaccagtatggatactggtatcagcagaagcccggtcaagcacctgttcttgtgattttcaaagatagcgaaaggccatccggcatacccgagcggttttctgggtcgtcaagcggaacgaccgtaacactgactatcagtggcgtgcaggccgaagacgaggcggattactattgtcagtccgctgactctagcggtaattacgaagtcttcgggggaggcaccaagttgacagtgtta

SEQ ID NO: 24324 - RNA, 330 nt, synthetic construct
  misc_feature 1..330: note = derived and/or modified sequence opt3 from anti-HIV_V3_LightChain
  source 1..330: mol_type = other RNA
cagagcgtgctgacccaacccccttccgtctctgaggccccaagacagagggttacaatctcatgcagtggcagctcctctaacattgggaataacgctgtgaattggtaccagcaggtaccgggaaaggcacccaaactccttatatattacgacgatctgttgccttcgggtgtgtcagaccggttcagcggcagtaagtccgggtctagcgcctccttagcgatctcaggactgcaaagtgaagatgaggctgactattactgtgccgcatgggatgacagcctaaaagtctatgtgtttggcactggtacgtctgttaccgtgctc

SEQ ID NO: 24325 - RNA, 333 nt, synthetic construct
  misc_feature 1..333: note = derived and/or modified sequence opt3 from anti-HIV_V3_LightChain
  source 1..333: mol_type = other RNA
gacatcgtgatgaaccagagccctccctccctggccgtcaccccaggcgagccggcttctatttcatgcagagcaagtcaaagcctcctttactccgatgggcacaattatctggactggtacttgcagaagcccggacaggcccctcagttactgatatatctaggttctacaagggcgtcgggcgttccagatcggttctcagggagcggaagtggcactgactttacgctcaaaatctcccgcgtggaagctgaggatgtaggtgtgtactattgtatgcaacccctgcagtcttacaccttcgggcagggaacaaaacttgaaattaag

SEQ ID NO: 24326 - RNA, 321 nt, synthetic construct
  misc_feature 1..321: note = derived and/or modified sequence opt3 from anti-HIV_V3_LightChain
  source 1..321: mol_type = other RNA
gcctacgagctgacccagccccctagcgtgtccgtctctccaggccaaacagctagaatcacttgctcaggggacgcactcccgaaccagtatgcctactggtatcaccagaggcccggacaggcgcctgttcttgtgattcataaggatacggaacggccaagtggtatacccgctcgcttcagcggctcctcttcggggaccacagtaactctgaccatctcagaggtgcaagccgaagacgagggagattactattgtcagagcgcagacacaagtgcctacgtcgtgtttggcggtgggaccaaattgactgtttta

SEQ ID NO: 24327 - RNA, 330 nt, synthetic construct
  misc_feature 1..330: note = derived and/or modified sequence opt3 from anti-HIV_V3_LightChain
  source 1..330: mol_type = other RNA
cagagcgtgctgacccaagccccctcctcttcaggcacacctgggcagagtgtcactatcagctgctccggatcttcgtcaaacatggagattaattacgtttattggtacagacagttcccaggtacggctccgcagctccttatatataacgacaatcaaaggcccagcggcgtgcctgatcggtttagtgcatccaagtctgggaccagcgcctccctggcgatcggaggcttgcgctcagaagacgaggctgattacttctgtgccgtatggcacggtgaccgagggggaccagtgtttggcggcgggacaaaattaactgtcctg

SEQ ID NO: 24328 - RNA, 327 nt, synthetic construct
  misc_feature 1..327: note = derived and/or modified sequence opt3 from anti-HIV_V3_LightChain
  source 1..327: mol_type = other RNA
agctacgagctgaagcagcccagatccgtgtctgtctcacctggccaaaccgccaggatcacatgcagtggggacgctatgccaaaccagtatgcatactggtatcagcagcggccgggacgcgcccccgttctccttattttcaaagataatgaacgagcgagcggtatacctgagcgtatctccgggtcttcgtcaggcactacggctaccctgacaattaacagagtgcaagccgaagacgaggcagattacttgtgtcagagcgccgacagttccggagcttttccatgggtattcggcggtgggactaccttaacagtgctg

SEQ ID NO: 24329 - RNA, 324 nt, synthetic construct
  misc_feature 1..324: note = derived and/or modified sequence opt3 from anti-HIV_V3_LightChain
  source 1..324: mol_type = other RNA
agctacgagctgacccagcccccttccgtgtctgtctcaccaggccaaacagccagaatcacttgcagtggggacgctctcccgaaggaatatgcatactggtatcagcagaaaagcggacaggcccccgttcttgtgatttacgaggatacgaggcggccttccggtataccagaacgcttctctggctcgtcaagcgggaccatggcgacactgactgtaagtggagctcacgtggacgatgaggccgactattactgttattcccgagatacctctgcaaaccaatgggtctttggcggtgggacaaagttgaccgtgtta

SEQ ID NO: 24330 - RNA, 318 nt, synthetic construct
  misc_feature 1..318: note = derived and/or modified sequence opt3 from anti-HIV_V3_LightChain
  source 1..318: mol_type = other RNA
gagatcgtgctgacccagagccccgccacactctccctttctcctggcgaaagagctactctgtcatgcagggcaagtcaaagcatttccacgtacttggggtggtatcagcagaagccaggacaggccccgcggttactgatatacgacgcgtctaaccgcgctaccggtatccccgcccgattctcgggctcagggagcggaacagattttactctaaccattagttccctcgagcctgaagacttcgcagtctattactgtcaacagcgttatacatggatcacctttggccagggtactagactggagattaaa

SEQ ID NO: 24331 - RNA, 327 nt, synthetic construct
  misc_feature 1..327: note = derived and/or modified sequence opt3 from anti-HIV_V3_LightChain
  source 1..327: mol_type = other RNA
agctacgagctgacccagcccccttccgtgtctgtctcaccaggccaaacagccagaatcacttgcagtggggacgctctcccgaaccagtatgtttactggtatcagcagaggcccggacaagcacctgtggtagtgctttacaaggatacggaacggccaagcggtattcccgagcgcttctccgggtcttcgtcaggcaccacagtcactctgaccataagcggagtgcaggccgaagacgaggcggattattactgtcagagtgctgacaattccggcgcctatcctttgtttttcggtgggggaacaaaattaaccgttctg

SEQ ID NO: 24332 - RNA, 333 nt, synthetic construct
  misc_feature 1..333: note = derived and/or modified sequence opt3 from anti-HIV_V3_LightChain
  source 1..333: mol_type = other RNA
cagagcgtgctgacccaacccccttccgtctctgccgctccaggccagaaggttacaatctcatgcagtgggagctcctctaacattggaaataactacgtgctctggtatcagcagttcccgggtactgcacccaaacttctgatatacggcaataacaagagaccttcggggatcccagacaggttttcaggaagcaaaagtggcacgtccgccaccttgggtattacagggttacaaactggagatgaggcggactatttctgtgctacctgggattctggcctgagcgccgactgggtatttggcgggggaacaaagctaaccgtgctc

SEQ ID NO: 24333 - RNA, 321 nt, synthetic construct
  misc_feature 1..321: note = derived and/or modified sequence opt3 from anti-HIV_V3_LightChain
  source 1..321: mol_type = other RNA
gacatccagatgacccaaagcccctcctctctgtcagccagtgtgggcgatagagtcacaattacttgcagggctagccaggagatagacaactacctcgcatggtatcagcagcggcctgggaaggccccaaaatcccttatctacgcggcttcttcgctgcaaggaggtgttccgcccaagttctcaggcagcgggagtggaacggaatttaccttgacaatttcctctttacaggccgaggatttcgcaacttattactgtcagcagtataatgcctaccctctgacctttggccaaggtacacgcctagacatcaac

SEQ ID NO: 24334 - RNA, 324 nt, synthetic construct
  misc_feature 1..324: note = derived and/or modified sequence opt3 from anti-HIV_V3_LightChain
  source 1..324: mol_type = other RNA
agctacgagctgacccagcccccttccctctctgtgtcaccaggccaaacagccagtatcacttgcagcggggacggacttccgaagcagtatggttactggtatcagcagaaacccggccaagctcctctgttggtcattttaaaggatacggaaagaccatccgggatacccgagaggttctctggatcgtcaagcggcaccacagttactctgaccatcagtggtgtgcaggcagaagacgaggccgattactattgtcagtccgtagactctacagggagctactatgtgtttggacctggcaccaaagtcactgtgcta

SEQ ID NO: 24335 - RNA, 324 nt, synthetic construct
  misc_feature 1..324: note = derived and/or modified sequence opt3 from anti-HIV_V3_LightChain
  source 1..324: mol_type = other RNA
agctacgagctgacccagcccccttccgtgtctgtctcaccaggccagacagcgagaatcacttgcagtggggacgttctcccgaagaaatatgcttactggtatcagcaaaagagcggacttgcacccgtgctggtaatttacgaagataacaggcggccttccggtataccagagcgcttctctggctcgtcaagcgggacgatggccaccttgacaatcagtggagcccaggtggaagacgagggcgattattactgttcctctactgacagctccggtgatcactatgtctttgggaccggaacaaaagtgaccgtttta

SEQ ID NO: 24336 - RNA, 321 nt, synthetic construct
  misc_feature 1..321: note = derived and/or modified sequence opt3 from anti-HIV_V3_LightChain
  source 1..321: mol_type = other RNA
gcctacgagctgacccagccccctagcgtgtccgtctctccaggccaaacagctagaatcacttgctcagcagaagccctcagtaaccagtatgcgtactggtataggcagcggccggggcaggctccccttctgattatatacaaggacacgaaacgccctagcggaatcccagagcgattctccggttctacctcgggcacaactgttaccttgacaatttcaggggtgcaagccgaagatgaggcagactattactgtcagagcgccgatagttccggagactatgtatttggcggtgggaccaaggtgactgtctta

SEQ ID NO: 24337 - RNA, 333 nt, synthetic construct
  misc_feature 1..333: note = derived and/or modified sequence opt3 from anti-HIV_CD4bs_LightChain
  source 1..333: mol_type = other RNA
cagcccgtgctgacccaaagctcctctgcctcagctagtctcggcagctccgtcaaacttacatgcactctggggtctggacactcgggttcaatcattgcatggcatcagcagcagcctggcaaggccccaagatacttgatgaaggttcaaagcagtgggtcctataacaaaggatctggcgtgccggacaggttcagcggttcctcaagtggggcggatcggtacttaacgataagcaatctgcagtttgaggacgaaggagattattactgtgagacctgggacacaaacaagtatgtattcggcactggcaccaaagtgacagtccta

SEQ ID NO: 24338 - RNA, 324 nt, synthetic construct
  misc_feature 1..324: note = derived and/or modified sequence opt3 from anti-HIV_CD4bs_LightChain
  source 1..324: mol_type = other RNA
gagctggtgctcacccagagccccggcacactttccctgtctcctggggaaagagccactttgtcatgcagggctagtcaaagcgtcgcatcctactatttagcctggtaccagcagaagccaggacaggcgccgcggctgctaatctatggtgcttcttcgcgcgccacgggcattcccgaccgattctcagggagcgttagtggaaccgattttacactcactatatcccgtctggagcctgaagacttcgcactttactattgtcaacagtacggctctagcccactgtcctttggtgggggaaccaaagtggagatcaga

SEQ ID NO: 24339 - RNA, 333 nt, synthetic construct
  misc_feature 1..333: note = derived and/or modified sequence opt3 from anti-HIV_CD4bs_LightChain
  source 1..333: mol_type = other RNA
cagagcgccctgacccaacccccttccatgtctggctcaccagggcagagtatcacaattagctgcactggatccggttctgacgtgggctcgcacaacttcgtctcatggtaccagcagcatccggctagagttcccaagctccttatatatgcagtggggaataggcctagcggagtaagtgagcggttttccggctctaaaagcggtaacacggcctacctgaccatctccgggttgcaagcggatgacgaagctgattattactgttcaagtcacacaactggaaccacattagaggtgttcggcggcgggacccgcctgactgtccta

SEQ ID NO: 24340 - RNA, 333 nt, synthetic construct
  misc_feature 1..333: note = derived and/or modified sequence opt3 from anti-HIV_CD4bs_LightChain
  source 1..333: mol_type = other RNA
gacatcgtgatgacccagagccccctgtccctccctgtcacaccaggcgagccggcctctatttcatgcagaagtagcgaatcccttctgcactctaacgggttcatatacttggattggtatttacaaaagcccggacagtcgcctcagctgctaatctacctcggttcaaaaagggctagcggcgttagtgaccggttttccgggtctggaagcggcactgcattcacgctgaagatttcccgcgtggaggccgaagatgtaggtgtgtattactgtatgcaggcgcttgagtcacgaacctttgggcaaggaacaaaactggaaatcaag

SEQ ID NO: 24341 - RNA, 327 nt, synthetic construct
  misc_feature 1..327: note = derived and/or modified sequence opt3 from anti-HIV_CD4bs_LightChain
  source 1..327: mol_type = other RNA
gagatcgtgctgacccagagccccggcacactctccctttctcctggggaaagagccactctgtcatgcagggctagtcaaagcgtctcctcttcgtacttggcatggtatcagcagaagccaggacagtcaccgcggttactgatttacggtgccagcagtcgcgcgacgggcatacccgaccgattctccgggtctggaagcggcaccgattttacactaactatctcccgtctcgagcctgaagacttcgctgtttattactgtcaacactatggttcaagtagcatttttaccttcgggccaggaacaaaagtggatatcaga

SEQ ID NO: 24342 - RNA, 330 nt, synthetic construct
  misc_feature 1..330: note = derived and/or modified sequence opt3 from anti-HIV_CD4bs_LightChain
  source 1..330: mol_type = other RNA
aacttcatgctgacccagccccacagcgtgtccggctctcctgggaagacagtcactatctcatgcacgagaagtagcggatccattgccggtaattacgttcaatggtatcagcagaggccaggcacctctccgacaactgtgatatacgagaacgaccagcggtcgtcaggggtacccgatcgctttagcggaagtatcgactcctctagcaattccgcttcactcaccattagtggccttaaaacagaagatgaggcagactattactgtcatagctatgatgccaccaaccaagtgttcggtgggggaactaagctgacagtcttg

SEQ ID NO: 24343 - RNA, 333 nt, synthetic construct
  misc_feature 1..333: note = derived and/or modified sequence opt3 from anti-HIV_CD4bs_LightChain
  source 1..333: mol_type = other RNA
gacgtggtcgttacccagagccccctgtccctccctgtgacacttggccaaccagcctctatctcatgcagaagtagccagtccctggtatactctgatgggactacgcacttgaactggtatcatcagaggccgggacagccccctcggcgcttaatttaccgagtgtcgaatcgtgactcaggtgtcccagatagattcagcggcagtgggtccggaaccgactttacactgaggatatctcgggtggaggctgaagatgttggcctatattactgtatgctcgcaactcaccccttcacctttggtcctgggacaaaggtggagatcaaa

SEQ ID NO: 24344 - RNA, 336 nt, synthetic construct
  misc_feature 1..336: note = derived and/or modified sequence opt3 from anti-HIV_CD4bs_LightChain
  source 1..336: mol_type = other RNA
cagagcgtgctgacccaacccccttccgtctctggcgccccagggcagacagttactatctcatgcacgggaagtagctccaacattggtccgtcttacgacgtgcagtggtatcagcaattccccggcagagctcctaagctccttatatcggggaataacaatagggcatcaggagtaccagatcggtttagcggcagtaaatccggtacctctgccagcctggcgatcacagggttgcagtccgaggacgaagctgattactattgtcagacttacgactcaagtttaagcggacacgtggtcttcggcggcgggacccgcctgacagtgcta

SEQ ID NO: 24345 - RNA, 321 nt, synthetic construct
  misc_feature 1..321: note = derived and/or modified sequence opt3 from anti-HIV_CD4bs_LightChain
  source 1..321: mol_type = other RNA
gacatccagatgacccaaagcccctccacactgtctgcctcagtgggcgatagagtcactattacgtgcagggctagtgcaagcatatacacctggctcgcctggtatcagcagcggcctgggaaggcgccagaggttcttatctacaaggcttccacactgaaatctggagtgccgtcgcgcttctcaggtagcggcagtgggactgaatttaccttgacaatttcctctttacagcccggagacttcgccacctattactgtcaacagtatactacataccctctgacctttggcggtgggacgactgtagagatcaaa

SEQ ID NO: 24346 - RNA, 330 nt, synthetic construct
  misc_feature 1..330: note = derived and/or modified sequence opt3 from anti-HIV_CD4bs_LightChain
  source 1..330: mol_type = other RNA
cagagcgccctgacccaacccgcttccgtgtctggctcacctgggcagagtatcacaattagctgcactggaacgtccaacgacataggtacctacaatctcgtctcttggtatcagcaccatccaaacaaggcaccgaaagttgtggtatacgagaataacaagagaccctcgggcatctcaaataggttcagcgggagtaaatccggaaacacagcctctcttactattagcggcctgcaggcggaagatgaggctgactattactgttgctcctatgccggttcaagtacctgggtgtttgggggaggcacaaagttgaccgtctta

SEQ ID NO: 24347 - RNA, 321 nt, synthetic construct
  misc_feature 1..321: note = derived and/or modified sequence opt3 from anti-HIV_V2_LightChain
  source 1..321: mol_type = other RNA
gacatccagatgacccaaagcccctccacactgtctgcctcagtgggcgatagagtcactattacgtgcagggctagtcagaccataagctcctggctcgcatggtaccagcagaagtctgggacagcccctaaacttctgatctataaggcgtcgtcaattgttagcggagtgccaagtcggttctccggttctggcagcgggactgagtttaccttgacaatcacctccttacaaccggacgatttcgctacttactattgtcagcagtacaactcaagtcccgaaacatttggacagggcaccaaagtagagattaag

SEQ ID NO: 24348 - RNA, 318 nt, synthetic construct
  misc_feature 1..318: note = derived and/or modified sequence opt3 from anti-HIV_V2_LightChain
  source 1..318: mol_type = other RNA
gagatcgtgctgacccagagccccggcacactctccctttctcctggggaaagagccactctgtcatgcagggctagtcaaagcgtctcctcttacttggcatggtatcagcagaagccaggacaggccccgcggttactgatttacgacgcgtcgtcacgcgctacgggtatacccgatcgattcagcggcagtgggtccggaaccgactttacactaactatctctcgtctcgagcctgaagatttcgccgtttattactgtcaacactatgcaggcagcagaacctttggtcaggggacaaaagtggagattaag

SEQ ID NO: 24349 - RNA, 333 nt, synthetic construct
  misc_feature 1..333: note = derived and/or modified sequence opt3 from anti-HIV_V2_LightChain
  source 1..333: mol_type = other RNA
cagagcgtgctgacccaacccccttccgtctctggcgccccagggcagagagttacaatctcatgcactggaagtagctccaacattggtgctcactacgacgtgcattggtatcagcagctcccgggcacggcacccaaacttctgatatacggaaattctaacaggccttcgggggtaccagatcggttctcaggcagcaagagtggtacctccgcctctttggcgatcacagggttacaagctgaggacgaagccgattattactgtcagagctatgactcctcactgagtggatacgtgtttggcactggcaccaaggtcacagtgcta

SEQ ID NO: 24350 - RNA, 324 nt, synthetic construct
  misc_feature 1..324: note = derived and/or modified sequence opt3 from anti-HIV_V2_LightChain
  source 1..324: mol_type = other RNA
gacaccgtgatgacacagagccccgccactctgtccgtctctcctggcgagagagttacgctctcatgcagggctagtcaaatcattaacaccaatcttgcatggtaccagaagcggccagggcaggccccgcgcctgttgatatatgcggctagcgcccgagcaacaggaatccccgcccgtttctccggttctggctcggggactgaatttaccttaacaatttcaggactgcagagcgaggatagtgctgtgtactattgtcaacagtacaaacactggcctccatataccttcggcagaggtactaagctagaaatcagg

SEQ ID NO: 24351 - RNA, 321 nt, synthetic construct
  misc_feature 1..321: note = derived and/or modified sequence opt3 from anti-HIV_V2_LightChain
  source 1..321: mol_type = other RNA
gagatcgtgctgacccagagccccggcacactctccctttctcctggggaaagagccactctgtcatgcagggctagtcaaagcgtctcctcttcgtacttggcatggtatcagcagaagccaggacaggccccgcggttactgatttacggtgcgtcaagccgcgctacgggcatacccgaccgattcagtgggtccggatctggcaccgattttacactaactatcagccgtctcgagcctgaagacttcgccgtttattactgtcaacagtatggttcctcaagaacctttgggcagggaacaaaagtggagattaag

SEQ ID NO: 24352 - RNA, 321 nt, synthetic construct
  misc_feature 1..321: note = derived and/or modified sequence opt3 from anti-HIV_V2_LightChain
  source 1..321: mol_type = other RNA
gacatccagatgacccaaagcccctcctctctgtcagccagtgtgggcgatagagtcacaattacttgcagggctagccagtccatatctgggaacctcaattggtaccagcagaagcctggaaaagcaccaaaccttctgatctatggtgcctcgtcattgcaaagcggcgttccgagtcggttctccgggtctggaagcggcacggactttaccttaacaatttcctcactgcagcccgaggatttcgcgacttaccactgtcagcagagtcatagcacctcttggacatttggtcaagggaccaaggtggtaatcaaa

SEQ ID NO: 24353 - RNA, 327 nt, synthetic construct
  misc_feature 1..327: note = derived and/or modified sequence opt3 from anti-HIV_10E8
  source 1..327: mol_type = other RNA
gccagcgagctgacccaggaccccacagtgtccgtcgctctcggccaaactgttacgattacctgcagaggggattctcttaggaaccactacacatcatggtatcagcagaagactggacaggcacctgtgctgttgatctacccaaaacataatcggagtccgggtataagcgaccgcttctccgcctcttcgtcaggcaacaccgcgagcttaacaatcaccggggctcaaactgaagatgagggagactattactgtagttcccgagataagtctggcagccgtctggtaacatttggtgggggaaccgaagtgacgggccta

SEQ ID NO: 24354 - RNA, 327 nt, synthetic construct
  misc_feature 1..327: note = derived and/or modified sequence opt3 from anti-HIV_10E8
  source 1..327: mol_type = other RNA
gccagcgagctgacccaggaccccacagtgtccgtcgctctcggccaaactgttacgattacctgcagaggggattctcttaggaaccactacacatcatggtatcagcagaagactggacaggcacctgtgctgttgatctacccaaaacataatcggagtccgggtataagcgaccgcttctccgcctcttcgtcaggcaacaccgcgagcttaacaatcaccggggctcaaactgaagatgagggagactattactgtagttcccgagataagtctggcagccgtctggtaacatttggtgggggaaccaaagtgacggtcgtg

SEQ ID NO: 24355 - RNA, 327 nt, synthetic construct
  misc_feature 1..327: note = derived and/or modified sequence opt3 from anti-HIV_10E8
  source 1..327: mol_type = other RNA
gccagcgagctgacccaggaccccacagtgtccgtcgctctcggccaaactgttacgattacctgcagaggggattctcttaggaactactatacatcatggtaccagcagaagcctggacaggcaccagtgctgttgatctatccgaaacacaatcggccccctggtataagtgaccgcttcagcgcctcctcttcgggcaacactgcgtcattaaccatcacaggggctcaaaccgaagatgagggagactactattgtagcagtcgagataagtccggctctcgtctggtaacttttggtgggggaacaaaagtgaccggccta

SEQ ID NO: 24356 - RNA, 327 nt, synthetic construct
  misc_feature 1..327: note = derived and/or modified sequence opt3 from anti-HIV_10E8
  source 1..327: mol_type = other RNA
gccagcgagctgacccaggaccccacagtgtccgtcgctctcggccaaactgttacgattacctgcagaggggattctcttaggaactactatacatcatggtaccagcagaagcctggacaggcaccagtgctgttgatctatccgaaacacaatcggccccctggtataagtgaccgcttcagcgcctcctcttcgggcaacactgcgtcattaaccatcacaggggctcaaaccgaagatgagggagactactattgtagcagtcgagataagtccggctctcgtctggtaacttttggtagagggacaaaactaaccgtggtc

SEQ ID NO: 24357 - RNA, 327 nt, synthetic construct
  misc_feature 1..327: note = derived and/or modified sequence opt3 from anti-HIV_10E8
  source 1..327: mol_type = other RNA
gccagcgagctgacccaggaccccacagtgtccgtcgctctcggccaaactgttacgattacctgcagaggggattctcttaggaaccactacacatcatggtatcagcagaagactggacaggcacctgtgctgttgatctacccaaaacataatcggagtccgggtataagcgaccgcttctccgcctcttcgtcaggcaacaccgcgagcttaacaatcaccggggctcaaactgaagatgagggagactattactgtagttcccgagataagtctggcagccgtctggtaacatttggtgggggaaccaaagtgacggtccta

SEQ ID NO: 24358 - RNA, 327 nt, synthetic construct
  misc_feature 1..327: note = derived and/or modified sequence opt3 from anti-HIV_10E8
  source 1..327: mol_type = other RNA
gccagcgagctgacccaggaccccacagtgtccgtcgctctcggccaaactgttacgattacctgcagaggggattctcttaggaactactatacatcatggtaccagcagaagcctcggcaggcaccagtgctgttgatctatccgaaacacaatcgaccccctggaataagtgaccgcttcagcgcctcctcttcgggtaacactgcgtcattaaccatcacaggcgctcaaaccgaagatgagggggactactattgtagcagtcgtgataagtccggatctagactggtaacttttggcggtgggacaaaactaaccgtgctc

SEQ ID NO: 24359 - RNA, 327 nt, synthetic construct
  misc_feature 1..327: note = derived and/or modified sequence opt3 from anti-HIV_10E8
  source 1..327: mol_type = other RNA
gccagcgagctgacccaggaccccacagtgtccgtcgctctcggccaaactgttacgattacctgcagaggggattctcttaggaactactatacatcatggtaccagcagaagcctggacaggcaccagtgctgttgatctatccgaaacacaatcggccccctggtataagtgaccgcttcagcgcctcctcttcgggcaacactgcgtcattaaccatcacaggggctcaaaccgaagatgagggagactactattgtagcagtcgagataagtccggctctcgtctggtaacttttggtgggggaacaaaactaaccgtgctc

SEQ ID NO: 24360 - RNA, 327 nt, synthetic construct
  misc_feature 1..327: note = derived and/or modified sequence opt3 from anti-HIV_10E8
  source 1..327: mol_type = other RNA
gccagcgagctgacccaggaccccacagtgtccgtcgctctcggccaaactgttacgattacctgcagaggggattctcttaggaaccactacacatcatggtatcagcagaagactggacaggcacctatcctgttgatatacccaaaacataatcggccgcccggtatcagtgaccgcttcagcgcctcctcttcgggcaacaccgcgtcattaacaattaccggggctcaaactgaagatgagggagactattactgtagcagtcgagataagtccggctctcgtctggtgacatttggtgggggaaccaaactaacggtactc

SEQ ID NO: 24361 - RNA, 327 nt, synthetic construct
  misc_feature 1..327: note = derived and/or modified sequence opt3 from anti-HIV_10E8
  source 1..327: mol_type = other RNA
agctccgacctgacccaggatcccgccgtgtctgtcgctctcggccaaacagttagaatcacttgccagggggactcacttaggcggtactatgcaggatggtaccagcagaagcctggtcaagccccagtgctggtagtgtatggccgcgataaccgaccgagtgggattcccgaccgtttcagcggatccacgtctggcaataccgcgtcgttgacaatagctggtgcccaggcagaggatgacgccgattactattgttcaagcagagacaaaagtgggtccaggttatctgtctttggaggcggcactaagctgaccgtgcta

SEQ ID NO: 24362 - RNA, 327 nt, synthetic construct
  misc_feature 1..327: note = derived and/or modified sequence opt3 from anti-HIV_10E8
  source 1..327: mol_type = other RNA
gccagcgagctgacccaggaccccgctgtgtccgtcgcattcgaaaagacagttactatcacgtgccaaggcgattctctcagatcacactacgtgagttggtatcagaaaaggcctgggcaggccccagtacttgtgttttacggaaagaacaatcggccgagcggtattcccgaccgcttctccggctctacctcggggaacacagcgtcactgactatagctggagcccaggcagaggatgacgccgattattactgtagcagtcgagacaaatccggctctcgtttgagcgtctttggtgggggaaccaagttaacagtgcct

SEQ ID NO: 24363 - RNA, 327 nt, synthetic construct
  misc_feature 1..327: note = derived and/or modified sequence opt3 from anti-HIV_10E8
  source 1..327: mol_type = other RNA
gccagcgagctgacccaggaccccgctgtgtccgtcgcactcaagcaaacagttactatcacgtgcagaggcgattctcttaggtcacactacgtgagttggtatcagcagaaacctgggcaggccccagtactggtgttctacggaaagaacaatcggccgagcggtattcccgaccgcttttccgggtcttcgtcaggcaacaccgcgagcttgacaatagctggagcccaagcagaagatgacgccgattattactgtagttcccgagacaaatctggcagccgtttatccgtcttcggtgggggaactaagctgaccgtgcta

SEQ ID NO: 24364 - RNA, 327 nt, synthetic construct
  misc_feature 1..327: note = derived and/or modified sequence opt3 from anti-HIV_10E8
  source 1..327: mol_type = other RNA
agctccgagctgacccaggaccccggcgtgtctgtcgccctcaagcaaacagttactatcacgtgcagaggggattcacttaggagtcactacgtgagctggtatcagaaaaagcctggacaggctccagtactggtgttctacggtaaaaacattggcccgtccgggatacccgaccggttttctggatcgacctcaggcaatacagcaagtttgactatcgccggtgcgcaggctgaagatgacgccgattattactgtagctcccgcgacaagtctgggagccgattatccgtcttcggaggcggcaccaaactgacagtgcta

SEQ ID NO: 24365 - RNA, 327 nt, synthetic construct
  misc_feature 1..327: note = derived and/or modified sequence opt3 from anti-HIV_10E8
  source 1..327: mol_type = other RNA
gccagcgagctgacccaggaccccgctgtgtccgtcgcactcaagcaaacagttactatcacgtgcagaggcgattctcttaggtcacactacgtgagttggtatcagaaaaagcctgggcaggccccagtactggtgttctacggcaaaaacaatcggccgagcggtattcccgaccgcttttccggatcttcgtcagggaacaccgcgagcttgacaatagctggagcccaggcagaagatgacgccgattattactgtagttcccgagacaagtctggcagccgtttatccgtcttcggtgggggaactaaactgaccgtgcta

SEQ ID NO: 24366 - RNA, 327 nt, synthetic construct
  misc_feature 1..327: note = derived and/or modified sequence opt3 from anti-HIV_10E8
  source 1..327: mol_type = other RNA
gccagcgagctgacccaggaccccggcgtgtccgtcgctctcaagcaaacagttactatcacgtgcagaggggattctcttaggtcacactacgtgagttggtatcagaaacggcctggacaggcaccagtactggtgttctacggtaagaacaatcgcccgagcggcattcccgaccgattttccgggtctacctcgggaaacacagcctcattgactatagcgggcgctcaggccgaagatgacgcagattattactgtagcagtcgtgacaaatccggttctagattaagcgtcttcgggggaggcaccaagctgacagtgcta

SEQ ID NO: 24367 - RNA, 327 nt, synthetic construct
  misc_feature 1..327: note = derived and/or modified sequence opt3 from anti-HIV_10E8
  source 1..327: mol_type = other RNA
gccagcgagctgacccaggaccccggcgtgtccgtcgctctcgaacaaacagttactatcacgtgcagaggggattctcttaggtcacactacgtgagttggtatcagaagaaacctggacaggcaccagtactggtgttctacggtaagaacaatcggccgagcggcattcccgaccgcttttccgggtctacctcgggaaacacagcctcattgactatagcgggcgctcaggccgaggatgacgcagattattactgtagcagtcgagacaaatccggttctcgtttaagcgtcttcgggggaggcaccaagctgacagtgcta

SEQ ID NO: 24368 - RNA, 327 nt, synthetic construct
  misc_feature 1..327: note = derived and/or modified sequence opt3 from anti-HIV_10E8
  source 1..327: mol_type = other RNA
gccagcgagctgacccaggaccccggcgtgtccgtcgctctcaagcaaacagttactatcacgtgcagaggggattctcttaggtcacactacgtgagttggtatcagaaaaagcctggacaggcaccagtactggtgttctacggtaaaaacaatcggccgagcggcattcccgaccgcttttccgggtctacctcgggaaacacagcctcattgactatagcgggcgctcaggccgaagatgacgcagattattactgtagcagtcgagacaagtccggttctcgtttaagcgtcttcgggggaggcaccaaactgacagtgcta

SEQ ID NO: 24369 - RNA, 327 nt, synthetic construct
  misc_feature 1..327: note = derived and/or modified sequence opt3 from anti-HIV_10E8
  source 1..327: mol_type = other RNA
agctccgagctgacccaggaccccggcgtgtctgtcgccctcaagcaaacagttactatcacgtgcagaggggattcacttaggagtcactacgtgagctggtatcagaaaaagcctggacaggctccagtactggtgttctacggtaaaaacaatcggccgtccggcattcccgaccgcttttctgggtcgacctcaggaaacacagccagcttgactatagcaggcgcgcaggctgaagatgacgccgattattactgtagttcccgagacaagtctggtagccgtttatccgtcttcgggggaggcaccaaactgacagtgcta

SEQ ID NO: 24370 - RNA, 327 nt, synthetic construct
  misc_feature 1..327: note = derived and/or modified sequence opt3 from anti-HIV_10E8
  source 1..327: mol_type = other RNA
agctccgagctgacccaggaaacaggcgtgtctgtcgccctcgggagaactgttacgattacctgcaggggagactcacttcggagtcactacgctagctggtatcaagagaagcccggtcaggcacctaaactgttgttctacggcaagaacaatcgcccatccgggatcccggatcgattttctggatcggcctcaggcaaccgtgcgagcttaacaataagtggtgctcaggccgaagacgatgcagagtattactgttcctctagagacaaaagcgggtccaggctgtcagtgttcggaggcggcactaagctagccgtactc

SEQ ID NO: 24371 - RNA, 327 nt, synthetic construct
  misc_feature 1..327: note = derived and/or modified sequence opt3 from anti-HIV_10E8
  source 1..327: mol_type = other RNA
agctccgagctgacccaggaaacaggcgtgtctgtcgccctcgggagaactgttacgattacctgcaggggagactcacttcggagtcactacgctagctggtatcaaaagaaacccggtcaggcacctaagctgttgttctacggcaaaaacaatcgcccatccgggatcccggatcgattttctggattcgcctcgggcaaccgtgcgtcattaacaataagcggtgctcaggccgaggacgatgcagaatattactgtagttccagagacaagtctgggagcaggctgtccgtgtttggaggcggcactaaactaaccgtactc

SEQ ID NO: 24372 - RNA, 327 nt, synthetic construct
  misc_feature 1..327: note = derived and/or modified sequence opt3 from anti-HIV_10E8
  source 1..327: mol_type = other RNA
agctccgagctgacccaggaaacaggcgtgtctgtcgccctcgggagaactgttacgattacctgcaggggagactcacttcggagtcactacgctagctggtatcaaaagaaacccggtcaggcacctaagctgttgttctacggcaaaaacaatcgcccatccgggatcccggatcgattttctggatcggcctcaggcaaccgtgcgagcttaacaataagtggtgctcaggccgaggacgatgcagaatatatctgttcctctagagacaagagcgggtccaggctgtcagtgttcggaggcggcactaaactaaccgtactc

SEQ ID NO: 24373 - RNA, 327 nt, synthetic construct
  misc_feature 1..327: note = derived and/or modified sequence opt3 from anti-HIV_10E8
  source 1..327: mol_type = other RNA
agctccgagctgacccaggaaacaggcgtgtctgtcgccctcgggagaactgttacgattacctgcaggggagactcacttcggagtcactacgctagctggtatcaaaagaaacccggtcaggcacctaagctgttgttctacggcaaaaacaatcgcccatccgggatcccggatcgattttctggatcggcctcaggcaaccgtgcgagcttaacaataagtggtgctcaggccgaggacgatgcagaatattactgttcctctagagacaagagcgggtccaggctgtcagtgttcggaggcggcactaaactaaccgtactc

SEQ ID NO: 24374 - RNA, 327 nt, synthetic construct
  misc_feature 1..327: note = derived and/or modified sequence opt3 from anti-HIV_10E8
  source 1..327: mol_type = other RNA
agctccgagctgacccaggaaacaggcgtgtctgtcgccctcgggagaactgttacgattacctgcaggggagactcacttcggagtcactacgctagctggtatcaaaagaaacccggtcaggcacctatcctgttgttctacggcaagaacaatcgcccatccgggatacatgatcgattttctggatcggcctcaggcaaccgtgcgagcttaacaatcagtggtgctcaggccgaggacgatgcagaatattactgttcctctagagacaaaagcgggtccaggctgtcagtgttcggaggcggcactaagctaaccgtactc

SEQ ID NO: 24375 - RNA, 393 nt, synthetic construct
  misc_feature 1..393: note = derived and/or modified sequence opt3 from anti-HIV_10E8
  source 1..393: mol_type = other RNA
gaggtgcagctggtcgaaagcggcggggacctcgttaagcccggaggttcccttagactgtcttgctcagccagtggcttcagctttaaaaacacctggatgacatgggtgaggcaagctcctgggaagggattggagtgggtaggccggatcactggtccaggggaaggatggacgtccgattacgcagccaccgtgcagggccgcttcacaatttctcgaaataacatgatagacatgttatatctggagatgaatcgtctaagaactgatgacaccggcctctactattgtgtccacacagaaaaatactataacttttggggagggtacccgcccggtgaggagtatttccagcattggggcagggggaccctggtgatcgtttcgtca

SEQ ID NO: 24376 - RNA, 393 nt, synthetic construct
  misc_feature 1..393: note = derived and/or modified sequence opt3 from anti-HIV_10E8
  source 1..393: mol_type = other RNA
gagatcagactggtggaaagcggcgggggactcgtcaagcccggtggctcccttaggctgtcttgctcagccagtgggttcaactttgacagcgcttggatgacctgggttcggcagcctccaggaaaaggcttggagtgggtgggtcgcattacagggccgggagaaggctggtccgtaggctacgcagagtctgtgaaggggcgattcataatctcgcgtattaattcaatcaactttttatatctggaaatgaataacctaagacccgaggatactggaagctacttctgtgcccacacgggtaaacattatgacttttggaggggctaccctccaggggaggaatatttccaagattggggacagggcacccaggtcattgtgagttcc

SEQ ID NO: 24377 - RNA, 393 nt, synthetic construct
  misc_feature 1..393: note = derived and/or modified sequence opt3 from anti-HIV_10E8
  source 1..393: mol_type = other RNA
gagatcagactggtggaaagcggcgggggactcgtcaagcccggtggctcccttaggctgtcttgctcagccagtgggttcaactttgacagcgcttggatgacctgggttcggcagcctccaggaaaaggcttggagtgggtgggtcgcattacagggccgggagaaggctggtccgtagattacgcagagtctgtgaagggccgattcataatctcgcgtattaattcaatcaactttttatatctggaaatgaataacctaagacccgaggacactgggagctacttctgtgcccacacgggaaaacattatgatttttggaggggttaccctccaggcgaggaatatttccaagactgggggcagggaacccaggtcattgtgagttcc

SEQ ID NO: 24378 - RNA, 393 nt, synthetic construct
  misc_feature 1..393: note = derived and/or modified sequence opt3 from anti-HIV_10E8
  source 1..393: mol_type = other RNA
gaggtgagactggtcgaaagcggcgggaggctcgttcggcccggaggttcccttcgcctgtcttgctcagccagtggcttcaactttgacaatgcttggatgacctgggtgcgacagcctccagggaagggattggagtgggtaggccgtatcacaggtccgggggaaggatggagcgtggattacgcagcctccgtcaaaggcagattcactatttctaggatgaactcgataaactttttctatttagagatgaataatctgaagatcgaagacacgggcctatacttttgtgcgcggaccgggaaacactatgctttctggggaggttatccccctggcgaggagtacctcgaagattgggggcaaggaacactggtgattgtttcaagc

SEQ ID NO: 24379 - RNA, 393 nt, synthetic construct
  misc_feature 1..393: note = derived and/or modified sequence opt3 from anti-HIV_10E8
  source 1..393: mol_type = other RNA
gaggtgagactggtcgaaagcggcgggggactcgttaagcccggtggctcccttaggctgtcttgctcagccagtgggttcaactttgacgatgcttggatgacctgggtgcggcagcctccaggaaaaggcttggagtgggtaggtcgcatcagcgggccgggagaaggctggtccgtggactacgcagagtctgtcaagggccgattcacaatttcgcgtttaaattcaataaactttctgtatctagaaatgaataacgtgagaactgaggatacggggtactatttctgtgccaggaccggaaaacactacgacttttggagcggttatccccctggcgaggaatacttccaagattgggggcagggaacactcgttatcgtgagttcc

SEQ ID NO: 24380 - RNA, 393 nt, synthetic construct
  misc_feature 1..393: note = derived and/or modified sequence opt3 from anti-HIV_10E8
  source 1..393: mol_type = other RNA
gaggtgagactggccgaaagcggcgggggactcgtcaagcccggtggctcccttaggctgtcttgctcagctagtgggttcgactttgataacgcatggatgacctgggttcggcagcctccaggaaaaggcttggagtgggtgggtcgcatcacagggccgggagaaggctggagcgtagactacgccgcgcccgtggagggccgattcactatttcccgtttaaattctataaactttctgtatctagaaatgaataacctcagaatggaggattcggggctgtacttctgtgctaggacgggaaagtattacgacttttggtcaggttatcctccaggcgaggaatacttccaagattgggggcagggaacccttgtcatcgtgcccagc

SEQ ID NO: 24381 - RNA, 393 nt, synthetic construct
  misc_feature 1..393: note = derived and/or modified sequence opt3 from anti-HIV_10E8
  source 1..393: mol_type = other RNA
gaggtgagactggtcgaaagcggcgggggactcgttaagcccggtggctcccttaggctgtcttgctcagccagtgggttcgactttgataacgcttggatgacctgggtgcggcagcctccaggaaaaggcttggagtgggtaggtcgcatcacagggccgggagaaggctggagcgtggactacgcagcccccgtcgagggccgattcactatttcccgtttaaattctataaactttctgtatctagaaatgaataacctcagaatggaggattcggggctgtacttctgtgcgaggacgggaaagtattacgacttttggtcaggttatcctccaggcgaggaatacttccaagattgggggcagggaacccttgtgatcgttcccagc

SEQ ID NO: 24382 - RNA, 393 nt, synthetic construct
  misc_feature 1..393: note = derived and/or modified sequence opt3 from anti-HIV_10E8
  source 1..393: mol_type = other RNA
gaggtgagactggtcgaaagcggcgggggactcgttaagcccggtggctcccttaggctgtcttgctcagccagtgggttcgactttgataacgcttggatgacctgggtgcggcagcctccaggaaaaggcttggagtgggtaggtcgcatcacagggccgggagaaggctggagcgtggactacgcagcccccgtcgagggccgattcactatttcccgtttaaattctataaactttctgtatctagaaatgaataacctcagaatggaggattcggggctgtacttctgtgcgaggacgggaaagtattacgacttttggtcaggttatcctccaggcgaggaatacttccaagattgggggcagggaacccttgtgatcgttagcagt

SEQ ID NO: 24383 - RNA, 393 nt, synthetic construct
  misc_feature 1..393: note = derived and/or modified sequence opt3 from anti-HIV_10E8
  source 1..393: mol_type = other RNA
gaggtgagactggccgaaagcggcgggggactcgtcaagcccggtggctcccttaggctgtcttgctcagctagtgggttcgactttgataacgcatggatgacctgggttcggcagcctccaggaaaaggcttggagtgggtgggtcgcatcacagggccgggagaaggctggagcgtagactacgccgcgcccgtggagggccgattcactatttcccgtttaaattctataaactttctgtatctagaaatgaataacctcagaatggaggattcggggctgtacttctgtgctaggacgggaaagtattacgacttttggtcaggttatcctccaggcgaggaatacttccaagattgggggcggggaacccttgtcatcgtgagcagt

SEQ ID NO: 24384 - RNA, 393 nt, synthetic construct
  misc_feature 1..393: note = derived and/or modified sequence opt3 from anti-HIV_10E8
  source 1..393: mol_type = other RNA
gaggtgagactggtcgaaagcggcgggggactcgttaagcccggtggctcccttaggctgtcttgctcagccagtgggttcgactttgataacgcttggatgacctgggtgcggcagcctccaggaaaaggcttggagtgggtaggtcgcatcacagggccgggagaaggctggagcgtggactacgcagcccccgtcgagggccgattcactatttcccgtttaaattctataaactttctgtatctagaaatgaataacctcagaatggaggattcggggctgtacttctgtgcgaggacgggaaagtattacgacttttggtcaggttatcctccaggcgaggaatacttccaagattgggggcggggaacccttgtgatcgttagcagt

SEQ ID NO: 24385 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaaggttacaatctcatgcagtgggagaagctccaacattggaaataacaatgtgttctggtaccagcagctcccgggtactgcacccaaacttctgatatatgacaacgataagaggccttctggcatcccagaccggttttcggggtcaaaaagcggaacgagtgccaccttgggcattacaggtttacaaactggggatgaggcggactactattgtggaacctgggattcctctctgagcgctggcggcgtattcgggacaggaaccaaggtgactgtccta

SEQ ID NO: 24386 - RNA, 336 nt, synthetic construct
  misc_feature 1..336: note = derived and/or modified sequence opt3 from anti-HIV-1_LightChain
  source 1..336: mol_type = other RNA
cagagcgtgctgacccaacccgcctccgtctctggctcacctgggcagagtatcacaattagctgcactggaacgaagtccgacataggtggctacaaatatgtttcttggtaccagcagcacccagggaaggctccgaaaatcctcatttatgatgtgaacaagagaccctcgggaatccctgacaggttctcaggcagcaaaagtggtacctccgcaacacttgggattactggactgcaaaccggcgatgaggccgactactattgtggcacatgggataattctttgagcaccgggggagtatttggtactggcacaaaggtgaccgtctta

SEQ ID NO: 24387 - RNA, 321 nt, synthetic construct
  misc_feature 1..321: note = derived and/or modified sequence opt3 from anti-HIV-1_LightChain
  source 1..321: mol_type = other RNA
cagagcgtgctgacccaacccccttccgtctctgccgctccaggccagagagttacaatctcatgcttcgggagtaggtttagctccgtgtcttggtaccagcagctcccgggaactgcacccaaacttctgatttatgagaacacgaagcggccttcgggtataccagaccgcttctcaggcagcaagagtgggacctccgccacattgggaatcactggcttacaaaccggtgatgaagcggactactattgtgggacatgggatcgatctctgagcgctggaggcgtatttggcaccgggactaaagtgacagtccta

SEQ ID NO: 24388 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgcctctggcacaccagggcagactatcacgatttcatgcagtggaagctcctctaacataggttcgaatgacgtctactggtatcagcacctcccgggcaccacacccaaggttgtgatctacaaaaacaatagaaggccttcagggattccagatcggttcagcggaagtaagtccggcacttctgctacccttggtatcacagggctgcagaccggagacgaggcagattattactgtggcacttgggaccgcagcttgtccgccggcggggtatttggaacaggtaccaaagtgacggtctta

SEQ ID NO: 24389 - RNA, 327 nt, synthetic construct
  misc_feature 1..327: note = derived and/or modified sequence opt3 from anti-HIV-1_LightChain
  source 1..327: mol_type = other RNA
cagagcgtgctgacccaacccccttccatgtctgccgctccaggccagaaggtcacaatctcatgcagtgggagcacttccattataggaaacaattacatctcttggtatcagcagctcccgggtacggcacccaaacttctgatttacgaggacaacaagagaccttcgggcatcccagataggttctcagggagcaaaagtggaacctccgccacattgggcattactggtttacaaaccggggacgaagcggattattactgtggaacatggcactctagcctgtccgctggcggcgtttttgggaccggaactaaggtgaca

SEQ ID NO: 24390 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggcctcaaggttacaatctcatgcagtgggaacactagcaatgtgggagacaacttcgtatcctggtacagatatcttccgggtacggcacccaaactgttgtcttacgaggatgacaagaggccttcgggcattccagatcggttttcagggagcaaaagtggaacctccgccacattaggcataactggtctgcagaccggggacgaagcggattattactgtggaacatgggactctagcctatccgctggcggcgtgttcgggaccggaactaaggtcacagtgctc

SEQ ID NO: 24391 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgcctctggcacaccagggcagagagtcactatctcatgcagtggaagctcctctaacattggttcgaatacggttaactggtaccagcagttcccgggcaccgctcccaagctccttatatatgagaataacaggcggccttcaggggtgccagcacgctttagcggaagtaaatccggcacatctgccactctggcgatcaccggtttgcaaacaggggacgaagctgattactattgtgccacctgggacagctccttatcagcaggaggcgtattcggcactgggacaaaggtgaccgtcctg

SEQ ID NO: 24392 - RNA, 318 nt, synthetic construct
  misc_feature 1..318: note = derived and/or modified sequence opt3 from anti-HIV-1_LightChain
  source 1..318: mol_type = other RNA
cagagcgtgctgacccaacccccttccgtctctgccgctccaggccagaaggttacaatctcatgcagtgggagctcctctaacattggaaataactacgtgtcgtggtatcagcagctcccgggtactgcacccaaacttctgatatacgagaataacaagagaccttcaggcatcccagacaggttcagcgggagtaaatccggaacgtctgccaccttgggcattacaggtttacaaactggggatgaagcggactattactgtggaacctgggataatagcctgtccacaggcggcgtatttgggaccggaact

SEQ ID NO: 24393 - RNA, 288 nt, synthetic construct
  misc_feature 1..288: note = derived and/or modified sequence opt3 from anti-HIV-1_LightChain
  source 1..288: mol_type = other RNA
ggcctgagcccctccctctgctctgggtcaagtagcaacatcggaaataactacgtgtcctggtatcagcaacttcctggtaccgccccaaagctgttgatttacgagaatacaaaaagaccgtctggcatacccgacaggttctcggggtcaaagagcggaacgagtgctactttaggcatcaccggtctgcagacaggggatgaaggagactattactgtggcacttgggatcggtccctatctgcaggcggggtctttggaaccggtacaaaagttaccgtgctc

SEQ ID NO: 24394 - RNA, 333 nt, synthetic construct
  misc_feature 1..333: note = derived and/or modified sequence opt3 from anti-HIV-1_LightChain
  source 1..333: mol_type = other RNA
cagttcgtgctgacccaaccccctagcgtctccgccgctccaggccagagagttacagtgtcttgctcagggactacgagtgacatcggagagaactacgtaagctggtatcagaagttttccgaagcagccccgaaactccttctgtacgataatgacaagaggccctctggtattcctgatcggttctcgggctcaaaaagcgggaccagtgcgacattgggaataactggcttacagaccggtgacgaggctgattattactgtgggacatgggactcctctctgagcgccggaggcgtgtttggcaccgggactaaggtcacagtgcta

SEQ ID NO: 24395 - RNA, 327 nt, synthetic construct
  misc_feature 1..327: note = derived and/or modified sequence opt3 from anti-HIV-1_LightChain
  source 1..327: mol_type = other RNA
cagagcgtgctgacccaacccccttccgtctctgccgctccaggccagaaggttacaatctcatgcagtgggggaagctccaacattggtaattactatgtgtcttggtacctccagcttccgggcactgcacccaaactgttgatatatgagaacaataagagaccttcggggatcccagacaggttctcaggaagcaaaagtggcacgtccgccaccttaggtattacagggctgcagactggagatgaagcggactactattgtggcacctggcactctagcctatccgctggcggggtatttggaacaggtaccaaggtgact

SEQ ID NO: 24396 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaaggttacaatctcatgcagtgggaacatgagcaatattggagacaacgcagtgtcctggtacagacaggtaccggaggcgccccctcagctccttatattcggtaatgataaaaggccatctggcgtgactgaccggttttcggggtcaaagagcggaacgagtgccaccctgggcatcacaggtttgcaaactggggatgaagctgactattactgtggaacctgggatcgctccttatctgccggcggcgtcttcgggacaggaaccaaagtgactgttctg

SEQ ID NO: 24397 - RNA, 336 nt, synthetic construct
  misc_feature 1..336: note = derived and/or modified sequence opt3 from anti-HIV-1_LightChain
  source 1..336: mol_type = other RNA
cagagcgtgctgacccaacccccttccgtctctggcgccccagggcagagagttacaatctcatgcactggaagtagctccaacattggtgctggctacgacgtgcactggtatctccagcttccggggacggcacccaggctgttgatatacgataatgacaagcggccttctggaatcccagatcgcttctcgggctcaaaaagcggtaccagtgccacattagggattactggactgcagaccggcgacgaggcggattattactgtggcacatggcattcctctctaagcgctgggggagtatttggtaccggcactaaggtgacagtcctc

SEQ ID NO: 24398 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaaggttacaatctcatgcagtgggagcacttccaacattggaaataacttcgtgtcttggtaccagcagctcccgggtacggcacccaaacttctgttttatgacaattacaagagaccttcgggcataccagataggttctcagggagcaaaagtggaacctccgccacattggcgatcactggcttacaaaccggtgacgaggctgattattactgtgccacatgggactctagcctgtccgcagggggagtatttggcaccggcactaaggtgacagtccta

SEQ ID NO: 24399 - RNA, 336 nt, synthetic construct
  misc_feature 1..336: note = derived and/or modified sequence opt3 from anti-HIV-1_LightChain
  source 1..336: mol_type = other RNA
cagagcgtgctgacccaacccccttccgtctctggcgccccagggcagagagttacaatctcatgcactggaggtagtagcaacattggcgctgggtacgacgtgcactggtatcagcatctcccgggaacggcaccccagcttctgatatacgagaataccaagaggccttccggcatcccagatcggttctctggttcgaaatcagggacaagcgccactttgggaattaccggcttacaaacaggcgacgaagcggattattactgtgggacctgggaccgcagtctgtccgctggaggtgtatttggcactgggacaaaggtgaccgtccta

SEQ ID NO: 24400 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccctctctgccgctccaggccagagagtcacagtttcatgcagtgggagctcctctaacatcggagacaattacgtgtcgtggtatcagcagcttccgggtgcagcccccaggctgttgatttacgagaacaataagcggccttcaggcataccagatcgcttcagcgggagtaaatccggaacttctgcgacgttaggcatcaccggtctgcaaacaggggacgaagctgattattactgtggaacttgggacaacagcctatccaccggcggcgtatttgggacaggaaccaaggtgactgtcctc

SEQ ID NO: 24401 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaaggttacaatctcatgcagtgggagaagctccaacattggaaattacttcgtgtcttggtatcagcagtttccgggtactgcacccaaactccttatatacgacaacaataagaggccttcgggcatcccagatcggttctcagggagcaaaagtggaacgtccgccaccctgggcattacaggtttgcaaactggggacgaggcggattattactgtggaacctgggaccgctctttaagcgctggcggcgtatttgggacaggaaccaaggtgactgtcctg

SEQ ID NO: 24402 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgcctctggcacaccagggcagagagtcactatctcatgcagtggaagctcctctaacattggttcgaatgctgttcactggttcaggcagctcccgggcacggcacccaaacttctgatatacgagaacaataagcggccttcagggatcccagaccgctttagcggaagtaagtccggcacctctgccacattgggtattactgggttacagaccggagatgaagcggactattactgtgctacatgggatagctccctgtcagccggcggcgtgttcgggaccggaactaaagtaacagtgcta

SEQ ID NO: 24403 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgcttcaggccagaaggttacaatcagttgcagcgggtcctcttcgaacattggaaataactacgtgtcatggtatcaccagctcccaggtactgcaccgaaacttctgatatacgacacgaataagagacccagcggcatccctgataggttcagtgggtccacctctggaacaagcgccactttgggcattaccggtttacagacaggggacgaggcggattattactgtggaacctgggacaactccctgtcaactggcggcgtatttgggacaggaaccaaagtgacggtccta

SEQ ID NO: 24404 - RNA, 333 nt, synthetic construct
  misc_feature 1..333: note = derived and/or modified sequence opt3 from anti-HIV-1_LightChain
  source 1..333: mol_type = other RNA
cagcccgtgctgacccaacctccaagcgtctccgccgctccgggccagacagttactatctcttgctcagggagtttcagcaacattgagacgaattacgtgtcctggtatcagcagctccccggaaccgcacctaaacttctgatatacgacaacaatatgagaccatctggtatccccgataggttttcgggctcaaagagcgggacaagtgccactttgggaattaccggcttacaaacaggtgacgaagcggattattactgtgggacctgggacacttccctgtctgctggaggcgtattcggcacagggaccaaggtgacggtccta

SEQ ID NO: 24405 - RNA, 336 nt, synthetic construct
  misc_feature 1..336: note = derived and/or modified sequence opt3 from anti-HIV-1_LightChain
  source 1..336: mol_type = other RNA
cagcccgtgctgacccaacctccaagcgtctccggcgccccggggcagagagttacaatctcttgcactggatcaagtagcaacattggtgctggctacgacgtgcactggtatcagcagctccccgggacggcacctaaacttctgatatacgagaataacaagaggccatccggaatccccgatcggttctctggctcgaagtcaggtaccagcgccacattggggattactggattacaaaccggcgacgaagcggattattactgtggcacatgggacaatagtctgtccaccgggggagtatttggtactggcacaaaagtgaccgtccta

SEQ ID NO: 24406 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccctctctgccgctccaggccagagaatcacaatttcatgcagtgggagctcctctaacataggaaataactacgtctcgtggtatcagcagttcccgggtactgcacccaaacttctgatctacgagaataacaagaggccttcaggcattccagaccggtttagcgccagtaagtccgggacgtctgcgaccttgggaatcacaggcttacaaactggtgatgaagctaattattactgtgggacctggcacagctccctgtcagccggaggcgttttcggcacagggaccaaagtgactgtacta

SEQ ID NO: 24407 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagagagttacaatctcatgcttcgggagtaggtttaacgtgggaactagctccgtatcttggtaccagcagctcccgggtacggcacccaaacttctgattgacgccaatggcgagcggccttcggggataccagatcgcttctcaggaagcaagagtggcacctccgcgacattgggtatcactgggttacaaaccggagacgaagctgattattactgtggcacatgggactctagcctgtccgccggcggggtgtttggaaccggtactaaggtcacagtgcta

SEQ ID NO: 24408 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccacaccaggccagaaggttactatctcatgcagtgggagcagatccaacattggatctcactacgtgtcgtggtatcagcagttcccgggtacggctcccaaactccttatatacgacaataacaagaggccttcaggcatcccagatcggtttagcgggagtaaatccggaacctctgcaacactgggcattactggtttgcaaaccggggacgaggccgattattactgtggaacatggcatagctccttatcagcgggcggcgtattcgggaccggaactaaggtgacagtcctg

SEQ ID NO: 24409 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgcctctggcacaccagggcagagagtcactatctcatgcagtggaagctcctctaacattggttcgaatcacgtttactggtatcagcagctcccgggcaagacgcccaaacttctgatatacaggaacaatcaacggccttcagggatcccagaccgcttcagcggaagtaagtccggcacctctgctacattgggtattactgggttacagaccggagatgaggcagactattactgtggcacatgggatagctccctgtcaaccggcggggtgtttggaactggtacaaaagtaaccgtgcta

SEQ ID NO: 24410 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaaggttacaatctcatgcagtgggagctccgcaaacattggaaataactacgtgtcttggtatcagcagttcccgggtactggccccagactcataatctacgagtcgaataaaaggccttcagggattagcgaccggtttagtggatcccaatctgatgccgcggctacgcttgacatcaccggcctgcagacaggtgatgaagccgactattactgtgggacttgggatagctccttgtcagcaggaggcgtattcggcaccgggacacgcgtgaccgtctta

SEQ ID NO: 24411 - RNA, 336 nt, synthetic construct
  misc_feature 1..336: note = derived and/or modified sequence opt3 from anti-HIV-1_LightChain
  source 1..336: mol_type = other RNA
cagagcgtgctgacccaacccccttccgtctctggcgccccagggcagacagttactatctcatgcacgggagacaccagtaacattggtgctgattacagagtgcactggtatcagcagctcccgggcacagcacccaaacttctgatatacgagaataacaagaggcctagcgggatcccagaccggttctccggatctaagtcgggcacttcagccaccttgggtattacagggttacaaaccggagatgaagcggactattactgtggcacttgggataatagcctgagtacaggcggggtatttggaaccggtacgaaagtgactgtccta

SEQ ID NO: 24412 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccctctctgccgctccaggccagagagtcacagtttcatgcagtgggagctcctctaacatcggaaataactacgtgtcgtggtatcagcagcttccgggtgcagcccccaagctgttgatttacaataacaatataaggccttcaggcatcccagagcggttcagcgggagtaaatccggaacttctgcgacgttaggcattaccggtctgcaaacaggggacgaaggagattattactgtggcacttgggaccgcagcctatccgctggcggggtatttggaaccggtacaaaggtgaccgtcctc

SEQ ID NO: 24413 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgcgtctggcacaccagggcagagagtcactatctcatgcagtggaagctcctctaacattggtggcaattacgtttcgtggtatcagcagctcccggggacggctcccaaacttctgatatcagagaacaataagaggcctagcggaatcccagaccggttcagtggctccaagtctggtaccagcgcaacattggggattactggattacaaaccggcgatgaagccgactactattgtggcacatgggattcctcactgagtgccgggggagtgtttggtaccggcactaaagtaacagtgcta

SEQ ID NO: 24414 - RNA, 333 nt, synthetic construct
  misc_feature 1..333: note = derived and/or modified sequence opt3 from anti-HIV-1_LightChain
  source 1..333: mol_type = other RNA
cagagcctgctcacccaacccccttccgtgtctgccgctccaggccagaaggtcacaatctcatgcagtgggagctcctctaacattggaaataacttcgtttcgtggtaccagcagcttccgggtactgcacccaaactgttgatatatgagaataacatgagaccttcaggcatcccagacaggtttagcgggagtaagtccggaacgtctgccaccttaggcattacaggtctgcaaactggggatgaagcggactactattgtggaacctgggatagctccctatcagctggcggcgtgttcgggacaggaaccaaagtaactgtgctc

SEQ ID NO: 24415 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaaggttacaatctcatgcagtgggactagctccaacattgcaaattactatgtgtcttggtacagacagctcccgggaacggcccccaaacttctgatatatgagaacaataagaggccttcgggtatcccagaccggttctcaggcagcaaaagtgggacctccgcgacattgggaattactggcttacagaccggtgatgaagctgactactattgtgggacatgggattctagcctgtccgccggaggcgtatttggcaccgggactaaggtgacagtccta

SEQ ID NO: 24416 - RNA, 333 nt, synthetic construct
  misc_feature 1..333: note = derived and/or modified sequence opt3 from anti-HIV-1_LightChain
  source 1..333: mol_type = other RNA
cagcccgtgctgacccaacctccaagcgtctccggcgccccggggcagagagttacaatctcttgctcaggaagtagctccaacattggtaataacgacgtgtcttggtaccagcaggtacccggcactgctcctaagctccttatatatgagaataacaaaaggccatcggggatccccgatcggttctcaggaagcaagagtggcacgtccgcaaccctgggtattacagggttgcaaactggagacgaagccgattactattgtggcacctgggacacatctttaagcgcgggcggggtgtttggaaccggtactaaagtcacagtgctg

SEQ ID NO: 24417 - RNA, 333 nt, synthetic construct
  misc_feature 1..333: note = derived and/or modified sequence opt3 from anti-HIV-1_LightChain
  source 1..333: mol_type = other RNA
cagctggtgctcacccaaccccctagcgtctccgccgctccaggccagagagttacaatctcttgcttcgggtcaaggtttaacgtgggaacgagtagcgtatcctggtaccagcagcttccgggtactgcacccaagctgttgattgacgccaatggcgagcggccttctgggataccagatcgcttctttggatcggaatcaggcaccagcgcgacattaggtatcactgggctgcaaaccggagacgaggctgattattactgtggcacatggcacagttccctatctgccggcggggtgttcggaaccggtactaaagtcacagtgctc

SEQ ID NO: 24418 - RNA, 333 nt, synthetic construct
  misc_feature 1..333: note = derived and/or modified sequence opt3 from anti-HIV-1_LightChain
  source 1..333: mol_type = other RNA
agctacgagctgacccagcccccttccgtgtctgccgctccaggccaaaaggtcacaatctcatgcagtgggagctcctctaacattggaaataactatgtttcgtggtaccagcagctcccgggtactgcacccaaacttctgatatatgaaaataacaagagaccttcaggcatcccagacaggttcagcgggagtaaatccggaacgtctgccaccttgggcattacaggtttacagactggggatgaggcggactactattgtggaacctgggatacaagcctgtccgctggcggcgtgtttgggaccggaactaaggtaacagtgcta

SEQ ID NO: 24419 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgcctctggcacaccagggcagagagtcactatctcatgcagtggaagcacgtccaacattggtacctactatgtttcttggtaccagcagctcccgggcacagctcccaaacttctgatatatgagaatactaagaggccttcggggatcccagaccggttctcaggaagcaagagtggcacctccgcaacattgggtattaccgggttacaaactggagatgaaggcgactactattgtggcacatgggatcgctctctgagcgccgggggagtgtttggtaccggcacgaaagtaactgtgcta

SEQ ID NO: 24420 - RNA, 336 nt, synthetic construct
  misc_feature 1..336: note = derived and/or modified sequence opt3 from anti-HIV-1_LightChain
  source 1..336: mol_type = other RNA
cagagcgccctgacccaacccgcttccgtgtctgcatcacctggccagagtatcgccattagctgcacagggacttcctctgacgtcggatcgtacaactatgtttcatggtaccagcagctcccaggtacggcgccgaaacttctgatatatgagaataccaagagacccagcggcatccctgataggttcagtgggtccaagtctggaacaagcgctactttgggcattaccggtttacaaacaggggacgaagccgattactattgtggaacctgggaccggtccctgtcagcaggcggcgtgtttgggactggaacaaaagtaaccgtgcta

SEQ ID NO: 24421 - RNA, 330 nt, synthetic construct
  misc_feature 1..330: note = derived and/or modified sequence opt3 from anti-HIV-1_LightChain
  source 1..330: mol_type = other RNA
cagagcgtgctgacccaacccccttccgtctctgccgctccaggccagagagttacaatctcatgcagtgggggaagctccaacattggtaataaccacgtgtcttggtaccagcatctcccgggcagggcaccccagcttctgatatatgacactacgcaacggccttcggggatcccagatcgcttctcaggaagcaagagtggcacctccgccacattgggtattactgggttacagaccggagacgaggcggattactattgtggcacatgggactctagcctgtccaccggcggggtatttggaactggtacaaaagtgaccgtc

SEQ ID NO: 24422 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgcctctggcacaccagggcagagagtcactatctcatgcagtggaagctcctctaacattggttcgaagtacgtttgttggtatcagcagctcccgggcacggctcccaaacttctgatatacaggaataaccaacggccttcagggatcccagaccgcttcagcggaagtaagtccggcacctctgcaacattgggtattactgggttacagaccggagatgaggccgactattactgcggcacatggcacagctccctgtcagcgggcggggtgtttggaaccggtactaaagtaacagtgcta

SEQ ID NO: 24423 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaaggttacaatctcatgcagtggggacagctccactttcgagaacgattacgtgtgttggtatcagcagctcccgggaacggcacccaaacttctgatttacgacaataacaagagaccttctggtataccagataggttttcgggctcaaaaagcgggaccagtgccacattgggaatcactggcttacaaaccggtgacgaagcggattattactgcgggacatggcactcctctctgagcgctggaggcgtattcggcaccgggactaaggtgacagtccta

SEQ ID NO: 24424 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaaggttacaatctcatgcagtgggagctcctctaacattggaaataactacgtgtcgtggtatcagcagctcccgggtactgcacccaaacttctgatatacggcaattcaaacagacctagcggggtaccagacaggttcagtggatccaagtctggcacgagcgcctccttggcgatcaccggtttacaagctgaggatgaagccgactattactgtgggacatgggattcaagtctgagcgcaggaggcgtgtttggcactgggaccaaagtcacagtgcta

SEQ ID NO: 24425 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagacagttactatctcatgcagtgggagctcctctaacattggatcgaatacggtgaactggtaccagcagctcccgggtaccgcacccaaacttctgatatatgagaataacaagagaccttcaggcatcccagacaggttcagcgggagtaagtccggaacatctgccactttgggcattaccggtttacaaacaggggatgaagcggactactattgtggaacctgggataatagcctgtccactggcggcgtatttgggacaggaaccaaagtgacggtccta

SEQ ID NO: 24426 - RNA, 336 nt, synthetic construct
  misc_feature 1..336: note = derived and/or modified sequence opt3 from anti-HIV-1_LightChain
  source 1..336: mol_type = other RNA
cagagcgtgctgacccaacccccttccgtctctggcgccccagggcagagagttacaatcttctgcactggatcaagtagcaacgtgggtggcgggtacgacgtacactggtatcagcagctcccgggaacggctcccaaacttctgatttacgagaataacaagaggccttccggcataccagatcggttttctggttcgaagtcagggaccagcgcaacattgggaatcactggcttacaaaccggcgacgaagccgattattactgtgggacatgggacagttccctgtctgcgggaggtgtgttcggcaccgggactaaagtcacagtgcta

SEQ ID NO: 24427 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaaggttacactctcatgcagtgggagctcctctaacatcggaaataactcggtgtcatggtaccagcagttcccgggtactgcacccaaacttctgatttatgacagcgataagagacctagtggcataccagacaggttttccgggtctaaaagcggaacgtccgccaccttgggcatcacaggtttacaaactggggatgagggagactactattgtggcacctgggatcggtcactgagtgcgggcggggtattcggaacaggtaccaaggtgactgtccta

SEQ ID NO: 24428 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgcctctggcacaccagggcagaaggtcactatctcatgcagtggaagctcctctcagattggttcgaactcagtttactggtatcagcaactcccgggcacgacccccaaacttctgatatacgggaataaccagagacctagcggaatcccagacaggttcagtggctccaagtctggtacaagcgctactttggggattaccggattacagacaggcgatgaggcagactattactgtggcacctgggattcctcactgagtgccgggggagtgtttggtactggcacaaaagtaaccgtgcta

SEQ ID NO: 24429 - RNA, 336 nt, synthetic construct
  misc_feature 1..336: note = derived and/or modified sequence opt3 from anti-HIV-1_LightChain
  source 1..336: mol_type = other RNA
cagagcgccctgacccaacccgcttccgtgtctggctcacctgggcagagtatcacaattagctgcactggaacgggttccgacgtcggcgggtacaaccacgtttcttggtatcagcagcatccaggaaaggcaccgaaactccttatatacgataataacaagagaccctcgggcatccctgacaggttctcaggtagcaaaagtgggacctccgccacactgggaattactggcttgcaaaccggcgatgaggcggactattactgtgggacatggcactctagcttatccgctggaggtgtgtttggcaccgggactaaggtaacagtgctg

SEQ ID NO: 24430 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagagagttacaatctcatgcagtgggagcggatccaacattggtgacaggttcgtgtcttggtaccagcacctcccgggcactgtacccaaacttctgatatatgataatgagcatcggccttcggggatcccagaccgcttttcaggaagcaagagtggcacgtccgcaaccttgggtattacagggttacagactggagatgaagccgactactattgtggcacctgggattctagcctgtccgcgggcggggtgttcggaacaggtaccaaggtcactgtgcta

SEQ ID NO: 24431 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaagatcacaatttcatgcagtgggagctcctctaacataggaaaatcggttgtgtcatggtacagacagttcccgggtactgcacccaagctccttatctatgacacgtacaaaaggcctagcggcattccagatcggtttagtgggtccaagtctggaaccagcgccacactgggcatcactggtttgcagaccggggacgaggcggattattactgtggaacatggcactcctcattaagtgctggcggcgtattcgggaccggaactaaagtgacagtcctg

SEQ ID NO: 24432 - RNA, 333 nt, synthetic construct
  misc_feature 1..333: note = derived and/or modified sequence opt3 from anti-HIV-1_LightChain
  source 1..333: mol_type = other RNA
cagcccgtgctgacccaacctccaagcgcctccggcacaccggggcagagagtcactatctcttgctcaggaagtagctccaacattggtggcaatacggttaactggtaccagcagttccccggggctgcacctaggctccttatatatgaggacaataagcggccatctggaatccccgatcgcttttcgggctcaaaaagcggtaccagtgccacactggggattactggattgcaaaccggcgacgaagcggattactattgtggcacatgggactcctctttaagcgctgggggagtgttcggtaccggcactaaggtaacagtgctg

SEQ ID NO: 24433 - RNA, 333 nt, synthetic construct
  misc_feature 1..333: note = derived and/or modified sequence opt3 from anti-HIV-1_LightChain
  source 1..333: mol_type = other RNA
aacttcatgctgacccagccccacagcgtgtccgagtctcctggcaagacagtcactatctcatgcacgagaagtagcgggtccgttgcctctaattacgtgcaatggtatcagcagctcccaggaaccgctccgaaacttctgatttacgaaaacaataagaggccctcgggtatacctgaccggttttcaggcagcaaaagtgggacatccgcaactttgggaatcaccggcttacagacaggtgatgaggccgactattactgtgggacctggcattctagcctgtccgcgggaggcgtattcggcactgggacaaaggtgaccgtccta

SEQ ID NO: 24434 - RNA, 333 nt, synthetic construct
  misc_feature 1..333: note = derived and/or modified sequence opt3 from anti-HIV-1_LightChain
  source 1..333: mol_type = other RNA
cagagcatgctgacccaacccccttccgtgtctgccgctccaggccagagagtcacagtttcatgcagtgggagctcctctaacatcggatcgcacttcgtgtcatggtaccagcagctcccgggtactgcacccaaacttctgatttatgacaatagcaacaggcctagtgccataccagatcggttttccggctctaagagcgggacgtccgcgaccttgggaatctcaggcttacatacaggtgacgaggctgattactattgtgccacttgggacaatagtctgagcaccgggggagtattcggcacaggcaccaaggtgactgtccta

SEQ ID NO: 24435 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaaggttatcatttcatgcagtgggggaagctccaacataggtaataacttcgtgtcttggtaccaccagctcccgggcacagcacccaaacttctgatctatgagaatactaagagaccttcgaaaattccagccaggttttcagggagcaagagtggaacgtccgcgaccttgggcatcacaggtttacagactggggacgaagctgattactattgtggaacctgggactctagcctgtccgccggcggcgtattcgggacaggaaccaaagtgactgtccta

SEQ ID NO: 24436 - RNA, 315 nt, synthetic construct
  misc_feature 1..315: note = derived and/or modified sequence opt3 from anti-HIV-1_LightChain
  source 1..315: mol_type = other RNA
cagagcctgctcacccaacccccttccgtgtctgccgctccaggccagaaggtcacaatctcatgcagtgggagctcctctaacattggaaataactacgtttcgtggtatcagcagcttccgggtactgcacccaaactgttgatatacgagaataacaagagaccttcaggcatcccagacaggttcagcgggagtaaatccggaacgtctgccaccttaggcattacaggtctgcaaactggggatgaagcggactattactgtggaacctgggatagctccctatcagctggcggcgtgtttgggacagga

SEQ ID NO: 24437 - RNA, 336 nt, synthetic construct
  misc_feature 1..336: note = derived and/or modified sequence opt3 from anti-HIV-1_LightChain
  source 1..336: mol_type = other RNA
cagagcgccctgacccaacccgcttccgtgtctggctcacctgggcagagtatcacaattagctgcactggaacgtcctctgacataggttcgtactcattcgtcagctggtatcagcagcacccaggcaaggcaccgaaactcatcatttacgatgttaacaagagacccagtgggatccctgacaggttttccggatctaaaagcggcacctccgccacacttggtattactgggctgcaaaccggagatgaggcggactattactgtggcacatgggatcggtcattgagtgctggcggggtgttcggaaccggtactaaggtaacagtgtta

SEQ ID NO: 24438 - RNA, 336 nt, synthetic construct
  misc_feature 1..336: note = derived and/or modified sequence opt3 from anti-HIV-1_LightChain
  source 1..336: mol_type = other RNA
cagagcgtgctgacccaacccccttccgtctctggcgccccagggcagagagttacaatctcatgcactggaaacagtagcaatattggtgctggcttcgacgtgcactggtacaggcatctcccggggacggcacccaaacttctgatatatgagaacaccaagcggccttccggaatcccagatcgcttttctggctcgaagtcaggtacaagcgccactttggggattaccggattacagacaggcgacgaagcggattactattgtggcacctgggaccgaagtctgtccgctgggggagtattcggtactggcacaaaagtgaccgtccta

SEQ ID NO: 24439 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaaggttacaatctcatgcagtgggggaagctccaacattggtaattactatgtgtcttggtacctccagcttccgggcgcagcccccaaactgttgatatatgacactgataagagaccttcggggatcccagacaggttctcaggaagcaaaagtggcacgtccgcgaccttaggtattacagggctgcagactggagatgaggctgactactattgtggcacctgggatcggtctctaagcgccggcggggtatttggaacaggtaccaaggtgactgtcctc

SEQ ID NO: 24440 - RNA, 333 nt, synthetic construct
  misc_feature 1..333: note = derived and/or modified sequence opt3 from anti-HIV-1_LightChain
  source 1..333: mol_type = other RNA
cagagcgtgctgaccagacccccttccgtctctgccgctccaggccaaaaggttacaatctcatgcagtgggaggagctccaacattggaaataactacgtgtcttggtatcagcagctcccgggtgcagcccccaaacttctgatatacgagaataacaagcggccttcgggcatcccagaccgcttctcagggagcaaaagtggaacttccgcgacgttgggcattaccggtttacagacaggggatgaagctgactattactgtggaacttgggattctagcctgtccgccggcggcgtatttgggaccggaacaaaggtgaccgtccta

SEQ ID NO: 24441 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaaggttacaatctcatgcagtgggactattagcaacataggagcaaatctcgtgtcctggtacagacagcttccgggtacggtacccaccgtgctgatccacgagaacaataaaaggccttctggcattccagaccggttctcggggtcaaagagcggaacaagtgccactttgggcatcaccggtttacagacaggggatgaagcggactattactgtggaacctggcattcctctctgagcgctggcggcgtctttgggactggaacaaaagtgaccgttcta

SEQ ID NO: 24442 - RNA, 327 nt, synthetic construct
  misc_feature 1..327: note = derived and/or modified sequence opt3 from anti-HIV-1_LightChain
  source 1..327: mol_type = other RNA
cagagcgtgctgacccaacccccttccgtctctgccgctccaggccagaaggttacaatctcatgcagtgggagctcctctaacattggaaataacttcgtgtcgtggtaccagcagctcccgggtactgcacccaaacttctgatatatgagaatacgaagagaccttcaggcatcccagacaggtttagcgggagtaaatccggaacctctgccacattgggcattactggtttacaaaccggggatgaagcggactactattgtggaacatgggatcggagcctgtccgctggcggcgtattcgggaccggaactaaggtgaca

SEQ ID NO: 24443 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaatccccctctgtctcagccgctcctggccagagagttacaatcagttgcagcgggggatcctctaacattggttcgaatgcagtgtcatggtaccagcagctcccaggcactgccccgaaacttctgatatatggggacacgatgaggcccagcggaatccctgatcggttcagtggctccaagtctggtaccagcgcgacattggggattactggattacaaaccggcgacgaggctgattactattgtggcacatgggaccgctccctgtcagccgggggagtatttggtaccggcactaaggtgacagtccta

SEQ ID NO: 24444 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagcaggttacaatctcatgcagtgggactacgagcaacattggaaccaattacgtgtcctggtatcagcaaatgccgcccgcagcccctaagctccttatatacgacaacaaaaagagaccatctgatatccccgacaggttctcgggttcaaaaagcggcacaagtgcgactctggggattaccggattgcagacaggcgatgaggctgactattactgtggtacctgggatcggtccttatctgccgggggagtatttggcactggcacaaaggtgaccgtcctg

SEQ ID NO: 24445 - RNA, 333 nt, synthetic construct
  misc_feature 1..333: note = derived and/or modified sequence opt3 from anti-HIV-1_LightChain
  source 1..333: mol_type = other RNA
cagagcgtggtcacccaatccccctctgcctcaggcacacctgggcagagagttatcattagttgcagcggatcctcttcgaacataggtaatatctacgtgtcatggtatcagcagctgccaggcactgctccgaagctccttatttacgagaacaataaaaggcccagcgggatccctgaccggttcagtggatccaagtctggcacgagcgcaaccctgggtattacagggttgcaaactggagatgaagccgactattactgtggcacctggcactcctcattaagtgcgggcggggtatttggaacaggtaccaaagtgactgtcctg

SEQ ID NO: 24446 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccatgtctgccgctccaggccagaaggtcacaatctcatgcagtgggagcacttccattataggaaacaattacatctcttggtatcagcagctcccgggtacggcacccaaacttctgatttacgaggacaacaagagaccttcgggcatcccagataggttctcagggagcaaaagtggaacctccgccacattgggcattactggtttacaaaccggggacgaagcggattattactgtggaacatgggaccggtctctgagcgctggcggcgtttttgggaccggaactaaggtgacagtacta

SEQ ID NO: 24447 - RNA, 336 nt, synthetic construct
  misc_feature 1..336: note = derived and/or modified sequence opt3 from anti-HIV-1_LightChain
  source 1..336: mol_type = other RNA
cagagcgccctgacccaacccccttccgcttctggctcaagagggcagagtgtgatcattagctgcacaggaacttcctctgacgtcggtgtttacaacctcgtgtcgtggtatcagcagcttccaggcacggcaccgaagctgttgatatacgagaataacaaaaggccctcagggatccctgatcggttcagcggaagtaagtccggcacctctgccacattaggtattactgggctgcaaaccggagacgaagcggattattactgtggcacatggcacagctccctatcagctggcggggtatttggaaccggtactaaagtgacagtcctc

SEQ ID NO: 24448 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccatgtctgccgctccaggccagtcagtcagtatcagctgctccgggtcttcggacaacattgagagaaatcaggttatatggctcagacaggtgccgggagcagcccccacagtacttatcattttcaacaatcggcgcccttcaggtgtgccagatcgatttagcggcagtcgttccgggacttctgcgacgctgggaatcaccggcttgcaaacaggtgacgaagctgattactattgtgggacttgggacaggagcttatccgccggaggcgtcttcggcaccgggacaaaggtgaccgttctg

SEQ ID NO: 24449 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagacagttactatctcatgcagtgggagcttctccaacattgagacgaattacgtgtcttggtatcagcagctcccgggaaccgcacccaaacttctgatatacgaaaacacaaagagaccttcgggtatcccagacaggttttcaggcagcaagagtgggacttccgccaccttgggaattacaggcttacaaaccggtgatgaggcggactattactgtgggacttgggatcggtctctgagcgctggaggcgtattcggcacagggaccaaagtgacggtccta

SEQ ID NO: 24450 - RNA, 333 nt, synthetic construct
  misc_feature 1..333: note = derived and/or modified sequence opt3 from anti-HIV-1_LightChain
  source 1..333: mol_type = other RNA
cagagcctgctcacccaacccccttccgtgtctgccgctccaggccagaaggtcacaatctcatgcagtgggagctcctctaacattggatcgaaatacgtttgttggtatcagcagcttccgggtactgcacccaagctgttgatatacgagaatacgaaaagaccttcaggcatcccagacaggttcagcgggagtaagtccggaacctctgccacattaggcattactggtctgcaaaccggggatgaagcggactattactgcggaacatgggatcggagcctatccgctggcggcgtgtttgggaccggaactaaagtaacagtgctc

SEQ ID NO: 24451 - RNA, 336 nt, synthetic construct
  misc_feature 1..336: note = derived and/or modified sequence opt3 from anti-HIV-1_LightChain
  source 1..336: mol_type = other RNA
cagagcgccctgacccaacccagatccgtgtctggctcacctgggcagagtgtcacaatcagctgcactggaacgacctccgacgttggtggctacaactatgtgtcttggtaccagcagctcccagggacagctccgaaacttctgatttatgagaataacaagaggccctcgggaatacctgatcggttctcaggcagcaagagtggtacttccgcaaccttggggatcacaggattacaaaccggcgacgaagccgattactattgtggcacttgggacaattctctgagcacagggggagtatttggtaccggcacgaaagtgactgtccta

SEQ ID NO: 24452 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagagagttacaatctcatgcactgggttcacgagtaacattggactcaattacgtgagctggtatcagcaggtaccgggtaccacacccaaacttgtgatatttgagaacgacaggcggttcctgggcatccctgatcgcttttccgggtctaagtcgggagcatcagccactttgggcattaccggtttacaaacaggggacgaagcggattactattgtggaacctgggacagcagtctgtccgctggcggcgtcttcgggactggaacaaaggtgaccgttcta

SEQ ID NO: 24453 - RNA, 333 nt, synthetic construct
  misc_feature 1..333: note = derived and/or modified sequence opt3 from anti-HIV-1_LightChain
  source 1..333: mol_type = other RNA
cagagcgtgctggcccaacccccttccgtctctgctgcaccaggccagaaggttaccatctcatgcagtgggagaacaagcaacattggaaataactacgtgtcctggtatcagcagctcccgggtactgcccccaaacttctgatatacgagaataacaagaggccttctggcatcccagaccggttctcggggtcaaaaagcggaacgagtgcgaccttgggcattacaggtttacaaactggggatgaagctgactattactgtggaacctgggatacatccctgtctgccggcggcgtatttgggaccggaactaaggtgacagtccta

SEQ ID NO: 24454 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccacatccgtctctgccgctcctggcagatgggttactgtgtcatgcagtgggacgaggagcaacatcggagaccactccgtatcttggttccagcatctcccaggtgcagccccgaaacttctgatttacgagaataacaagcggccctcgggcatacctgatcgcttttcagggagcaagagtggaacctccgcgacattgggcatcactggtttacagaccggggacgaagctgattattactgtggaacatgggactctagcctgtccaccggcggcgtgttcgggactggaacaaaagtcaccgtgcta

SEQ ID NO: 24455 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaaggttacaatctcatgcagtgggagctcctctaacattggagacaattacgtgtcgtggtatcagcagttcccgggtactgcacccaaactccttatatcagagaacaataagagacctagcggcatcccagataggtttagtgggtccaaatctggaacgagcgccaccctgggcattacaggtttgcaaactggggacgaagcggattactattgtggaacctgggactcctcattaagtgctggcggcgtattcgggacaggaaccaaggtgactgtcctg

SEQ ID NO: 24456 - RNA, 333 nt, synthetic construct
  misc_feature 1..333: note = derived and/or modified sequence opt3 from anti-HIV-1_LightChain
  source 1..333: mol_type = other RNA
caggccctgctcacccaaccccctagcgtgtccgctgcaccaggccagaaggtcacaatctcttgctcagggagtagctccaacattggaaataactacgtttcttggtatcagcagcttccgggtactgcccccaaactgttgatatcggagaataacaagagaccttcaggcatcccagacaggttcagcgggagtaaatccggaacgtctgcgaccttaggcattacaggtctgcaaactggggatgaagctgactactattgtggaacctgggatacaagcctatccgccggcggcgtgtttgggaccggaactaaggtaacagtgctc

SEQ ID NO: 24457 - RNA, 333 nt, synthetic construct
  misc_feature 1..333: note = derived and/or modified sequence opt3 from anti-HIV-1_LightChain
  source 1..333: mol_type = other RNA
cagctggtgctcacccaaccccctagcgcctccggcacaccagggcagagagtcactatctcttgctcaggaagtacgagcaacattggtacctactatgtttactggtatcagcttctgccgggcacaactcccaaggtgttgatatacgctaatgaccagaggccttccgggatcccagatcggttctctggatcgaaatcaggcaccagcgcaacattaggtattaccgggctgcaaactggagacgaggccgattattactgtggcacatgggacagttccctatctaccggcggggtatttggaacgggtactaaggtgaccgtcctc

SEQ ID NO: 24458 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaaggttacaatctcatgcagtgggactagctccaacattggaaataacttcgtgtcttggtaccagagactcccgggtacggcacccaaacttctgatatttgagaatgacaagaggccttcgggcatcccagatcggttctcagggagcaaaagtggaacctccgccacattgggcattactggtttacagaccggggacgaagcggattattactgtggaacatgggaccgctctctgagcgctggcggcgtatttgggaccggaactaaggtgacagtccta

SEQ ID NO: 24459 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaatccccctctgtctcagccacacctggccagagagttactatcagttgcagcgggaacacgtccaatattggaaagaacttcgtgtcttggtaccagcagtttccaggtaccgctccgaaactccttatatatgacaatgataagaggccctcgggcatccctgaccggttctcagggagcaaaagtggaacatccgcaactctgggcattaccggtttgcaaacaggggatgaggccgactactattgtggaacctgggattctagcttatccgcgggcggcgtatttgggactggaacaaaggtgaccgtcctg

SEQ ID NO: 24460 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggcagagaggttatcatttcatgcagtgggagctcctctaacataggaaataaccacgtgtcgtggtaccagcagctcccgggtacagcacccaaggtacttatctatgaatcaaataaaaggcatagcggcattcctgaccggttcagtgggtccaagtctggaactagcgccacgctggcgatcaccggcttgcagacaggtgatgaggctgactactattgtggggcctgggattcctcattaagtgcaggaggcgtgtttggcactgggaccaaagtcacagtgctg

SEQ ID NO: 24461 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgcctctggcacaccagggcagagagtcactatctcatgcagtggaagctcctctaacattggtgactcgacggttaattggtaccagcagctcccgggcaccgctcccaaacttctgatatatgagaacacaaagaggccttcagggatcccagatcggttcagcggaagtaagtccggcacttctgcaaccttgggtattacagggttacaaaccggagacgaagccgattactattgtggcacttgggaccgcagcctgtccgcgggcggggtgtttggaacaggtaccaaagtaacggtgcta

SEQ ID NO: 24462 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaaggttacaatctcatgcagtgggagcacttccaacattggaaataactacgtgtcttggtatcagcagctcccgggtacggcacccaaacttctgatatacgagaataacagacaaccttcgggcatcccagacaggttctcagggagcaagagtggaacctccgccacattgggcattactggtttacagaccggggatgaaggagactattactgtggcacatgggatcggtctctgagcgcgggcggggtatttggaaccggtactaaagtgacagtccta

SEQ ID NO: 24463 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaaggttacaatctcatgcagtgggagctcctctaacattggatcgaattacgtgtcatggtatcagcagctcccgggtactgcacccaaacttctgatatacgagaacaataagagacctagcggcatcccagacaggttcagtgggtccaaatctggaacgagcgccaccttgggcattacaggtttacaaactggggatgaagcggtatattactgtggaacctgggactcctcactgacagctggcggcgtgtttgggagtggaaccaaggtcactgtgcta

SEQ ID NO: 24464 - RNA, 336 nt, synthetic construct
  misc_feature 1..336: note = derived and/or modified sequence opt3 from anti-HIV-1_LightChain
  source 1..336: mol_type = other RNA
cagagcgtgctgacccaacccccttccgtctctggcgccccagggcagagagttacaatctcatgcattggaagtagctccaacataggtgctgactacagggtgcactggtatcagcagctcccgggcactgcacccaaacttctgatctacgagaataacaagcggccttctgggattccagatcgcttctcgggatcaaagagcggcacgagtgccaccttgggtatcacagggttacaaactggagacgaagcggattattactgtggcacctgggactcctctctgagcacaggcggggtatttggaaccggtactaaagtgacagtccta

SEQ ID NO: 24465 - RNA, 336 nt, synthetic construct
  misc_feature 1..336: note = derived and/or modified sequence opt3 from anti-HIV-1_LightChain
  source 1..336: mol_type = other RNA
cagagcgtgctgacccaacccccttccgtctctggcgccccagggcagagaatcacagtttcatgcactggaacgagtagcaacattggtgctccgtacgacgtgaattggtatcagcagctccccggcaccgcacctaaacttctgatatacgagaacacaaagaggccatccgggatccccgatcggttctctggatcgaagtcaggcactagcgccaccttgggtattacagggttacaaaccggagacgaagcggattattactgtggcacttgggaccgcagtctgtccgctggcggggtatttggaacaggtaccaaagtgacggtccta

SEQ ID NO: 24466 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaaccccctgccatgtccgctgcaccaggccagtctgtcacaatctcatgcagtgggagcgccttcaacattgagagacaccaggttacttggctcaggcatcttccgggaacggcgcccacctccgtgataatcatgaataaccagcggccttctggtgtaccagaccgcttttcgggctcacgaagcgggacaagtgctactctgggaattaccggcttgcaaacaggtgatgaaggggactactattgtggaacctgggatcgttccttatctgccggcggcgtgttcgggactggaacaaaggtcaccgtgctg

SEQ ID NO: 24467 - RNA, 333 nt, synthetic construct
  misc_feature 1..333: note = derived and/or modified sequence opt3 from anti-HIV-1_LightChain
  source 1..333: mol_type = other RNA
cagagcgtgctggcccaacccccttccgcttctggcaccccagggcagagagtcacaatctcatgcagtggaagcgcatccaacattggtttcaattctgttacttggtaccagcagctcccgggcacggcccccaccgtgcttatatatgggaacgacctgaggccttcgggaatcccagatcggttttcaggcagcaagagtggtacatccgcgactttggggattaccggattacaaacaggcgacgagggcgattactattgtgggacctgggaccgctctctgagcgctggaggtgtattcggcactgggacaaaagtgaccgtccta

SEQ ID NO: 24468 - RNA, 336 nt, synthetic construct
  misc_feature 1..336: note = derived and/or modified sequence opt3 from anti-HIV-1_LightChain
  source 1..336: mol_type = other RNA
cagagcgccctgacccaacccgcttccgtgtctggctcacctggggagagtatcacaattagctgcactggaacgagatccgacataggtaactacgcatatgtctcttggtaccagcagctcccaggcaccgccccgaaacttctgatctcggaaaataacaagaggccctcagggattcctgatcggttcagcggaagtaagtccggcacatctgcgactttgggtatcaccgggttacagacaggagacgaggctgattattactgtggcacctgggacagctccctgtcagccggcggggtttttggaactggtacaaaagtgaccgtacta

SEQ ID NO: 24469 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccccaccgggccagaaggttacaatctcatgcagtgggactacgagcaacattggatccaattacgtggcttggtatcagcagctccccggtaccgcacctaaacttctgatatacgacaacgataagagaccatctggcatccccgacaggttctcggggtcaaaaagcggaacaagtgccactttgggcattaccggtttacaaacaggggatgaggcggactattactgtggaacctgggatcggtccctgtctgctggcggcgtatttgggactggaacaaaggtgaccgtccta

SEQ ID NO: 24470 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaatccccctctgtctcaggcacacctgggcagagagttactatcttctgcagtggaagcgactccgatattggtataaactctgtgtcgtggtaccagcagctcccaggcacggccccgaaacttctgatctatgacaataacaagaggccctcagggattcctgatcggtttagcggaagtaagtccggcacctctgctacattgggtatcactgggttacaaaccggagacgaggcagattactattgtggcacatgggaccgcagcctgtccgccggcggggtattcggaaccggtactaaagtgacagtccta

SEQ ID NO: 24471 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaaggttacaatctcatgcagtgggaacagctccaatattggaaacaattacgtgtcttggtatcagcacctcccgggtactgcacccaaacttctgatatacgagaacacgaagagaccttcgggcatcccagacaggttctcagggagcaaaagtggaacctccgccacattgggcattactggtttacagaccggggatgaagcggactattactgtggaacatgggatcggtctctgagcgctggcggcgtatttgggaccggaactaaggtgacagtccta

SEQ ID NO: 24472 - RNA, 333 nt, synthetic construct
  misc_feature 1..333: note = derived and/or modified sequence opt3 from anti-HIV-1_LightChain
  source 1..333: mol_type = other RNA
cagagcctgctcacccaacccccttccgtgtctgccgctccaggccagaaggtcacaatctcatgcagtgggggaaacagcgacattggtaaaaatttcgtttcctggtaccagcagcttccgggcactgcacccaagctgttgatatatgagaacaataaaagaccttctgggatcccagataggttttcgggatcaaagagcggcacgagtgccaccttaggtattacagggctgcaaactggagacgaagcggattactattgtggcacctgggacaactccctatctacaggcggggtgttcggaaccggtactaaagtaacagtgctc

SEQ ID NO: 24473 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaaggttatcatttcatgcagtgggagctcctctaacataggaaagaattacgtggcatggtatcagcagctcccgggtacagcccccaaacttctggtatacgagaacactaatagaccttcgggcatcccagacaggttctcagggagcaaaagtggaacgtccgcgaccttgggcattacaggtttacaaactggggatgaagctgactattactgtggaacctgggattctagcctgtccgccggcggcgtgtttgggacaggaaccaaggtcactgtgcta

SEQ ID NO: 24474 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaaggttacaatctcatgcagtgggagcatgtccgacattggactcaacccggtgtcttggtacagacagcttcccgaggcacctccacacctgttgatattcgataatgacgaaaggccctcgggtactgccggccggttttcagcgagcaaaagtgggacgtccgctaccttagatatcacaggactgcagactggcgacgaggccgattattactgtggtacctgggactctagcctatccgcagggggagtattcggcacaggcaccaaggtgactgtcctc

SEQ ID NO: 24475 - RNA, 336 nt, synthetic construct
  misc_feature 1..336: note = derived and/or modified sequence opt3 from anti-HIV-1_LightChain
  source 1..336: mol_type = other RNA
cagagcgccctgacccaacccgcttccgtgtctggctcacctgggcagagtatcacaattagctgcactggaacgtcctctgacgtcggttcgtacaacctcgtttcatggtatcagcagtacccaggcagagcaccgaaacttctgatatatgagaataacaagaggcccagcgggatccctgatcggttcagtggatccaagtctggcaccagcgccacattgggtattactgggttacaaaccggagacgaagcggattactattgtggcacatgggacaattccctgtcaaccggcggggtgtttggaactggtacaaaagtaaccgtgcta

SEQ ID NO: 24476 - RNA, 333 nt, synthetic construct
  misc_feature 1..333: note = derived and/or modified sequence opt3 from anti-HIV-1_LightChain
  source 1..333: mol_type = other RNA
cagagcctgctcacccaacccccttccgtgtctgcctcaccaggccagaaggtcacaatcagttgcagcgggacttcctctaacattggaaataactacgtttcgtggtatcagcagttcccgggtacggctcccaaacttctgatatacgagaataacaagagatcaagcggcatccctgacaggtttagtgggtccaaatctgataccagcgcaacattgggaattactggcttacaaaccggtgacgaagccgattattactgtgggacatgggaccggtccctgtcagcgggaggcgtgttcggcaccgggactaaggtaacagtgcta

SEQ ID NO: 24477 - RNA, 336 nt, synthetic construct
  misc_feature 1..336: note = derived and/or modified sequence opt3 from anti-HIV-1_LightChain
  source 1..336: mol_type = other RNA
cagagcgtgctgacccaacccccttccgtctctggcgccccagggcagagagttacaatctcatgcactggaaggcggagtaacattggtgctggctacgacgtgcactggtatcagcagctcccggggacggcacccaaacttctgatatacgagaataacaagcgccctagcggaatcccagatcgattctccggctctaagtcgggtacctcagccacattggggattactggattacaaaccggcgacgaagcggattattactgtggcacatgggacaccagcctgagtgctgggggagtatttggtactggcacaaaagtgaccgtccta

SEQ ID NO: 24478 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagagagttacaatctcatgcagtgggagctcctctaacattggaaataacttcgtgtcgtggtaccagtttttcccgggtactgcacccaagctcgtaatatatgagaatgacaaaaggccttcaggcacgccagatcggtttagcgggagtaagtccggaacctctgccacacttgcgatcattggcctgcagactggtgacgaaggggattactattgtggaacctgggacaacagcttgtccacaggcggcgtgttcgggaccggaactaaagtcacagtgtta

SEQ ID NO: 24479 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagagagttacaatctcatgcagtgggggaagctccaacattggtaataaccacgtgtcttggtaccagcagctcccgggcactgcacccaaacttctgatatcggagaataacaagaggccttcagggatcccagaccggttcagcggaagtaagtccggcacgtctgccaccttgggtattacagggttacaaactggagatgaagcggactattactgtggcacctgggatagctccctgtcagctggcggggtatttggaacaggtaccaaagtgactgtccta

SEQ ID NO: 24480 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaaggttacaatctcatgcagtgggagctcctctaacattggaagagacttcgtgtcgtggtaccagcaggtaccgggtactgcacccaaactccttatatatgataatgacaagaggccttcaggcatcccagatcggtttagcgggagtaaatccggaacgtctgccaccctgggcattacaggtttgcaaactggggacgaggcggattactattgtggaacctgggacagctccttatcagctggcggcgtgttcgggacaggaaccaaggtcactgtgctg

SEQ ID NO: 24481 - RNA, 336 nt, synthetic construct
  misc_feature 1..336: note = derived and/or modified sequence opt3 from anti-HIV-1_LightChain
  source 1..336: mol_type = other RNA
cagaccgtggtcacacaaccccctagcgtttccggcgccccagggcagactgctacgatctcttgcaccggatcaagtagcaacattggtgcagactacgatgtgcactggtatcagcagctgccgggcacagcccccaagctccttatatacgacaataacaaaagaccttccgggatcccagataggttctctggatcgaagtcaggcactagcgcgaccctgggtattacagggttgcaaaccggagacgaggctgattattactgtggcacttgggaccggagtttatccgccggcggggtatttggaacaggtaccaaagtgacggtcctg

SEQ ID NO: 24482 - RNA, 333 nt, synthetic construct
  misc_feature 1..333: note = derived and/or modified sequence opt3 from anti-HIV-1_LightChain
  source 1..333: mol_type = other RNA
aacttcatgctgacccagccccctagcgcctccggcacaccagggcaaagagtgactatctcttgctcaggaagtagctccaatattggttctaactacgtctattggtaccagcagctcccgggcacgacccccaaacttctgatatataggaataaccagcggccttcggggatcccagaccgcttttcaggaagcaagagtggcacatccgctactttgggtattaccgggttacaaacaggagatgaggcagactactattgtggcacctgggattctagcctgtccgccggcggggttttcggaactggtacaaaggtgaccgtacta

SEQ ID NO: 24483 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaaggttacaatctcatgcagtgggagctccccgaacattggaaataacttcctctcttggtaccagcagcttcccggtactgcacctaaactgttgatatatgagaatacgaagagaccatcgggcatccccgacaggttttcagggagcaaaagtggaacctccgccacattaggcattactggtctgcaaaccggggatgaagcggactactattgtggaacatgggatcggtctctaagcgctggcggcgtgttcgggaccggaactaaggtaacagtgctc

SEQ ID NO: 24484 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaatccccctctgtctcagccgctcctggccagaaggttacaatcagttgcagcgggtcctcttcggacattggaaacaatttcgtgtcatggtaccagcagctcccaggtactgcaccgaaacttctgatatatgagaacaataagagacccagcggcatccctgataggtttagtgggtccaaatctggaacgagcgccaccttgggcattacaggtttacaaactggggacgaagcggattactattgtggaacctgggactcctcactgagtgctggcggcgtattcgggacaggaaccaaggtgactgtccta

SEQ ID NO: 24485 - RNA, 333 nt, synthetic construct
  misc_feature 1..333: note = derived and/or modified sequence opt3 from anti-HIV-1_LightChain
  source 1..333: mol_type = other RNA
cagttctttctgacccaaccccctagcctctccgccacaccaggccagagagtgtctatctcatgcagtgggggaggtagcaacattgctaataacgacgtcttctggtttcagcagttcccgggcgcagggcccaggcttctgatatacgataatttgaagcggcactatggaactcctgaccgcttttccggctctaaatcgggtacgtcagccaccttagggatcacaggactgcaaactggcgatgaggcggactactattgtggcacctgggataacagcctaagtacagggggagttttcggtaccggcactaaggtgacagtactc

SEQ ID NO: 24486 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaaggttacaatctcatgcagtgggagcggaccgaacattggttccaattctgtgtcgtggtaccagcacttccccggcactgcacctaaactccttatatatgacaacaataagagaccatcagggatccccgataggtttagcggaagtaaatccggcacgtctgccaccctgggtattacagggttgcagactggagacgaggcggattactattgtggcacctgggaccggagcttatccgctggcggggtattcggaacaggtaccaaggtgactgtcctg

SEQ ID NO: 24487 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaatccccctctgcctcaggcacacctgggcagagagtcactatcagttgcagcggatcctcttcgaacattggttcaaatacggttagctggttccagcacctcccaggcaccgctccgaaacttctgatatacgagaacaataagaggcccagtgggatccctgaccggttttccggatctaagagcggcacatccgcaactttgggtattaccgggttacagacaggagatgaagccgactattactgtggcacctggcattcaagtctgagcgcgggcggggtgttcggaactggtacaaaagtaaccgtgcta

SEQ ID NO: 24488 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctggcgccccagggcagaacgttatcatttcatgcagtggaagctcctctaatataggtaagaactacgtggcttggtatcagcagctcccgggcacagcacccaaaatcgtaatttacgagactacgaatagaccttcggggatcccagccaggttctcaggaagcaagagtggcacctccgcgacacttggtattactgggctgcaagctggagacgaagccgattattactgtggcacctgggactctagcttgaacgcaggcggggtgtttggaacaggtaccaaagtcactgtgtta

SEQ ID NO: 24489 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaaggttacaatctcatgcagtgggagctcctctaacattggaaataacttcctctcgtggtaccagcaccttccgggtactgcacccagactgttgatatatgacaatgatcagaggccttcaggcatcccagaccggtttagcgggagtaaatccggaacgtctgccaccttaggcattacaggtctgcaaactggggatgaggcggactactattgtggaacctggcatagctccctatcagctggcggcgtgttcgggacaggaaccaaggtaactgtgctc

SEQ ID NO: 24490 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgcctctggcacaccagggcagaaggtcactatctcatgcagtggaagctcctctaacattggtaataactacgtttcgtggtatcagcagctcccgggcacggctcccaaacttctgatatacgagaataacaagagaccttcagggatcccagacaggttcagcggaagtaaatccggcacctctgcaacattgggtattactgggttacaaaccggagatgaagccgactattactgtggcacatgggatagctccctgtcaaccggcggggtgtttggaactggtacaaaggtaaccgtgcta

SEQ ID NO: 24491 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaaggttacaatctcatgcagtgggactacgagcaacattggaaatcactacgtgtcctggtatcagcagttcccgggtaccgcacccaaactcataatctacgagacagacagaaggccttctggcattccagcccggttttcggggtcaaagagcggaaccagtgcgactcttgctatcgccggcctgcaaacaggtgatgaagcagactattactgtgggacctgggattcctctttgagcactggaggcgtattcggcacagggaccaaagtgacggtctta

SEQ ID NO: 24492 - RNA, 333 nt, synthetic construct
  misc_feature 1..333: note = derived and/or modified sequence opt3 from anti-HIV-1_LightChain
  source 1..333: mol_type = other RNA
cagctggtgctcacccaaccccctagcgtctccgccgctccaggccagaaggttacaatctcttgctcagggagtagctccaacattggaaataactacgtgtcttggtatcagcagcttccgggtactgcacccaaactgttgatatacgagaataacaagagaccttcgggcatcccagacaggttctcagggagcaaaagtggaacgtccgccaccttaggcattacaggtctgcaaactggggatgaagcggactattactgtggaacctgggattctagcctatccacaggcggcgtatttgggaccggaactaaggtgacagtcctc

SEQ ID NO: 24493 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagagagttacaatctcatgcagtgggggaagctccaacattggtaataaccacgtgtcttggtaccagcatctcccgggcagggcaccccagcttctgatatatgacactacgcaacggccttcgcgcatcccagatcgattctcagggagcaagagtggaacctccgccacattgggcattactggtttacagaccggggacgaggcggattactattgtggaacatgggacaattctctgagcaccggcggcgtatttgggactggaacaaaagtgaccgtccta

SEQ ID NO: 24494 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaagatcacaatttcatgcagtgggagcagatccaacataggaaataactacgtttcttggtatcagcagttcccgggtactgcacccaaactccttatctacgacaataaccaaaggccttcgcggattccagatcgcttttcaggcagcaagagtgggacgtccgccaccctgggaatcacaggcttgcagactggtgacgaggcggattattactgtgggacctgggactctagcttatccgctggaggcgtgttcggcacagggaccaaagtaactgtgctg

SEQ ID NO: 24495 - RNA, 321 nt, synthetic construct
  misc_feature 1..321: note = derived and/or modified sequence opt3 from anti-HIV-1_LightChain
  source 1..321: mol_type = other RNA
cagagcgtgctgacccaacccccttccgtctctgccgctccaggccagagagttacaatctcatgcttcgggagtaggtttagctccgtgtcttggtaccagcagctcccgggaactgcacccaaacttctgatttatcctaacggtgagcggccatcgggcatacccgaccgcttctttgggtcagaaagcggaacgagtgccaccttgggcatcacaggtttacaaactggggatgaggcggactactattgtgctacctgggattcctctctgagcgccggaggcgtattcggcacagggaccaagctaactgtgctc

SEQ ID NO: 24496 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccctctctgccgctccaggccagaaggtcacaatctcatgcagtgggagctcccttaacattggaaatcactacgtttcttggtatcaacaggtgccgggtactgcacccaaactgttgatatacgaggacaacaagagaccttcgggcatcccagataggttctcagggagcaaaagtggaacgtccgccaccttaggcattacaggtctgcagactggggacgaagcggattattactgtggaacctggcattctagcctatccgctggcggcgtatttgggacaggaaccaaggtgactgtcctc

SEQ ID NO: 24497 - RNA, 333 nt, synthetic construct
  misc_feature 1..333: note = derived and/or modified sequence opt3 from anti-HIV-1_LightChain
  source 1..333: mol_type = other RNA
cagttcgtgctgacccaaccccctagcgtctccgccgctccaggccagaaggttacagtgtcttgctcagggactacgagtgacatcggagagaactacgtaagctggtatcagaaatttccggaagcagcccccaagctccttatttacgataatgacaaaagaccttccggtataccagataggttctctggctcgaagtcagggaccagcgcgacactgggaatcactggcttgcagaccggtgacgaggctgattattactgtgggacatgggaccggagtttatccgccggaggcgtgtttggcaccgggactaaagtcacagtgctg

SEQ ID NO: 24498 - RNA, 333 nt, synthetic construct
  misc_feature 1..333: note = derived and/or modified sequence opt3 from anti-HIV-1_LightChain
  source 1..333: mol_type = other RNA
ctgagcgtgctcacccagcccccttccgtctctgccgctccaggccaacaggttacaatctcatgcagtgggactacgagcaacattggaaccaattacgtgtcctggtatcagcagatgccgcccacagcacctaaacttctgatatacgagaacaataagagaccatctggtatccccgacaggttctcgggctcaaagagcgggaccagtgccactttgggaattacaggcttacaaaccggtgatgaagcggactattactgtgggacttgggattcctctctgagcgctggaggcgtatttggcacagggaccaaagtgacggtccta

SEQ ID NO: 24499 - RNA, 336 nt, synthetic construct
  misc_feature 1..336: note = derived and/or modified sequence opt3 from anti-HIV-1_LightChain
  source 1..336: mol_type = other RNA
cagagcatgctgacccaacccccttccgtgtctggcgccccagggcagagagtcacaatctcatgcactggaagtaggagcaacattggtgctggctacgacgttcactggtatctccagcttccggggacggcacccaagctgttgatatacgagaataacaaacggccttccggaatcccagatcgcttctctggctcgaagtcaggtaccagcgccacattagggattactggactgcagaccggcgacgaagcggattattactgtggcacatgggacaatagtctatccaccgggggagtgtttggtactggcacaaaagtaaccgtgctc

SEQ ID NO: 24500 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccacaccaggccagaaggttactatctcatgcagtgggagcagatccaacattggatctcactacgtgtcgtggtatcagcagttcccggagtcagctcccacgctccttatatacgaaaatgtagagaggcctagcggtatcccagaccggtttagtggctccaaatctgggaccagcgcaacactgggaattactggcttgcaaaccggtgatgaagccgactattactgtgggacatgggattcctcattaagtgcgggaggcgtgttcggcaccgggactaaggtcacagtgctg

SEQ ID NO: 24501 - RNA, 333 nt, synthetic construct
  misc_feature 1..333: note = derived and/or modified sequence opt3 from anti-HIV-1_LightChain
  source 1..333: mol_type = other RNA
cagttctttctgacccaaccccctagcctctccgccacaccaggccagagagtgtctatctcatgcagtgggggaggtagcaacattgctaataacgacgtcttctggtttcagcagttcccgggcgcagggcccaggcttctgatatacgataatttgaagcggcactatggaactcctgaccgcttttccggctctaaatcgggtgccacggggaccttagagatcacagaagttcaaactgcggatgaggctgactactattgtggaacctgggattcaagcctgagtgccggcggcgtgttcgggacaggaaccaaggtaactgtgcta

SEQ ID NO: 24502 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaaggttacaatctcatgcagtgggggaagctccaacattggtgacaattctgtgtcgtggtaccagcagctcccgggcactgcacccaaacttctgatatatgagaacaataagagaccttcagggatcccagataggttcagcggaagtaaatccggcacgtctgccaccttgggtattacagggttacaaactggagacgaagcggattactattgtggcacctgggacagctccctgtcaacaggcggggtatttggaaccggtactaaggtgacagtccta

SEQ ID NO: 24503 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagacagttactatctcatgcagtgggagcgcatccaacattggaagaaattctgtgtcgtggtaccagtatgtaccgggtgccgcgcccaagaggctcatatacgagaacaataaacggccttcaggcatcccagaccgcttcagcgggagtaagtccggaacgtctgctacccttggcattacaggtctgcagactggggatgaagccgactattactgtggaacctgggataccagcttgtccgcaggcggcgtgtttgggacaggaactaaagtcacagtgtta

SEQ ID NO: 24504 - RNA, 333 nt, synthetic construct
  misc_feature 1..333: note = derived and/or modified sequence opt3 from anti-HIV-1_LightChain
  source 1..333: mol_type = other RNA
cagagcgtgctggcccaacccccttccgtctctgctgcaccaggccagaaggttaccatctcatgcagtgggagaacaagcaacattggaaattacttcgtgtcctggtatcagcagtttccgggtactgcccccaggctccttatatacgacaacgatcaacggccttctggcatcccagaccgcttctcggggtcaaaaagcggaacgagtgcgaccctgggcattacaggtttgcagactggggatgaggctgactattactgtggaacctgggattcctctttaagcgccggcggcgtatttgggacaggaaccaaggtgactgtcctg

SEQ ID NO: 24505 - RNA, 333 nt, synthetic construct
  misc_feature 1..333: note = derived and/or modified sequence opt3 from anti-HIV-1_LightChain
  source 1..333: mol_type = other RNA
cagagcgccctgacccaacccgcttccgtgtctgcagcccctggccagaaggtcacaatctcatgcagtgggagctcctctaacattggaaatatatacgtttcgtggtatcagcagctcccaggtactgcgccgaaacttctgatctacgagaacaataagagaccctcaggcattcctgacaggttcagcgggagtaaatccggaacgtctgctaccttgggcatcacaggtttacaaactggggatgaagccgactattactgtggaacctggcacagctccctgtcagcaggcggcgtgtttgggacaggaaccaaggtaactgtgcta

SEQ ID NO: 24506 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccacaccaggccagagagttactgtgtcatgcagtgggagctcctctaacatcggaaatcactacgtatcgtggtatcaacaggtgccgggtacggctcccaagctccttatttacgacaactcaaataggcctagcggcataccagatcggttcagtgggtccaaatctggaaccagcgcaacactgggcatcactggtttgcagaccggggacgaggccgattattactgtggaacatgggactcctcattaagtgcgggcggcgtctttgggaccggaactaaggtgacagttctg

SEQ ID NO: 24507 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccctctctgccgctccaggccagagagtcacagtttcatgcagtgggagctcctctaacatcggagacaattacgtgtcgtggtatcagcagcttccgggtgcagcccccaggctgttgatttacgataactcaatacggcctagcgcgatcccagctcgcttcagtggctccaagtctgggactagcgccacgttagcaattaccggactgcaaacaggcgacgaggccgattattactgtggtacttgggactcctcactaagtgctgggggagtatttggcaccggcacaaaagtgaccgtcctc

SEQ ID NO: 24508 - RNA, 336 nt, synthetic construct
  misc_feature 1..336: note = derived and/or modified sequence opt3 from anti-HIV-1_LightChain
  source 1..336: mol_type = other RNA
cagagcgccctgacccaacccgcttccgtgtctggctcacctgggcagagtatcacaattagctgcactggaacgtcctctgacgtcggtggctacgattatgtttcgtggtacctccagcttccagggaccgcaccgaagctgttgatatatgagaacaataaaagaccctcaggaatccctgacaggttcagcggcagtaagtccggtacatctgccactttagggattaccggactgcagacaggcgatgaagcggactactattgtggcacctgggatagctccctatcagctgggggagtgtttggtactggcacaaaagtaaccgtgctc

SEQ ID NO: 24509 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagagagttacagtgtcatgcagtgggagctcctctaacatcggaaataactacgtatcgtggtatcagcagttcccgggtactgcacccaagctcgtgatttacgacacggataaaaggccttcaggcataccagaccggtttagcgggagtaagtccggaacctctgccacacttggcatcactggtctgcaaaccggggatgaggcggactattactgtgctacatgggatagctccttgtcagccggaggcgtcttcggcaccgggactaaagtgacagtttta

SEQ ID NO: 24510 - RNA, 336 nt, synthetic construct
  misc_feature 1..336: note = derived and/or modified sequence opt3 from anti-HIV-1_LightChain
  source 1..336: mol_type = other RNA
cagagcgtgctgacccaacccccttccgtctctggcgccccagggcagagagttacaatctcatgcactggaaacagtagcaatattggtgctggctacgacgtgcactggtatcagcagctcccggggacggcacccaaacttctgatatccgagaacaataagaggccttctggaatcccagatcggttctcgggctcaaagagcggtaccagtgccacattggggattactggattacaaaccggcgacgaagcggattactattgtggcacatgggactcctctctgagcgctgggggagtatttggtaccggcactaaagtgacagtccta

SEQ ID NO: 24511 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgcctctggcacaccagggcagagagtcactatctcatgcagtggaagctcctctaacattggttcgaattacgttgactggtatcagcagctcccgggcacggctcccaaacttctgatatacgagaacaataagaggccttcagggatcccagatcggttcagcggaagtaagtccggcacctctgcaacattgggtattactgggttacaaaccggagacgaagccgattattactgtggcacatggcacagctccctgtcagcgggcggggtgtttggaaccggtactaaagtaacagtgcta

SEQ ID NO: 24512 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccacaccaggccagactgttacgatctcatgcagtgggagctcctctaacattggaaataactacctctcgtggtatagacagcttccgaggaccgctcccaagctgttgatatacgagaataaccggcgcccttcaggtgtgccagcacgattcagcggcagtaaatccgggacatctgccactttagcgatcaccggactgcagacaggcgacgaagctgattattactgtggtacctgggacagctccctatcagccgggggagtatttggcactggcacaaaggtgaccgtcctc

SEQ ID NO: 24513 - RNA, 321 nt, synthetic construct
  misc_feature 1..321: note = derived and/or modified sequence opt3 from anti-HIV-1_LightChain
  source 1..321: mol_type = other RNA
cagagcgtgctgacccaacccccttccgtctctgccgctccaggccagagagttacaatctcatgcttcgggagtaggtttagctccgtgtcttggtaccagcagctcccgggaactgcacccaaacttctgatttatcctaacggtgagcggccatcgggcatacccgaccgcttctttgggtcagaaagcggaacgagtgccaccttgggcatcacagcggtacaaactggtgatgaggctgactactattgtgggacctgggatgactccttatctacaggaggcgtgttcggcaccgggactaaggtcacagtgctg

SEQ ID NO: 24514 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaaggttacactctcatgcagtgggactagctccaacatcggaaataactacgtgtcttggtatcagcaggtaccgggtgcagcccccaaagtgcttatttacgagaatgacaagagaccttcgggcataccagataggttctcagggagcaaaagtggaacgtccgcgaccctgggcatcacaggtttgcaaactggggacgaagctgattattactgtggaacctgggaccggtctttaagcgccggcggcgtctttgggacaggaaccaaggtgactgttctg

SEQ ID NO: 24515 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaaggttacaatctcatgcagtgggagcaactccaatattggaaacaattacgtgtcttggtatcagcagctcccgggtactgcaacgaaacttctgatatacgagaacgacaagagaccctcgggcatccctgataggttctcagggagcaaaagtggaacctccgccacattgggcattactggtttacaaaccggggacgaagcggattattactgtggaacatggcactctagcctgtccgctggcggcgtatttgggaccggaactaaggtgacagtccta

SEQ ID NO: 24516 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccctctctgccgctccaggccagcaggtctcaatcagttgccttgggagaagctccaacattggaacaaattacgtttcttggtatcagcaattcccgggtactgcacccaagctgttgatatacgagaacaaaaagaggccttcggaaatcccagaccggttttcaggcagcaaaagtgggacgtccgccaccttaggaattacaggcctgcagcccggtgatgaggcggactattactgtgggacttgggattctagcctatccgctggaggcgtgttcggcaccgggacaaaggtaaccgtgctc

SEQ ID NO: 24517 - RNA, 336 nt, synthetic construct
  misc_feature 1..336: note = derived and/or modified sequence opt3 from anti-HIV-1_LightChain
  source 1..336: mol_type = other RNA
cagagcgccctgacccaacccccttccgcttctggctcaccagggcagagtgtgacaatcagctgcactggaacgtcctctgacgtcggtgcatacaactcggtttcatggtatcagcagctcccgggcaccgcccccaaacttctgattagcgagaataacaagagacctagtgggataccagataggttctccggatctaagagcggcacatccgcgactttgggtatcaccgggttacaaacaggagacgaagctgattactattgtggcacctgggactcaagtctgagcgccggcggggtgtttggaactggtacaaaagtaaccgtgcta

SEQ ID NO: 24518 - RNA, 333 nt, synthetic construct
  misc_feature 1..333: note = derived and/or modified sequence opt3 from anti-HIV-1_LightChain
  source 1..333: mol_type = other RNA
cagagcgccctgacccaacccccttccgcttctggctcaccagggcagagtgtgacaatcagctgctccggaggttcttcgaacattggcaataaccacgtctcatggtaccagcatctcccggggagagcaccccagcttctgatatatgacactacgcaaaggcctagccggatcccagatcgcttcagtggatcccgatctggcaccagcgccacattggcgattactggtttacagaccggggacgaggctgtttactattgtggaacatgggataattccctgtcaaccggcggcgtgtttgggactggaacaaaggtaaccgtgcta

SEQ ID NO: 24519 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagagagttacaatctcatgcagtgggggaactagcaacattggtaatgagtacgtgtcctggtatcagcagctcccgggcacggcacccaaacttctgatatacgaaaacaataagaggccttctgggatcccagaccggttctcgggatcaaagagcggcaccagtgccacattgggtattactgggttacaaaccggagatgaggcggactattactgtggcacatgggattcctctctgagcgctggcggggtatttggaaccggtactaaagtgacagtccta

SEQ ID NO: 24520 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagagagttacagtgtcatgcagtgggagctcctctaacatcggaaataactacgtatcgtggtatcagcagctcccgggtgcagcccccaaacttctgatttacgacactgataagaggccttcaggcataccagaccggttcagcgggagtaagtccggaacgtctgcgaccttgggcatcacaggtttacaaactggggatgaggctgactattactgtggaacctgggatcgcagcctgtccgccggcggcgtgtttgggacaggaaccaaagtcactgtgcta

SEQ ID NO: 24521 - RNA, 333 nt, synthetic construct
  misc_feature 1..333: note = derived and/or modified sequence opt3 from anti-HIV-1_LightChain
  source 1..333: mol_type = other RNA
cagagcctgctcacccaacccccttccgtgtctgccgctccaggccagaaggtcacaatctcatgcagtgggggaaacagcgacattggtaaaaatttcgtttcctggtaccagcagtctccgggcgcagcccccagacttctgatatatgagaacgataggcggccttcggggatcccagaccgcttttcaggaagcaagagtggcacttccgcgacgttgggtattaccgggttacaaacaggagatgaagctgactactattgtggcacttgggatcgatctctgagcgccggcggggtgttcggaaccggtacaaaagtaaccgtgcta

SEQ ID NO: 24522 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaaggttaacatctcatgcagtgggagctcctctaatattggtaaaaactacgtgtcgtggtatcagcagataccgggaacagcacccaaggtactcatctacgagaataacaaaagaccttcaggcattccagacaggttcagcgggagtaagtccggaacttctgccacgcttggcatcgcgggtctgcaaaccggggatgaagctgactattactgtgccacatgggatagctccttgtcagcaggaggcgtgtttggcactgggaccaaagtcacagtgtta

SEQ ID NO: 24523 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaaggttacaatctcatgcagtgggagctcctctaacattggaaatagacacgtgtcgtggtaccagcagctcccgggtactgtacccaaacttctgatatatgagacgaacaagaggccttcaggcatcccagaccggttcagcgggagtaaatccggaacctctgcaacattgggcattactggtttacaaaccggggatgaagccgactactattgtggaacatgggataatagcctgtccaccggcggcgtgtttgggactggaacaaaggtcaccgtgcta

SEQ ID NO: 24524 - RNA, 336 nt, synthetic construct
  misc_feature 1..336: note = derived and/or modified sequence opt3 from anti-HIV-1_LightChain
  source 1..336: mol_type = other RNA
cagagcgtgctgacccaacccccttccgtctctggcgccccagggcagagagttacaatctcatgcactggaagtagctccaacattggtgctggctacgacgtgcactggtatcagcagctcccggggacggcacccaaacttctgatattcggacatgataagaggccttctggcatcccagaccggttttcgggttcaaagagcgggaccagtgccacattgggaattactggcttacaaaccggcgatgaggcggactactattgtgggacatgggattcctctctgagcgctggaggtgtattcggcaccgggactaaagtgacagtccta

SEQ ID NO: 24525 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaactcccctccgcctctggccttcctgggcagacagtcactatctcatgcagtggaagcacgtcctctattggttcgaaccacgtttactggtatcaacaggtggctggcaccgcaccaaagctgttgatatacgagaataacaaaagaccgtcagggatccccgacaggttcagcggaagtaagtccggcacatctgccactttaggtattaccgggctgcagacaggagatgaagcggactattactgtgctacctgggatagctccctatcagccggcggcgtatttgggactggaacaaaagtgaccgtcctc

SEQ ID NO: 24526 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaaacaccctccgcctctggcgctcctgggcagggagtcactatctcatgcagtggtagctcctctaacgttggcagaaattacgtgtcgtggtatcagcagctcccagggacggcaccgaaacttctgatttacgagaacaccaagaggccctcaggaatacctgaccggttcagcggcagtaagtccggtacatctgccactttggggatcaccggattacaaacaggcgatgaagcggactattactgtggcacctgggatcgcagcctgtccgctgggggagtatttggtactggcacaaaagtgaccgtccta

SEQ ID NO: 24527 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaaggttacaatctcatgcagtgggagctcctctaacattggaaataactacgtgtcgtggtatcagcagttcccgggtactgcacccaaactccttatatcagacaataacaagagacctagcggcatcccagataggtttagtgtatccaaatctgggacgagcgccaccctgggaattacaggcttgcaagcgggtgacgaggctgattactattgtgggacttgggactcctcattaagtgccggaggcgtgttcggcaccgggacaaaggtcaccgtgctg

SEQ ID NO: 24528 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaaggttacaatctcatgcagtgggagcaactccaatattggaaacaattacgtgacttggtatcagcagttcccgggtacggcacccaaagtactcatatacgacaactctagaaggccttcgggcatcccagatcggttttcagggagcaagagtggaacctccgccacacttggcattactggtctgcaaaccggggacgaggcggattattactgtggaacatgggactctagcttgtccgctggcggcgtgttcgggaccggaactaaagtcacagtgtta

SEQ ID NO: 24529 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctggcgccccagggcagagagttacaatctcatgcagtggaagctcctctaacattggtaataactacgtgtcgtggtatcagcagctcccgggcactgctcccaaacttctgatatacgagaatacgaagaggccttcagggatcccagaccggttcagcggaagtaagtccggcacctctgcaacattgggtattactgggttacaaaccggagatgaagccgactattactgtggcacatgggatcgcagcctgtccgcgggcggggtatttggaaccggtactaaagtgacagtccta

SEQ ID NO: 24530 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagacagttactatctcatgcagtgggagcacgtccaacattggacagaatttcctctcttggtttcagcacgtgccgggtaccgcacccaaacttctgatatacgagaacaataagagaccttcgggcatcccagacaggttctcagggagcaagagtggaacatccgccactttgggcattaccggtttacaaacaggggatgaagcggactattactgtggaacctggcattctagcctgtccgctggcggcgtatttgggactggaacaaaagtgaccgtccta

SEQ ID NO: 24531 - RNA, 333 nt, synthetic construct
  misc_feature 1..333: note = derived and/or modified sequence opt3 from anti-HIV-1_LightChain
  source 1..333: mol_type = other RNA
aacttcatgctgacccagccccctagcgcctccggcacaccagggcaaagagtgactatctcttgctcaggaagtagctccaatattggttctaagtacgtctcgtggtatcagcagctcccgggcacggctcccaaacttctgatatacgagaacaccaagaggccttcagggatcccagaccggtttagcggaagtaaatccggcacatctgcaactttgggtattaccgggttacagacaggagatgaagccgactattactgtggcacctgggatcgcagcctgtccgcgggcggggttttcggaactggtacaaaggtgaccgtacta

SEQ ID NO: 24532 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaaggttacaatctcatgcagtgggagctcctctaacattggaaataactacgtgtcgtggtatcagctccttccgggtactgcacccaaactgttgatatacgagaataacaagagaccttcaggcatcccagacaggttcagcgggagtaaatccggaacgtctgccaccttaggcattacaggtctgcagactggggatgaagcggactattactgtggaacctgggataatagcctatccacaggcggcgtatttgggaccggaactaaggtgacagtcctc

SEQ ID NO: 24533 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgtctctgccgctccaggccagaaggttacaatctcatgcagtgggagctcctctaacattggaaataactacgtgtcgtggtatcagcagctcccgggtactgcacccaaaataatcatttacgacaataacaagagaccttcaggcatcccagataggttcagcgggagtaaatccggaacgtctgccacccttggcattacaggtctgcaaactggggacgaggcggattattactgtggaacctggcacagctccttgtcagctggcggcgtatttgggacaggaaccaaggtgactgtctta

SEQ ID NO: 24534 - RNA, 333 nt, synthetic construct
  misc_feature 1..333: note = derived and/or modified sequence opt3 from anti-HIV-1_LightChain
  source 1..333: mol_type = other RNA
cagagcgtgctgacccaacccccttccgcctctgctacaccaggccagagagtcactatctcatgcagtgggagctcctctaacattggatcgaagcacgtttactggtatcagaaactcccgggtacggcacccaaacttctgatatacgagaataccaagaggccttcaggcatcccagaccggttcagcgggagtaagtccggaacatctgccactttgggcattaccggtttacagacaggggatgaagcggactattactgtggaacctgggatcgcagcctgtccgctggcggcgtgtttgggactggaacaaaagtaaccgtgcta

SEQ ID NO: 24535 - RNA, 432 nt, synthetic construct
  misc_feature 1..432: note = derived and/or modified sequence opt3 from anti-HIV-1_HeavyChain
  source 1..432: mol_type = other RNA
caggcccaactggtggagagcggcgggggagtcgttcagcccggtagatccctcaggctttcttgcgctgcatcaggcttcacctttagtagctacgggatccactgggtgcggcaggcccctggaaagggcctggaatgggtagcggtgatgtcctctgacggtacatataaatactatggggattcgatgaagggacgcttcactatttcacgagacaacagcaaaaatagtttgtacttacagatgaactccctgcgtgctgtcgatacggccgtgtattactgtgcaaaggacctaggcgagggcgaaaatgaggaatgggccaccgattattacgacttttctatagggtacccaggacaagatccgagaggtgttgtgggcacattcgacatctgggggcagggaactatggtcaccgtgagctcc

SEQ ID NO: 24536 - RNA, 426 nt, synthetic construct
  misc_feature 1..426: note = derived and/or modified sequence opt3 from anti-HIV-1_HeavyChain
  source 1..426: mol_type = other RNA
caggtgcaactggtcgagagcggcgggggagttgtgcagcccggtagatccctcaggctttcttgcgccgcttcaggcttcacctttagtagctacgggatgcactgggtacggcaggcacctggaaagggcctggaatgggtggccgtcatctccgacgatggttctaacaaatattacgcggactcggtgaaggggcgcttcacaatttcacgagataatagcaaaaacactttgtatttacagatgaatagtctgcgtgctgaggacacggccgtttactattgtgcaaaggatctaggagaatccgagaacgaagagtgggcctctgactactatgattttggcagcgactacccaggccaagatccgagagctgtggtcggggcattctggggacagggtaccatggtgacagtatcctca

SEQ ID NO: 24537 - RNA, 432 nt, synthetic construct
  misc_feature 1..432: note = derived and/or modified sequence opt3 from anti-HIV-1_HeavyChain
  source 1..432: mol_type = other RNA
caggtgcaactggtcgagagcggcgggggagttgtgcagtccggtagatctctcaggctttcatgcgccgctagtggcttcacctttagcgcatacgccctgcactgggtacggcaggcgcccgggaagggattggaatgggtggctgtcatctcctatgacggccgcgataaagactacgccgattctgtgaagggtcgattcacaatttcgcgtgacaacagcaaaaatactttatatctgcagatgaactcactaagagcagaggatacggccgtttactattgtgctaaggacctcggggaaagtgagaatgaagagtgggcatccgattactatgactttggatctgattaccctggccaagacccaagggccgtggtcggcgctttcgatatatgggggcagggaaccatggtgacagtaagctcc

SEQ ID NO: 24538 - RNA, 432 nt, synthetic construct
  misc_feature 1..432: note = derived and/or modified sequence opt3 from anti-HIV-1_HeavyChain
  source 1..432: mol_type = other RNA
caggtgcaactggtccagagcggcgggggactcgttcagcccggtagatcccttaggctgtcttgcgtggcctcaggcttccggtttagtttccacgggatgcattgggtacgccaggctcctggaaagggcttggagtgggtggcagtcgtgagcgacgatggttccgaccaaaaatacgttgattctgtgaaggggcgattaaccatctcgcgtgacaacagcaaaaatacagtctatctgcagatgaactcactaagagccgaagatactgcggtgtactattgtgctaaggacctcggagagagtgaaaatgaggaatgggcctccgattactatgactttggctctgattacccaggccaggacccgagggcagtagttggggccttcgatatttggggacagggtacgatggtgaccgtcagctcc

SEQ ID NO: 24539 - RNA, 432 nt, synthetic construct
  misc_feature 1..432: note = derived and/or modified sequence opt3 from anti-HIV-1_HeavyChain
  source 1..432: mol_type = other RNA
gaggtgcacctggtcgaaagcggcgggggagttgtgcagcccggtagatccctcaggctttcttgcgccgcttcaggcttcacctttaacagttacgcaatgatctgggtacggcaagcccctgggaagggactggagtgggtggcggtcattagctatgacggcaataacaaatactatgctgattccgtgaagggtcgcttcacaatatctcgagaaaattcgaaaaacactttgtacttacagatgaactcactgcgtgccgaggacacggcagtttatcattgtgccaaggatctaggggaaagcgagaatgaggaatgggctagtgactactatgattttggaagagactacccaggccaggatccgaggggcgtggtcgggaccttcgacatctggggacacggtacaatggtgactgtatcctct

SEQ ID NO: 24540 - RNA, 432 nt, synthetic construct
  misc_feature 1..432: note = derived and/or modified sequence opt3 from anti-HIV-1_HeavyChain
  source 1..432: mol_type = other RNA
caggtgcaactggtcgagagcggcgggggagttgtgagacccggtggctccctcaggctttcttgcaccgcctcagggttccactttaacaagtacggaatgaattgggtacggcaggctcctggcaaaggtctggcattggtggccttcatccagagtggggcgagctataactactatgctgactccgtcaagggacgctttacaatttctcgagataattcgaaaaacactttatacctgcagatgaactcactacgtgccgaagacacggcagtgtattactgtgccaaggatctcggcgacagcgagaatgaagagtgggctagtgattattacgacttcggcagagattacccagggcaagacccgaggggagttgtgggtgcatttgatatatggggccatgggaccatggtcacagtgtcctct

SEQ ID NO: 24541 - RNA, 432 nt, synthetic construct
  misc_feature 1..432: note = derived and/or modified sequence opt3 from anti-HIV-1_HeavyChain
  source 1..432: mol_type = other RNA
caggtgcacctggtcgagagcggcgggggagttgtgcaacccggtaagtccctcaccatctactgcgccgtatctgagttcacactttcaaactatgctatgcattgggtgagactgactcctggcaaagggttgcagtgggtcgcagtgattagttacgacggaagcaataagtattacgccgattccgttaaaggcaggtttacgatatctcgggacaactcgaagaataccttatatctgcagatgaactcactacgcgcggaagatacagctgtgtactattgtgccaaagacctcggtgaaagcgagaatgaagagtgggcaagtgattactacgacttcgggcgagattatccaggacaggacccgcgtggcgtcgtgggcgtatttgatatctgggggcaaggaactatggttaccgtgtcctct

SEQ ID NO: 24542 - RNA, 432 nt, synthetic construct
  misc_feature 1..432: note = derived and/or modified sequence opt3 from anti-HIV-1_HeavyChain
  source 1..432: mol_type = other RNA
gaggtgcagctgctcgaaagcggcgggggagtcgttcaacccggtagatcccttaggctgtcttgcgccgcttcaggcttcacctttagtacatacgcattgcactgggtgcggcaggcccctgggaagggattagagtgggtagcggtgatcagctatgacggctccactaaattctacgctgattctgtcaagggtcgctttacgatttcgcgagacaacagcaaaaataccctgtatctacagatgaactcactccgtgccgaagatacagcagtgtactattgtgccaaggacctgggggagagtgaaaatgaggagtgggcttccgattactatgacttcggatctgattacccaggccaggacccgagagcagttgtgggcgcctttgatatatgggggcaaggaactatggtcaccgtgagctcc

SEQ ID NO: 24543 - RNA, 432 nt, synthetic construct
  misc_feature 1..432: note = derived and/or modified sequence opt3 from anti-HIV-1_HeavyChain
  source 1..432: mol_type = other RNA
caggtgcaactggtcgagagcggcgggggagttgtgcagcccggtggctccctcagactttcttgcgccgcttcagggttcacctttagtagctacggaatgcactgggtaaggcaggcacctggcaagggtctggaatgggtggccttcatccggtatgacgggtccaacaaatactatgcggattctgtcaagggacgctttacaatttcgcgagagaatagcaaaaatactttgtacttacagatgaactcactgcgtgctgaagacacggccgtgtatcattgtgcaaaggatctaggcgagagtgaaatagaggagtggacctccgactactatgatttcggcagagactacccagggcaagatccgaggggagtttttggtacattcgacatctggggccacgggactatggtgaccgtctctagc

SEQ ID NO: 24544 - RNA, 432 nt, synthetic construct
  misc_feature 1..432: note = derived and/or modified sequence opt3 from anti-HIV-1_HeavyChain
  source 1..432: mol_type = other RNA
gaggtgcagctggtcgaaagcggcgggggagttgtgaagcccggtggctccctcagactttcttgcgtagtgtcagggttcacctttagtaacgcctggatgagctgggtcaggcaagctcctggaaaaggcctggagtgggtggcagttatctccgacgatggttctaataagtactatgccgactcggtgaaagggcggttcacaatttcacgcgataacagcaagaatactttgtacttacagatgaacagtctgcgagcggaagacacggctgtctattactgtgccaaagatctaggagagtccgaaaatgaggagtgggcatctgactattacgattttggcagcgactatccaggccaggatccgcgtgccgtggtaggggctttcgacatatggggacagggtaccatggttacagtgtcctca

SEQ ID NO: 24545 - RNA, 432 nt, synthetic construct
  misc_feature 1..432: note = derived and/or modified sequence opt3 from anti-HIV-1_HeavyChain
  source 1..432: mol_type = other RNA
caggtgcaactggtcgagagcggcgggggagttgtgcagcccggtggctccctcagactttcttgcgccgcttcagggttcacctttagtacatacggaatgcactgggtaaggcaggcacctggcaagggtctggaatgggtggccttcatccggtatgacgggcgcaacaaaaattacgcggatagcgtcaagggacgatttactatttcccgtgacaactctaaaaatacgttgtatttacagatgaactcgctgagagctgaggataccgccgtgtactattgtgcaaaggacctaggcgaatcagagaatgaagagtgggccacagattactatgacttcagcataggctacccagggcaagatccgaggggagttgtgggtatctttgacatttggggccaggggactatggtcaccgtgagttcc

SEQ ID NO: 24546 - RNA, 432 nt, synthetic construct
  misc_feature 1..432: note = derived and/or modified sequence opt3 from anti-HIV-1_HeavyChain
  source 1..432: mol_type = other RNA
caggtgcacctggtcgagagcggcgggggagttgtgcaacccggtggctccctcagactttcttgcgccgcttcagggttcagttttagcatctacggaatgcattgggtaaggcaggcacctggcaagggtctggaatgggtgaccttcacacggtatgacgggtccaacaaatactatactgattctgtcaagggacgctttacgatttcgcgagacaattcaaagaacaccttgtacttacagatgaatagcctgcgtacagaggatactgccgtgtattactgtgcgaaagacctaggcgaaagtgagaacgaagagtgggcttccgattattacgacttcggctctgattacccagggcaggacccgagagccgttgtgggagcatttgatatatggggtcaaggcaccatggtcacagtgagctcc

SEQ ID NO: 24547 - RNA, 432 nt, synthetic construct
  misc_feature 1..432: note = derived and/or modified sequence opt3 from anti-HIV-1_HeavyChain
  source 1..432: mol_type = other RNA
caggtgcaactggtcgagagcggcgggggagttgtgcagcccggtggctccctcagactttcttgcgccgcttcagggttcacctttagtagctacggaatgcactgggtaaggcaggcacctggcaagggtctggaatgggtggccttcatccggtatgacgggtccaacaaatactatgcggatccagtcaagggacgctttacaatttctcgagacaattcgaaaaacactttgtacttacagatgaactcactgcgtgctgaggatacggccgtgtattactgtgcaaaggacctaggcgaaagcgagaatgaagagtgggccagtgattattacgacttcggcagagattacccggggcaagaccccaggggagttgtgggtgtctttgatatatggggccaggggaccatggtgacagcttcctct

SEQ ID NO: 24548 - RNA, 432 nt, synthetic construct
  misc_feature 1..432: note = derived and/or modified sequence opt3 from anti-HIV-1_HeavyChain
  source 1..432: mol_type = other RNA
gagatgcagctggtggaaagcggcgggggactcgtccaacccggtggctcccttagactgtcttgcgccgcttcagggttcacctttagtagctactggatgtcctgggttaggcaggcacctggaaagggcttggagtgggtggccgtaatctcttatgacggtaacaataaatactatgcggattcggtgaaggggcggttcacaatttcacgcgaaaacagcaaaaatactttatacctgcagatgaacagtctacgagctgaggacacggccgtctattactgtgcaaaggatctcggagaatccgagaatgaggaatgggcctctgactattacgattttggcagcgactacccaggccaggatccgcgtggggtggttggaaccttcgacatatggggtcacggcacaatggtgactgtctcctca

SEQ ID NO: 24549 - RNA, 432 nt, synthetic construct
  misc_feature 1..432: note = derived and/or modified sequence opt3 from anti-HIV-1_HeavyChain
  source 1..432: mol_type = other RNA
caggtgcaactggtcgagagcggcgggggagttgtgcagcccggtagatccctcaggctttcttgcgccgcttcaggcttcacctttagtagctgtgcaatgcactgggtacggcaggcccctgggaagggactggaatgggtggcggtcatctcctacgacggcaacaataaacattatgctgattctgtgaagggtcgcttcacaatttcgcgagacaacagcaaaaatactttgtacttacagatgaactcactgcgtgccgaggatatggcagtttattactgcgccaaggacctaggggaaagtgagaatgaagagtgggcttccgattattacgacttttggagagattatccaggacaagacccgaggggctgggtgggcacgttcgatatatgggggcagggaaccatggtcacagtgtctagc

SEQ ID NO: 24550 - RNA, 432 nt, synthetic construct
  misc_feature 1..432: note = derived and/or modified sequence opt3 from anti-HIV-1_HeavyChain
  source 1..432: mol_type = other RNA
caggtgcaactggtcgagagcggcgggggagttgtgcagcccggtagatccctcaggctttcttgcgccgcttcaggcttcacctttagtaactacgggatgcactgggtacggcaggcacctggaaagggcctggaatgggtgacagtcatcagctccgacggttctaaaaagtattacgccgattcggtgaaagggcgcttcactatttcacgagacaatagcaagaacacgttgtatttacagatgaatggactgcgtgcggatgacaccgctgtttactattgtgccaaagatctaggcgacagtgagaacgaagagtgggcatccgattactatgactttggcagagattacccagggcaagacccgaggggagtggtcggtgccttcgatatatggggccatgggacaatggtgactgtatctagc

SEQ ID NO: 24551 - RNA, 432 nt, synthetic construct
  misc_feature 1..432: note = derived and/or modified sequence opt3 from anti-HIV-1_HeavyChain
  source 1..432: mol_type = other RNA
caggtgcaactggtcgagagcggcgggggagttgtgcagcccggtggctccctcagactttcttgcgccgcttcagggttcacctttagtagctacggaatgcactgggtaaggcaggcacctggcaagggtctggaatgggtggccttcatccggtatgacgggtccaacaaatactatgcggattctgtcaagggacgctttacaatttcgcgagacaattcaaagaacactttgtacttacagatgaatagcctgcgtgctgtggatacggccgtttattactgtgcaaaagacctaggcgagggcgaaaacgaggaatgggccaccgattattacgacttcagtatagggtacccaggacaagatccgagaggtgtggtcggcgcttttgacatctgggggcagggaacaatggtgactgtatcctct

SEQ ID NO: 24552 - RNA, 432 nt, synthetic construct
  misc_feature 1..432: note = derived and/or modified sequence opt3 from anti-HIV-1_HeavyChain
  source 1..432: mol_type = other RNA
caggtgcaactggtcgagagcggcgggggagttgtgcagcccggtaggtccctcaggctttcttgcgccgcttcaggcttcacctttcggaactacgggatgcactgggtacgccagagtcctggaaagggcctggaatgggtggcagtcatcagctatgacggtaaaattataaattacatcgatttcgtgaaggggcgatttacaatttcccgtgagaactctaaaaatactttgtatttacagatgaactcgctgagagccgaagacacggcggtttactattgtgctaaggatctaggagagtcagaaaatgaggagtgggccagcgactactatgatttcggcagtgactacccaggccaagatccgagaggggtggtcggaacctttgacatctggggtcatggcacaatggtgactgtatcctct

SEQ ID NO: 24553 - RNA, 432 nt, synthetic construct
  misc_feature 1..432: note = derived and/or modified sequence opt3 from anti-HIV-1_HeavyChain
  source 1..432: mol_type = other RNA
gaggtgcagctgctcgaaagcggcgggggacttgtccaacccggtagatccctgaggttgtcttgcgccgcttcaggcttcacctttagtagctacgttatgcactgggtgcggcaggcacctgggaagggattagagtgggtagccgtgatctcctatgacggctctaacaaacattacgcggattcggtcaagggtcgcttcacaatttcacgagacaatagcaaaaacactctgtatctacagatgaatagtctccgtgctgaagatacggccgtgtactatagagcaaaggacctgggggagtccgaaaacgaggagtgggcctctgattactatgactttggaagggattacccaggccaggacccgcggggcgttgtgggggtcctttacatatggggacaaggtaccatggtgacagtaagctcc

SEQ ID NO: 24554 - RNA, 432 nt, synthetic construct
  misc_feature 1..432: note = derived and/or modified sequence opt3 from anti-HIV-1_HeavyChain
  source 1..432: mol_type = other RNA
gaggtgcagctggtcgaaagcggcgggggactcgttaagcccggtggctcccttagactgtcttgcgccgcttcagggttcacctttagtacatacagcatgcactgggtgaggcaagcacctggaaaaggcttggagtgggtagccgtgatctcctatgacggtaacaataagtactatgcggattctgtcaaagggcggttcactatttcgcgcgaaaactcaaagaatacgttatacctgcagatgaacagcctacgagctgaggacaccgccgtgtatcattgtgcaaaagatctcggagaaagtgagaatgaggaatgggcctccgactactatgattttggccgtgactacccaggccaggatccgagaggggttgtgggaacattcgacatatggggtcacggcactatggtcaccgtgtctagc

SEQ ID NO: 24555 - RNA, 432 nt, synthetic construct
  misc_feature 1..432: note = derived and/or modified sequence opt3 from anti-HIV-1_HeavyChain
  source 1..432: mol_type = other RNA
caggtgcaactggtcgacagcggcgggggagttgtgcagcccggtagatccctcaggcttttctgcgccgtatctggctttaccttctcaacatacactatgcactgggtgcggcaggctcctgggcgcggactggagtgggtcgcagtgatcagttatgatggcagcacgaagtactatgccgactccgttcagggtcgatttaccatttctcgtgataactcgaaaaatacattgtacttacaaatgaactcactgagagcggaagacactgctgtgtattactgtgccaaggatctaggggagagcgaaaatgaggaatgggcaagtgactattacgatttcggatccgactacccaggccaggatccgagggccgtcgtgggcgcttttgacatatgggggcagggaaccatggtaacagtttctagc

SEQ ID NO: 24556 - RNA, 426 nt, synthetic construct
  misc_feature 1..426: note = derived and/or modified sequence opt3 from anti-HIV-1_HeavyChain
  source 1..426: mol_type = other RNA
caggtgcaactggtcgagagcggcgggggagttgtgcagcccggtaggtccctcaggctttcttgcgccgcttcaggcttcacctttagtagcttcgggatgcactgggtacggcaggcacctggaaagggcctggaatgggtggccgtcatctcctacgacggtaacaataaatattacgcggattctgtgaaggggcgctttacaatttcgcgagagaacagcaaaaatactttgtatttacagatgaactcactgcgtccagaagacacggctgtttactattgtgccaaggatctaggagagagtgaaaatgaggagtgggcatccgactactatgatttcggcagagactacccgggccaagatcccagaggggtggtcggaacctttgacatatggggtcatggcacaatggtgactgta

SEQ ID NO: 24557 - RNA, 432 nt, synthetic construct
  misc_feature 1..432: note = derived and/or modified sequence opt3 from anti-HIV-1_HeavyChain
  source 1..432: mol_type = other RNA
caggtgcaactggtcgagagcggcgggggagttgtgcagcccggtaggtccctcaggctttcttgcgccgcttcaggcttcatgtttagtcggtacgggatgcactgggtacgccaggcacctggaaagggcctggaatgggtggccgtcatcagccatgacggttccaacaaatattacgcggattctgtgaaggggcgattcattatatcgcgtgacaattcaaagaacaccttgtatttacagatgaatagcctgagagctgatgacacagccgtttactattgtgcaaaagatctaggagagagtgaaaacgaggaatgggcctccgactactatgatttttggatcggctacccaggccaagacccgagaggggtggtcggagctttcgatatttggggtcagggcactatggtgacggtatctagc

SEQ ID NO: 24558 - RNA, 432 nt, synthetic construct
  misc_feature 1..432: note = derived and/or modified sequence opt3 from anti-HIV-1_HeavyChain
  source 1..432: mol_type = other RNA
caggtgcaactggtcgagagcggcgggggagttgtgcagcccggtggctccctcagactttcttgcgccgcttcagcattcacctttagtagctacgggatgcactgggtaaggcaggcccctggaaagggcctggaatgggtggcgttcatccggtatgacggttccaacaaatactatgctgattctgtcaaggggcgctttacaatttcgcgagacaattcaaagaacactttgttcttacagatgaatagcctgcgtgccgaggatatggcagtgtactattgtgccaaagacctaggagaaagtgagaacgaagagtgggcttccgattactatgacttttggagagattacccaggccaagacccgaggggctgggttgggacgttcgatatatggggacagggtaccatggtgacagtctctagc

SEQ ID NO: 24559 - RNA, 426 nt, synthetic construct
  misc_feature 1..426: note = derived and/or modified sequence opt3 from anti-HIV-1_HeavyChain
  source 1..426: mol_type = other RNA
caggtgcaactggtcgagagcggcgggggagttgtgcagcccggtagatccctcaggctttcttgcgccgcttcaggcttcacctttagtagcttcgggatgcactgggtacggcaggcacctggaaagggcctggaatgggtggccgtcatctcctacgacggttctaacaaatattacgtggattcggttaaggggcgctttacaatttcacgagacaatagcaaaaacactttgtatttacagatgaatagtctgcgtgcggaggatacggctgtgtacgccaaggacctaggagaatccgagaacgaagagtgggcatctgattattacgacttcggcagcgattatccaggccaagacccgagaggggtcgtgggaacctttgatatatggtcccagggtacaatggtaactgtttcaagt

SEQ ID NO: 24560 - RNA, 432 nt, synthetic construct
  misc_feature 1..432: note = derived and/or modified sequence opt3 from anti-HIV-1_HeavyChain
  source 1..432: mol_type = other RNA
caggtgcaactggtcgagagcggcgggggagttgtgcagcccggtggctccctcagactttcttgcgccgcttcagggttcacctttagtacatacggaatgcactgggtaaggcaggcacctggcaagggtctggactgggtggccttcatccggtatgatgggagccataaatactatgcggactccgtcaagggacgctttactatttctcgagaaaactcgaaaaatacgttgtacttacagatgaactcactgcgtccagaggataccgctgtgtattactgtgccaaggacctaggcgaaagcgagaatgaagagtgggcaagtgattattacgacttcggcagagattacccggggcaagaccccaggggagttgtgggtacatttgatatatggggccacgggactatggtcaccgtgtcctct

SEQ ID NO: 24561 - RNA, 432 nt, synthetic construct
  misc_feature 1..432: note = derived and/or modified sequence opt3 from anti-HIV-1_HeavyChain
  source 1..432: mol_type = other RNA
caggtgcaactggtcgagagcggcgggggagttgtgcagcccggtaggtccctcaggctttcttgcgccgcttcaggcttcacctttagtagctacgcaatgcactgggtacggcaggcccctgggaagggactggaatgggtggcggtcatctcctatgacggctctggtgattactatgctgactcggtgaaagggcgcttcacaatttcacgagataacagcaagagtactttgtacttacagatgaactccctgcgtccagaggacacggccgtttattactgtgcaaaagatctaggagaatctgagaatgaagagtgggccagcgactattacgattttggcagagactacccgggccaagatcccagaggggtggtcggaaccttcgacatatggggtcatggcacaatggtgactgtatcctca

SEQ ID NO: 24562 - RNA, 432 nt, synthetic construct
  misc_feature 1..432: note = derived and/or modified sequence opt3 from anti-HIV-1_HeavyChain
  source 1..432: mol_type = other RNA
caggtgcacctggtcgagagcggcgggggagttgtgcaacccggtggctccctcagactttcttgcgccgcttcagggttcacctttagtacatacggaatgcagtgggtaaggcaggcacctggcaagggtctggaatgggtggccttcatcaaaaacgacgggactaatgagttttatggagatagcgtcaagggccggttcacgatttcccgcgacaactctaaaaataccgtgtcgttgcatatggattcattacgaccagaagacacagcgctgtactattgtgctaaggatctaggcgagagcgaaaacgaggagtgggccagtgactactatgattttgggtccgactacccgggacaggatccccgtgcagttgtgggtgccttcgacatatggggccaagggactatggtcaccgtgtctagc

SEQ ID NO: 24563 - RNA, 432 nt, synthetic construct
  misc_feature 1..432: note = derived and/or modified sequence opt3 from anti-HIV-1_HeavyChain
  source 1..432: mol_type = other RNA
caggtgcaactggtcgagagcggcgggggagttgtgcagcccggtggctccctcagactttcttgcgtagcctcagggttcacctttagtagctacggaatgcactgggtgaggcaggctcctggcaagggtctggaatgggtcgcattcatccggtatgacgggcgcaacaaatactatgccgattccgtgaagggacgatttacaatttctcgtgacaaatcgaagaatactttgtgtttacagatgaactcactgagagttgaggatacggcggtgtactattgcgctaaagacctaggcgatagcgaaaatgaggaatgggccagtgactactatgatttcggcagggactacccagggcaagatccgcggggagtcgtgggtgcatttgacatatggggccatgggaccatggtaacagtttcctct

SEQ ID NO: 24564 - RNA, 432 nt, synthetic construct
  misc_feature 1..432: note = derived and/or modified sequence opt3 from anti-HIV-1_HeavyChain
  source 1..432: mol_type = other RNA
caggtgcaactggtcgagagcggcgggggagttgtgcagcccggtcggtccctcaggctttcttgcgccgcttcaggcttcacctttagtagctacgggatgcactgggtacggcaggcacctggaaagggcctggaatgggtggccgtcatctcctatgacggttctaacaaatactatcgcgattcggtgaaggggcgattcacaatttcacgtgacaatagcaaaaacactgtttacttgcagatgaatagtttaagagcggaggatacggctgtgtattactgtgccaaggacctgggagaatccgagtctgaagagtgggcaagcgattattacgactttggcagggattacccaggccaagacccgagaggggtcgtgggagccctagatatatggggtcagggcatcatggtaaccgtttcctca

SEQ ID NO: 24565 - RNA, 432 nt, synthetic construct
  misc_feature 1..432: note = derived and/or modified sequence opt3 from anti-HIV-1_HeavyChain
  source 1..432: mol_type = other RNA
gaggtgcagctggtcgaaagcggcgggggaatggttcaacccggtagacctctcaggctttcctgcgccgcttctggcttcatcttttcagggttcggactgcactgggtgcggcaggcaccaggcaagggtttggagtgggtagccagtattagctacgacgggggaaacaaatattacgcggattccgtgcgcggccgatttaccatatctcgtgacaattcgaagaacacattatatctgcagatgaactcactaagagctgaagatactgccgtctactattgtgcaaaagacctcggcgagagcgaaaatgaggagtgggccagtgattactatgacttcgggtccgattacccgggacaggaccccagggctgtggttggtgcatttgatatctggggccaagggacgatggtgaccgtctctagc

SEQ ID NO: 24566 - RNA, 432 nt, synthetic construct
  misc_feature 1..432: note = derived and/or modified sequence opt3 from anti-HIV-1_HeavyChain
  source 1..432: mol_type = other RNA
gaggtgcagctggtcgaaagcggcgggggagttgtgagacccggtggctccctcaggctttcttgcgccgcttcagggttcacctttaacgactacggaatggcatgggtacggcaagcccctggcaagggtctggagtgggtggcggatatcagttatgacgggagcaataaatactatgctgattccgtcaagggacgcttcacaatttctcgagacaactcgaaaaatactttgtacttacagatgaactcactgcgtgccgaagatacggcagtgtattactgtgccaaggacctaggcgagagcgaaaatgaggagtgggctagtgattattacgactttggcagagattacccagggcaggacccgaggggagttgtgggtgcattcgatatatggggccaggggaccatggtcacagtgtcctct

SEQ ID NO: 24567 - RNA, 429 nt, synthetic construct
  misc_feature 1..429: note = derived and/or modified sequence opt3 from anti-HIV-1_HeavyChain
  source 1..429: mol_type = other RNA
caggtgcaactggtcgagagcggcgggggagttgtgcagcccggtagatccctcaggctttcttgcgccgcttcaggcttcacctttagtagctacgggatgcactgggtacggcaggcacctggaaagggcctggaatgggtggccgtcgtgtcctatgacgagtctaaatactatgcggattcggttaagggtcgcttcacaatctcacgagacaacagcaaaaatactttgtacttacagatgaacagtctgcgtgctgaagatatggccgtgtattactgtgcaaaggacctaggggagtccgaaaatgaggagtgggcctctgattattacgaattttggagagactacccaggacaagatccgaggggctgggtcggcacgttcgacatttgggggcagggaaccatggtgacagtaagctcc

SEQ ID NO: 24568 - RNA, 432 nt, synthetic construct
  misc_feature 1..432: note = derived and/or modified sequence opt3 from anti-HIV-1_HeavyChain
  source 1..432: mol_type = other RNA
caggtgcaactggtcgagcccggcagaggggttgtgcaccctggaggtagcctcaggctttcctgcgtaacctctggcttcacatttgaaaacttcccaatgcattgggtgcggcaggccccggggaagggactggagtgggtcgctttgatctcatacgacggcagtgataaatattacagcgactccgtgaagggtcgctttactatttctcgagataattcgaaaaacacgttatatctgcagatgaactcactacgtgcagaagacaccgccgtttactattgtgcgaaggatctcggggagagcgaaaatgaggagtgggctagtgactactatgatttcggatccgactaccccggccaggatcctagaggcgtggtcgggacatttgacatatggggacacggtactatggtgaccgtatctagc

SEQ ID NO: 24569 - RNA, 432 nt, synthetic construct
  misc_feature 1..432: note = derived and/or modified sequence opt3 from anti-HIV-1_HeavyChain
  source 1..432: mol_type = other RNA
caggcccaactggtggagagcggcgggggagtcgttcagcccggtaggtccctcaggctttcttgcgctgcatcaggcttcagttttgccacccacgcgatgcattgggtgcggcgcagccctgggaagggactggaatgggtagctacaatctcctacggcggtaaaaacgagtattacgccgactctgtgaaggggcgattcactatttcgcgtgaaaattcaaagaacacgttgtatttacagatgaatagcctgagagcagaggataccgccgtctactattgtgctaaagacctaggagaaagtgagaacgaggaatgggcatccgattactatgactttggctctgattacccaggccaggacccgagaggggtggttggaacattcgatatatggggtcacggcactatggtgaccgtcagctcc

SEQ ID NO: 24570 - RNA, 432 nt, synthetic construct
  misc_feature 1..432: note = derived and/or modified sequence opt3 from anti-HIV-1_HeavyChain
  source 1..432: mol_type = other RNA
gccgtgcagctggtcgagagcggcgggggactcgttaagcccggtggctcccttagactgtcttgcgctgcatcagggttcacctttttcaacacatggatgagttgggtgaggcaaagccctggaaaaggcttggaatgggtagccgacatctcctacgatggttctaataagtattacgcggactcggtgaaagggcggtttactatttcacgcgataacagcaagaatacgttatatctgcagatgaacagtctacgagctgaggacaccgccgtctactattgtgcaaaagatctcggagaatccgagaatgaagagtgggcctctgactactatgatttcggccgtgactacccaggccaggatccgagaggggtggttggagtgtttgacatatggggtcagggcacaatggtcactgtgagctcc

SEQ ID NO: 24571 - RNA, 432 nt, synthetic construct
  misc_feature 1..432: note = derived and/or modified sequence opt3 from anti-HIV-1_HeavyChain
  source 1..432: mol_type = other RNA
caggtgcaactggtcgagagcggcgggggagttgtgcagcccggtagatccctcaggctttcttgcgccgcttcaggcttcacctttagtagctacgggatgcactgggtacggcaggcacctggaaagggcctggaatgggtggccgtcatctcctatgacggttctaacaaatactatgcggattcggtgaaggggcgcttcacaatttcacgagacaatagcaaaaacactttgtacttacagatgaatagtctgcgtgctgaggatacggccgtttattactgtgcaaaggacctaggagaatccgagaacgaagagtgggcctctgattattacgactttggcagcgattacccaggccaagacccgagagctgtggtcggggcattcgatatatggggacagggtaccatggtgacagtatcctca

SEQ ID NO: 24572 - RNA, 432 nt, synthetic construct
  misc_feature 1..432: note = derived and/or modified sequence opt3 from anti-HIV-1_HeavyChain
  source 1..432: mol_type = other RNA
caggtgagactggtcgagagcggcgggagggttgtgcaacccggaggttccctccggctttcttgcgtagcctcaggcttcacctttagtagctacgggatccactgggtgcgccaggctcctggaaagggcctggaatgggtcacattcatttggcatgacggtcgagatacttattacgcagacgccgtgaaagggcgttttacgatatccagagataactctaagaataccttgtatttacagatgaactcgctgagggcggaggacacagctgtttactattgtgccaaagatctaggagaatcagagaatgaagagtgggcaactgactactatgatttctggaccggctacccaggccaggacccgcgggccgtggtcggggcttttgatatctggggacaaggtacaatggtgaccgtaagcagt

SEQ ID NO: 24573 - RNA, 432 nt, synthetic construct
  misc_feature 1..432: note = derived and/or modified sequence opt3 from anti-HIV-1_HeavyChain
  source 1..432: mol_type = other RNA
caggtgcacctggtcgagagcggcgggggagttgtgcaacccggtagatccctcaggatctactgcgccgtatctgagttcacctttcggaactatgctatgcattgggtgcgccttgcacctggcaaggggctgcagtgggtcgccgtgatttcatacgacggaagtaataaatattacggcgatagcgttaagggtcgattcacaatatcccgtgacaactctaaaaatactttgtatttacagatggattcgctgagagcggaagacacggctgtgtactattgtgccaaggatctaggggaatcagagaacgaagagtgggcaagcgactactacgattttggaagggactatccaggccaggatccgcggggcgtcgtggggaccttcgacatctggggacacggtacaatggtaactgttagttcc

SEQ ID NO: 24574 - RNA, 432 nt, synthetic construct
  misc_feature 1..432: note = derived and/or modified sequence opt3 from anti-HIV-1_HeavyChain
  source 1..432: mol_type = other RNA
gaggtgcagctggtcgaaagcggcgggggactcgttaagcccggtggctcccttagactgtcttgcgccgcttcagggttcacctttagtgacgcatggatgagctgggtgaggcaagcccctggaaaaggcatggagtgggtagcggtgatctcctacgatggttctaacaagtattacgctgactcggtcaaagggcggttcacaatttcacgcgataatagcaagaacactttgtatttacagatgaatagtctgcgagccgtggacacggcagtttactattgtgccaaagatctaggagaaggcgagaacgaagagtgggctaccgactactatgatttttccataggctacccagggcaggacccgcgtggagtggtcggtgcattcgatatctggggccaggggacaatggtgactgtatctagc

SEQ ID NO: 24575 - RNA, 432 nt, synthetic construct
  misc_feature 1..432: note = derived and/or modified sequence opt3 from anti-HIV-1_HeavyChain
  source 1..432: mol_type = other RNA
gaggtgcaggtcgttgaaagcggcgggggactggtgaagcccggtggctccctcagactttcttgcgaggcctcagggttcacctttagtaacgcttggatgagctgggtaaggcaagcacctggaaaaggcctggaatgggtggccgtcatctcctacgacggtaataacaagtattacgcggattctgtgaaagggcggttcacaatttcgcgcgaaaattcaaagaacactttgtatttacagatgaatagcctgcgagctgaggacacggccgtttaccactgtgcaaaagatctaggagagagtgagaacgaagagtgggcctccgactattacgattttggccgtgactatccaggccaggatccgagaggggtggtcggaaccttcgacatatggggtcatggcacaatggtgactgtatctagc

SEQ ID NO: 24576 - RNA, 432 nt, synthetic construct
  misc_feature 1..432: note = derived and/or modified sequence opt3 from anti-HIV-1_HeavyChain
  source 1..432: mol_type = other RNA
caggtgcaactggtcgagagcggcgggggagttgtgcagcccggtggctccctcagactttcttgcgccgcttcagggttcacctttagtagctacggaatccactgggtaaggcaggcacctggcaagggtctggaatgggtggccttcattcggtccgacgcgacaaacaaatattacgctgattctgtcaaggggcgctttactatatcgcgagagaatagcaaaaatacgttgtatttacagatgaactcactgcgtgccgaagacaccgcagtgtactattgtgccaaggatctaggagagagtgaaaacgaggagtgggcttccgactactatgatttcggctctgactacccaggccaagatccgagaggggttgtgggaacatttgacatctggggtcatggcactatggtcaccgtgagctcc

SEQ ID NO: 24577 - RNA, 432 nt, synthetic construct
  misc_feature 1..432: note = derived and/or modified sequence opt3 from anti-HIV-1_HeavyChain
  source 1..432: mol_type = other RNA
caggtgcaactggtcgagagcggcgggggagttgtgcagcccggtagatccctcaggctttcttgcgccgcttcaggcttcacctttagtagcttcgggatgcactgggtacggcaggcacctggaaagggcctggaatgggtggccgtcatctcctacgacggtaacaataaatattacgcggattctgtgaaggggcgctttacaatttcgcgagagaacagcaaaaatactttgtatttacagatgaactcactgcgtgctgaagacacggccgtttactattgtgcaaaggatctaggagagagtgaaaatgaggagtgggcctccgactactatgatttcggctctgactacccaggccaagatccgagaggggtggtcggaacctttgacatatggggtcatggcacaatggtgactgtaagctcc

SEQ ID NO: 24578 - RNA, 432 nt, synthetic construct
  misc_feature 1..432: note = derived and/or modified sequence opt3 from anti-HIV-1_HeavyChain
  source 1..432: mol_type = other RNA
caggtgcaactggtcgagagcggcgggggagttgtgcagcccggtagatccctcaggctttcttgcgccgcttcaggcttcacctttagtaactacgcaatggactgggtacggcaggcccctgggaagggactggaatgggtggcggtcatcagctatgatggctccaataaatactatgctgactctgtgaagggtcgcttcacaatttcgcgagataacagcaaaaatactttgtacttacagatgaactcactgcgtgccgaggacacggcagtttattactgtgccaaggatctaggggaaagtgagaatgaagagtgggctaccgactattacgatttttggacaggatacccaggccaagacccgagagcagtggtcggcgccttcgatatatgggggcagggaactatggtgaccgtatcctct

SEQ ID NO: 24579 - RNA, 432 nt, synthetic construct
  misc_feature 1..432: note = derived and/or modified sequence opt3 from anti-HIV-1_HeavyChain
  source 1..432: mol_type = other RNA
caggtgcaactggtcgagagcggcgggggagttgtgcagcccggtagatccctcaggctttcttgcgccgcttcaggcttcacctttagtagctacgggatgcactgggtacggcaggcacctggaaagggcctggaatgggtggccgtcgtgtcctatgacgagtctaacaaatactatgcgggttcggttaaggggcgcttcacaatctcacgagataatagcaaaaacactttgtacttacagatgaatagtctgcgtacggaagacatggctgtgtattactgtgccaaggatctaggagagtccgaaaacgaggagtgggcatctgactattacgattttggcagagaatacccaggccaagacccgagggggtgggtcggaaccttcgatatttggggtcagggcacaatggtgactgtaagctcc

SEQ ID NO: 24580 - RNA, 432 nt, synthetic construct
  misc_feature 1..432: note = derived and/or modified sequence opt3 from anti-HIV-1_HeavyChain
  source 1..432: mol_type = other RNA
caggtgcaactggtcgagagcggcgggggagttgtgcagcccggtagatccctcaggctttcttgcgccgcttcaggcttcacctttagtagctacgggatgcactgggtacggcaggcacctggaaagggcctggaatgggtggccgtcatctcctatgacggttctaacaaatactatgtggattcggttaaggggcgcttcacaatttcacgagacaatagcaaaaacactttgtacttacagatgaatagtctgcgtgcggaggatacggctgtgtattactgtgccaaggacctaggagaatccgagaacgaagagtgggcaaccgattattacgacttttctataggctacccaggccaagatccgagaggggtcgtgggaatcttcgacatttggggtcagggcacaatggtaactgttagctcc

SEQ ID NO: 24581 - RNA, 432 nt, synthetic construct
  misc_feature 1..432: note = derived and/or modified sequence opt3 from anti-HIV-1_HeavyChain
  source 1..432: mol_type = other RNA
caggtgcaactggtcgagagcggcgggggagttgtgcagcccggtagatccctcaggctttcttgcgccgcttcaggcttcacctttagtacaagcgggatgcactgggtacggcaggcacctggaaagggcatggaatgggtggccgtcatctcctacgacggttctaacaaatattacgcggattcggtgaaggggcgcttcactatttcacgagacaatagcaaaaacacgctgtatttgcagatgaatagtttacgtgctgttgataccgccgtgtactattgtgcaaaggacctgggagagggcgaaaacgaggaatgggccacagattactatgacttttccataggctacccagggcaagatccgagaggagtcgtgggtgctttcgacatctggggccaggggactatggtaaccgtttctagc

SEQ ID NO: 24582 - RNA, 363 nt, synthetic construct
  misc_feature 1..363: note = derived and/or modified sequence opt3 from anti-HIV_C38-VRC18.02_HeavyChain
  source 1..363: mol_type = other RNA
caggtgagactggtccaaagcggcaaccaggttaggaagcccggggcctccgtgcggatctcttgcgaggcttcaggatacaaattcattgaccactttatacattgggtacgccaggtgcctggtcacggcctcgaatggcttgggtggatcaatccacgaggaggcggtgtcaactatagtcgtagcttccaggggaagctgtccatgaccatgacaagagataattttgaggaaactgcatacttggacttatctaaactgaacccgggagatacggccgtgtatttctgtgcgaggggctttgctggctacgagtggtcgttcatttgggggcaaggaaccctagttatcgtgtcaagc

SEQ ID NO: 24583 - RNA, 396 nt, synthetic construct
  misc_feature 1..396: note = derived and/or modified sequence opt3 from anti-HIV_44-VRC13.02_HeavyChain
  source 1..396: mol_type = other RNA
caggtgcaactggtccagagcggcaccgccctcaagtcccccgggtcttcagctaaacttagttgcacagttctgggagacgagttcggtacttactttatcagctggattagacaggcacctggccaggggttggaatgggtgggaggcatagtaccacactcccaattacagtcttcggcccagaagttccatggtaggatcattatctcagcgggggctggagtgacgccgcccgtcgtgagcctgcagctaaccaacctcacatttgaggatactggcacctatttctgtgcccgggaacgcggccgacaccgtgaccctaaaacaggggatgcactgagaggaaggtactttgacttctggggtcggggcaccgggcttcgcgttagtact

SEQ ID NO: 24584 - RNA, 321 nt, synthetic construct
  misc_feature 1..321: note = derived and/or modified sequence opt3 from anti-HIV-1_LightChain
  source 1..321: mol_type = other RNA
gacatcaagctgacccagagccccgccttcctctccgcttctgtgggcgagagagtcacatttacttgcagggcatcacaagatattagtcacgaccttgtttggttccagcagaaagccgggcgggcgcctagcctgttgatgttttacggatccacgttagaacgcggtgtgccaccgcgattctctggccgtagatcggggaccgagtttacagtaactatagattcactgcagcccgaagacgtgggaacctattactgtcaacagctaagcgctttccctctcacatttggcggtgggaccactgtcgatatcaag

SEQ ID NO: 24585 - RNA, 321 nt, synthetic construct
  misc_feature 1..321: note = derived and/or modified sequence opt3 from anti-HIV-1_LightChain
  source 1..321: mol_type = other RNA
gacatcaagatgacccagagccccgccttcctgtccgcttctgtgggcgagagagtcacatttacttgcagggcatcacaagatattagtcacgacgttgtgtggttccagcagaaaagcgggtccgcccctaagctccttatgttttacggatctacgctggaacggggtgtaccaccgcgcttctcgggccgacgttcagggaccgagtttacagtgactatagatggattgcagcccgaagacgtcggcacctattactgtcaacagttaagcgcgttccctctgacatttggtgggggaaccactgtggatatcaaa

SEQ ID NO: 24586 - RNA, 321 nt, synthetic construct
  misc_feature 1..321: note = derived and/or modified sequence opt3 from anti-HIV-1_LightChain
  source 1..321: mol_type = other RNA
gacatcaagctgacccagagccccgccttcctctccgcttctgtgggcgagagagtcacatttacttgcagggcatcacaagatattcggcacgaacttgtttggtaccagcagaaacctgggcgcggaccaaagctgttgatatattacggtagtacgttagagggcggggtgccgagccgattctccggacgtagatctggcaccgaatttacagtaactatctcgtcactgcagcccgaggacgtgggtacctattactgtcaacagctaaacagcttccctctcacatttgggggaggcaccactgtcgatattagg

SEQ ID NO: 24587 - RNA, 321 nt, synthetic construct
  misc_feature 1..321: note = derived and/or modified sequence opt3 from anti-HIV-1_LightChain
  source 1..321: mol_type = other RNA
gacatccagctgacccaaagcccctccttcctctctgcctcagtgggcgatagagtcagtattacatgcagggctagccaggggataaagcacgagcttgcatggtaccagcagaaacctggacgggccccatccctgttgatctattacgcgtctactttagctcgcggtgttccgtcgcgattttcagccagctggagtggcacgctgttcaccctaacaattaatgggctccaacccgaagactttgcaacttatttctgtcagcagatgaactccctgcctcttacctttggaggcggtacaaagatggatgtgcgt

SEQ ID NO: 24588 - RNA, 321 nt, synthetic construct
  misc_feature 1..321: note = derived and/or modified sequence opt3 from anti-HIV-1_LightChain
  source 1..321: mol_type = other RNA
gacatccagctgacccaaagcccctccttcctctctgcctcagtgggcgataaggtcacaattacttgcagagctagtcacggggttaggaacgagcttgcatggtaccagcagaaacctggaaaggccccaaatctgttgatatattacgcgagcacgttacagtccggtgtgccgtctcggttttcggctaccggctcagggacacatttcactctgaccgtaagcagtctacaacccgaagactttgccacatatttctgtcagcacatgtcctcttaccctctcacctttggaggcggtactaaagtggagatcaag

SEQ ID NO: 24589 - RNA, 321 nt, synthetic construct
  misc_feature 1..321: note = derived and/or modified sequence opt3 from anti-HIV-1_LightChain
  source 1..321: mol_type = other RNA
gacatccagctgacccaaagcccctccttcctctctgcctcagtgggcgataaggtcacatttacttgcagagctagtcagggggttaggaacgagcttgcatggtaccagcagaaacctggaaaggccccaaatctgttgatttattacgcgagcacgttacaatccggtgtgccgtctcggttctcggctaccggctcagggacacactttagcctgactgtaagttccctacagcccgaagacttcgccacctatttttgtcagcatatgtctagctaccctctcacattcggaggcggtaccaaagtggagataaag

SEQ ID NO: 24590 - RNA, 321 nt, synthetic construct
  misc_feature 1..321: note = derived and/or modified sequence opt3 from anti-HIV-1_LightChain
  source 1..321: mol_type = other RNA
gacatccagctgacccaaagcccctccttcctctctgcctcagtgggcgataaggtcacaattacttgcagagctagtcagggggttaggaacgagcttgcatggtaccagcagaaacctggaaaggccccaaatctgttgatatattacgcgagcacgttacaatccggtgtgccgtctcggttttcggctaccggctcagggacacacttcactctgaccgtaagcagtctacagcccgaagactttgccacatatttctgtcagcatatgtcctcttaccctctcacctttggaggcggtactaaagtggagatcaag

SEQ ID NO: 24591 - RNA, 366 nt, synthetic construct
  misc_feature 1..366: note = derived and/or modified sequence opt3 from anti-HIV-1_HeavyChain
  source 1..366: mol_type = other RNA
agccagtacctggcccaacccggcgctgaggtggcaaagcctggggcctccgtcaaagtttcttgcaaggtgcacggagacaacttcagaggtcattatctccactgggtaaggcaggcgccaggccaggggcttcagtggatcggaggcattaatccgttttcaggtgaagctgcctacgggaaacggttcgagggacgcctgcgattgacccgtgatacaagtgtgaacactgcatatatggaattagccaagctgacgcccgacgataccgctgtctacttttgtgcaagagacaaaacatataatgatgagttcactgccatggacatatggggccatggcaccacagtgatcgttagctcc

SEQ ID NO: 24592 - RNA, 366 nt, synthetic construct
  misc_feature 1..366: note = derived and/or modified sequence opt3 from anti-HIV-1_HeavyChain
  source 1..366: mol_type = other RNA
agccagtacctggcccaacccggcgctgaggtggcaaagccttgggcctccgtcaaagtttcttgcagagtgcacggggacaacttcaggggattttatctccattgggtacggcaggcgccaggtcagggccttgaatggatcgggggaattaatccgttctcaggcgaggctgcctacggtcgccgatttgaagggcgtctgagattgaccagggatacaagtataaacactgcatatatggaggtgacgaagttaaccagcgacgatacagccgtctacttctgtgctcgggacaaaacttataatgatgaatttaccgcaatggacatctggggacagggcacaaccgtgattgtttcctct

SEQ ID NO: 24593 - RNA, 366 nt, synthetic construct
  misc_feature 1..366: note = derived and/or modified sequence opt3 from anti-HIV-1_HeavyChain
  source 1..366: mol_type = other RNA
agccagtacctggcccaatccggctctgaggtgaagaaacccggggcttcagtcaaggttagttgcagactccacggagacaaattcggtgcacattatatccactgggtgaggcaggcccctggccaggggcttgaatggctgggatttttccatccaggcaccggtgatgcggtaagcgctcagaagtttcaagggcggatttccttgacacgcgacacttctatatcgacgggatacttagaggtgcgacgtctgtcaagcgatgacaccgccgtctattactgtgcaagagataaaacatatagtgacgaagccactggcatggatatctggggccaggggaccacagtgattgtttcctct

SEQ ID NO: 24594 - RNA, 366 nt, synthetic construct
  misc_feature 1..366: note = derived and/or modified sequence opt3 from anti-HIV-1_HeavyChain
  source 1..366: mol_type = other RNA
agcctggagctcgtgcagtccggcaccgaagtcaagaaacccggggcctctgttaaggtgtcatgcaaacttttcggagacacaatcacgagtggtcctattcactgggtaagacaagctccaggccaggggctggagtggatgggatggactaacccgcatagcggcgataccgcaacagcccccaagtttcagggtagggtgtacatgactaatgacaaaaagataaacaccgcgttcttggatgtcacacggttagcttccgacgataccgccatctatttttgtgcacgcgacatgtactattctaatgaagccgtggggatggatgtttggggacagggcactacagtgtcggtctcaagc

SEQ ID NO: 24595 - RNA, 366 nt, synthetic construct
  misc_feature 1..366: note = derived and/or modified sequence opt3 from anti-HIV-1_HeavyChain
  source 1..366: mol_type = other RNA
caggaggtgctggtccaaagcggcgccgaagttaagaaacccggggcttccgtgaaggtatcttgcagagcattcggatacacctttacagcccacgcgctccattgggtgaggcaggctcctggtcagggccttgagtggctggggtggatcaacccacactcaggagacactacgaccagtcagaaattccaaggccgggtctatatgacacgcgataagagcattaatactgcctacttggaagtgacccgattaacatccgacgataccgcaatattttattgtgcccgtgacaaatactatggtgatgaggctgttgggatggacgtgtggggacagggcacttctgtcacagtgtcgtca

SEQ ID NO: 24596 - RNA, 366 nt, synthetic construct
  misc_feature 1..366: note = derived and/or modified sequence opt3 from anti-HIV-1_HeavyChain
  source 1..366: mol_type = other RNA
caggaggtgctggtccaaagcggcgccgaagttaagaaacccggggcttccgtgaaggtatcttgcagagcattcggatacacctttacaggtaacgccctccactgggtgaggcaggcgcctggccaggggcttgagtggctgggatggatcaatccacattcaggcgacactacgaccagtcagaaattccaaggtcgggtctatatgacacgcgataaggctattaacactgcctacttggacgtgacccgattaacaagcgatgacaccgcaatatattactgtgcccgtgataaatattacgggaatgaagctgttggaatggacgtgtggggccagggcacttccgtcacagtgtcttcg

SEQ ID NO: 24597 - RNA, 366 nt, synthetic construct
  misc_feature 1..366: note = derived and/or modified sequence opt3 from anti-HIV-1_HeavyChain
  source 1..366: mol_type = other RNA
caggaggtgctggtccaaagcggcgccgaagttaagaaacccggggcttccgtgaaggtatcttgcagagcattcggatacacctttacaggtaacgccctccactgggtgaggcaggcgcctggccaggggcttgagtggctgggatggatcaatccacattcaggcgacactacgaccagtcagaaattccaaggtcgggtctatatgacacgcgataagagcattaacactgcctttttggacgtgacccgattaacatccgatgacaccgggatatactattgtgctcgtgataaatactatggaaatgaagcagttggcatggacgtgtggggccaggggacttctgtcacagtgtcgtca

SEQ ID NO: 24598 - RNA, 303 nt, synthetic construct
  misc_feature 1..303: note = derived and/or modified sequence opt3 from anti-HIV_45_LightChain
  source 1..303: mol_type = other RNA
agcctgacccagtcccccggcacactctctctttcacctggggagactgccatcattagttgcagaacgagccaatacggatccctggcttggtatcagcagaggccaggtcaggcaccgcggttggtgatatactctggctcgacccgcgccgcggggatccccgaccgattctcaggaagccgttggggccctgattataacttaacaattagtaatctggaatccggtgactttggggtctactattgtcaacagtacgagttctttggacagggcactaaggttcaggtggatatcaaa

SEQ ID NO: 24599 - RNA, 303 nt, synthetic construct
  misc_feature 1..303: note = derived and/or modified sequence opt3 from anti-HIV_45_LightChain
  source 1..303: mol_type = other RNA
gtgctgacccagagccccggcacactctccctttctcctggggagactgccacgatctcatgcagaaccagtcaatacggaagcctggcttggtatcagcagaggccaggtcaggcaccgcggttggtcatttactccggctctacacgcgccgcggggatacccgaccgattctcgggatcacgtagcggccctgattatactttaaccatcagtaacctggaatccggtgactttggggtttactattgtcaacagtacgagttctttggacagggcacaaaggtgcagcaagataataaa

SEQ ID NO: 24600 - RNA, 303 nt, synthetic construct
  misc_feature 1..303: note = derived and/or modified sequence opt3 from anti-HIV_45_LightChain
  source 1..303: mol_type = other RNA
gtgctgacccagagccccggcacactctccctttctcctggggagactgccatcatttcatgcagaacgagtcaatacggaagcctggcttggtatcagcagaggccaggtcaggcaccgcggttggtcatatactccggctctacccgcgccgcggggatccccgaccgattctcgggatcacgttggggccctgattataacttaacaattagcaatctggaaagtggtgactttggggtttactattgtcaacagtacgagttctttggacagggcactaaggtgcaggtagatatcaaa

SEQ ID NO: 24601 - RNA, 363 nt, synthetic construct
  misc_feature 1..363: note = derived and/or modified sequence opt3 from anti-HIV_45_HeavyChain
  source 1..363: mol_type = other RNA
caggtgagactgagccaatccggcgggcagatgaagaaacccggagagtctatgaggatctcatgccgggccagtggttacgagttcattgactgtaccctcaactggatacgccttgctcctggccgacgtccagaatggatggggtggctgaagccgagaggaggcgcagtcaattatgccagggtttttcagggtcgggtgacaatgactcgcgatgtatacagcgacacggcgttcttggaattaagatccctgaccgctgatgacacagccgtgtatttttgcactagggggaaaaccgtcgattacaactgggacttcgagcacgtgggacccggcacacctgttaccgtgtcttcg

SEQ ID NO: 24602 - RNA, 363 nt, synthetic construct
  misc_feature 1..363: note = derived and/or modified sequence opt3 from anti-HIV_45_HeavyChain
  source 1..363: mol_type = other RNA
caggtgagactgagccaatccggcgggcagatgaagaaacccggagagtctatgaggatctcatgccaggccagtggttacgagttcattgactgtaccctcaactgggtccggcttgctcctggccgccgaccagaatggatggggtggctgaagccgcgtggaggcgcagttaattatgccagaatatttcagggtagggtgacaatgactcgggatgtatacagcgacacggcgttcttggaattacgctccctgaccgctgatgacacagccgtgtatttttgcactagagggaaaaactgtgattacaattgggacttcgagcacgtcggacccggctatcctgtgaccgtttctcca

SEQ ID NO: 24603 - RNA, 375 nt, synthetic construct
  misc_feature 1..375: note = derived and/or modified sequence opt3 from anti-HIV_45_HeavyChain
  source 1..375: mol_type = other RNA
caggtgagactgagccaatccggcgggcagatgaagaaacccggagactctatgaggatctcatgccgggccagtggttacgagttcattaactgtcctataaattggatccgcctcgctccaggcaagcgaccggaatggatggggtggatgaaaccccgtggaggcgcagtcagctatgccagacagcttcagggtagggttaccatgacacgggatatgtactccgagactgcgtttctggaattgcgctctttaacgtcggacgataccgctgtgtatttctgcacaagagggaagtactgtactgccagggactattacaactgggattttgagcactggggacaaggcacccctgtaacagtgtcaagc

SEQ ID NO: 24604 - RNA, 435 nt, synthetic construct
  misc_feature 1..435: note = derived and/or modified sequence opt3 from anti-HIV_cap256-206-252885_VR-Chain
  source 1..435: mol_type = other RNA
caggagcaactggtggaaagcggcgggggagtcgttccccctggttcctctctcaccctttcatgcgtggccagtagattcacatttagcgctttcggcatgcactgggtaaggcaggcaccagggaagggactggagtgggtggccggcgtctcctttgtgggtatcaaaaagtactatgcggactctgttaaagggcggttcactatttcgcgcgataactcaaagaatacgttgtttttacagatgaacggactgcgaggcgaagacaccggcctatactattgtgtgaaagatatgcgttacctcgagtgcgaagagtgggctagcgactattacgatttcgggaagccgaatcagccctgtctggacagaaggggagtcagtggtatatccgccttttggggccaagggacaactgtgaccgtatctagc

SEQ ID NO: 24605 - RNA, 438 nt, synthetic construct
  misc_feature 1..438: note = derived and/or modified sequence opt3 from anti-HIV_cap256-206-249183_VR-Chain
  source 1..438: mol_type = other RNA
caggtgctgctcgtcgagagcggcgggggagttgtggaacccggtacctcccttacactgtcttgcgccgcttcaagattcacttttagtaacttcggcatgcactgggtaaggcaaacgcctgggggaggcttggagtgggtggcaagcatctccaatgaaggtaacaagaaataccatgccgagtctgtctgggggcggtttattatatcgcgcgacaattcaaagaacaccgtgttcttacacatgagcagtctgcgaccagatgactccgcgctatatttttgtgttcgtgatagacaggaagacgattgcgaggtgtggtggtctgactacgaggctttcggaagggaaatcccgtgtcggcagtatcgcggccagggcctcgccgggatttttgatatctggggaagaggtacaatggtcactgtgagctcc

SEQ ID NO: 24606 - RNA, 438 nt, synthetic construct
  misc_feature 1..438: note = derived and/or modified sequence opt3 from anti-HIV_cap256-206-220956_VR-Chain
  source 1..438: mol_type = other RNA
cagatgatgctggtggagagcggcggggacgtcgttgaacccggaagatccctcaccctttcttgcgccacatcacaattcacttttagtaactacggtatgcactgggtgaggcaggctcctggccgggggctggagtgggtagcaagcatctccaatgaaggaaacaagaaatatcatgccgagtctgtgtggggccgcttgattatatcgcgagataattcaaagaacacgttattcctgcacatgagcagtctacgtgcggacgattccgctctctacttttgtgtcagagacaggcaggaagatgagtgcgaggaatggtggtctaattattacgccttcggtcgcgggggaccatgtcggaaatatagaggccagggcctggcagggatctttgacgtgtggggaaggggtaccatggttacagtgagctcc

SEQ ID NO: 24607 - RNA, 432 nt, synthetic construct
  misc_feature 1..432: note = derived and/or modified sequence opt3 from anti-HIV_cap256-206-220629_VR-Chain
  source 1..432: mol_type = other RNA
caggagcaactggtggaaagcggcgggggagtcgttccccctggtaagtccctcaaactttcttgcgtggcctcaagattcagttttggcgctttcgggatgcactgggtaaggcaggcaccaggaaagggcctggagtgggtggccggtatcagctttgcggggattaaaaagtactatggagactccgtcaaaggccggttctacatatctcgcgataactcgcagaataccttgtttttagaaatgaacggcctgcgaggggacgatacagctcgttattactgtgtgaaggacctaagagagctcgaatgcgaggagtgggcctcagattattacgacttcggaaagccgcagccctgtctggatagcaggggtgttagtggcatctccgcaatgtgggggcctggaactatggtgacggtctctagc

SEQ ID NO: 24608 - RNA, 381 nt, synthetic construct
  misc_feature 1..381: note = derived and/or modified sequence opt3 from anti-HIV_cap256-206-200599_VR-Chain
  source 1..381: mol_type = other RNA
caggagaagctggtggaaagcggcgggggagccgtccaacccggtggctccctcagactttcttgcgttgcttcagggttcacctttaacggattcggcatgcactgggtgaggcaggcacctggtaaagggctggagtgggtagccacaatcagttttagcggagtgtacatttcccgggaaaattctaagaacactttgtatttacagatgaatggcctgcgcggcgaggacacggcgctatactattgtgctaaagatctccgatacctggaatgcggggagtggtcgacctattacccacagccgtgtcttgacacacgtggagtctcaggtataagcaacgtgtggggccccgggactagagttaccgtgagttcc

SEQ ID NO: 24609 - RNA, 432 nt, synthetic construct
  misc_feature 1..432: note = derived and/or modified sequence opt3 from anti-HIV_cap256-206-186347_VR-Chain
  source 1..432: mol_type = other RNA
caggagctgctcgtggaaagcggcgggggagtcgttccccctggtaagtcccttaccatctcttgcgtggcctcaagattcacatttagtgctttcggcatgcactgggtaaggcaagcaccagggaaaggactgcagtgggtggccagcatttcctttgcgggcactaagaaatactatgctgacttcgtcaagggtcggtttacgatatctcgcgataactcgaaaaataccatcttcttgcagatgaacgggttacgaggagaggacacagccctgtaccattgtgtgaaggatatgcgtcagctagaatgcgaggaatggacttcagactattacgattttggcagaccgcaaccctgtattgacaggcggggcgttagcgggatcagtgcaatgtggggacctggtaccatggtgacagtctcctct

SEQ ID NO: 24610 - RNA, 438 nt, synthetic construct
  misc_feature 1..438: note = derived and/or modified sequence opt3 from anti-HIV_cap256-206-186226_VR-Chain
  source 1..438: mol_type = other RNA
cagatgctgctcgtggagagcggcgggggagtcgttgaacccggtagatcccttaccctgtcttgcgccacatcacaattcacttttagtaactacggcatgcactgggtgaggcagacgcctgggaccggattggagtgggtagctagcatctccaatgaaggcaacaagaaatatcatggtgaggcagtgtgggggcggttcattatatctcgcgacaattcgaagaaaacattatttctgcacatgtcaaacctacgagccgatgacagcggactctacttctgtgtccgtgatagacaggaagacgagtgcgaggaatggtggagtgattattactcctttggcaggggcgggccatgtcggaagtatcatggacagggtctggcgggcatcttcgacatttgggggcgcggaactcttgtgaccgtttctagc

SEQ ID NO: 24611 - RNA, 435 nt, synthetic construct
  misc_feature 1..435: note = derived and/or modified sequence opt3 from anti-HIV_cap256-206-179686_VR-Chain
  source 1..435: mol_type = other RNA
caggagcaactggtggaaagcggcgggggagtcgttcccccttggaagtccctcaccctttcttgcgaggcctcaagattcacatttagtgctttcggtatgcactgggtgaggcaggcaccaggcaaagggctggaatgggtagccggaatcagctttgcgggcattaagaaatactatgctgactccgtgaagggtcggttctttatatctcgcgataactcgaaaaatcgagtcttgttagagatgaacgggctgcgtagagaagacactgccaggtacttctgtgtgaaggatctacgggagctcgagtgcgaagagtgggcatcagactattacgattttggaaagccgaatcagccctgtctggaccgcagaggcgttagcggcatcagtgccatgtgggggcagggaacgatggtgaccgtctcctct

SEQ ID NO: 24612 - RNA, 417 nt, synthetic construct
  misc_feature 1..417: note = derived and/or modified sequence opt3 from anti-HIV_cap256-206-173707_VR-Chain
  source 1..417: mol_type = other RNA
caggagaagctggtggaaagcggcgggggagccgtccaacccggtggctccctcagactttcttgcgttgcttcagggttcacctttaaaggattcggcatgcactgggtgaggcaggcacctggtaaggggctggagtgggtagccacaatcagttttagcggagtgaaaaagtactatggcaactccgcgaaaggccggttctttatttctcgcgacaatttgaagaacactgtctacttagaaatgaatgggctgcgaggagaggatacggctctatattactgtgccaaggacctccgttatctggaatgcggtgagtggtcgacctactatccacagccgtgtcttgatacaagaggcgtgtcagggataagcaacgtttggggacccggcactaaagtgaccgtcagttcc

SEQ ID NO: 24613 - RNA, 432 nt, synthetic construct
  misc_feature 1..432: note = derived and/or modified sequence opt3 from anti-HIV_cap256-206-173339_VR-Chain
  source 1..432: mol_type = other RNA
caggagctgctcgtggaaagcggcgggggagtcgttccccctggtaagtcccttaaactgtcttgcgtggcctcaagattcacctttggcgctttcgggatgcactgggtaaggcaagcaccaggaaagggcttggagtgggtggccggtatcagttttgcggggactaaaaactactatgctgacagcgtcaagggacggttcacaatttcccgcgataatccgaaaaacacgttatttctgcagatgaatggcctacgaggcgacgataccgggctctactattgtgtgaaggacatgcgtgaactggagtgcgaactttggacatctgattactatgacttcggaagaccccagccttgtatagatcagaggggtgtttcgggcatctcagccatgtgggggcaaggaactatggtgaccattagcagt

SEQ ID NO: 24614 - RNA, 438 nt, synthetic construct
  misc_feature 1..438: note = derived and/or modified sequence opt3 from anti-HIV_cap256-206-172689_VR-Chain
  source 1..438: mol_type = other RNA
cagatgatgctggtggagagcggcgggggagtcgttgaacccggtagatccctcaccctttcttgcgccacatcacacttcacttttagtaactacggcatgcattgggtgaggcaagctcctgggggacggctggagtgggtagcaagcatctccaatgccggcaacaagaaatatcacggtgactctgtgtgggggcgcttgattatatcgcgagataattcaaagaacacgttattcctgcatatgagcagtctacgtgtcgacgattccgcgctctacttttgtgtgagagacaggcaggaagatgagtgcgaagagtggtggtctgactattacgctttcggacggggcggcccatgtcgcaaatatagagggcagggactggccggtatctttgatatttggggcagggggaccatggttacagtgagctcc

SEQ ID NO: 24615 - RNA, 432 nt, synthetic construct
  misc_feature 1..432: note = derived and/or modified sequence opt3 from anti-HIV_cap256-206-162744_VR-Chain
  source 1..432: mol_type = other RNA
caggagaagctggtggaaagcggcgggggagtcgttccccctggtaaatccctcagactttcttgcgtggcctcaggcttcacctttagtgctttcgggatgcactgggtaaggcaagcaccaggaaagggcctggagtgggtggccggtatcagctttgcggggattaaaaactactatgctgactccgtcaagggacggttcacaatatctcgcgataattcgaaaaactcattgtttttacagatgaatggcctgcgaggcgacgatactgcccgttactattgtgtgaaggacatgagagaactagagtgcgaagagtggacgagcgattactatgacttcgggaagccgcagccctgtatcgataggcggggagttagtggtatttccgcaatgtggggccaggggaccatggtgacaatctctagc

SEQ ID NO: 24616 - RNA, 438 nt, synthetic construct
  misc_feature 1..438: note = derived and/or modified sequence opt3 from anti-HIV_cap256-206-146057_VR-Chain
  source 1..438: mol_type = other RNA
cagatgcaactggtggagagcggcgggggagtcgttcagcccggtacctccctcacactttcttgcgtggcctcacagttcacttttagtaactacggcatgcactggatcagacaggctcctgggcaaggactggaatgggtagcaagcatttccaatgacggcggtaagaggtatcatggggatgccgtgtgggcgcggttcataatctctcgcgacaactcgaaaaatacggtctttttgcagatgacctcattacgagctgaggatacagcccgttacttctgtgtgagagacaggcaggaagatgagtgcctggaatggtggagcgactattacaactttggacggcagctaccatgtgcaaagttccgcggcctcggcctggccggggtttttgatatttggggacacggtactatggtgaccgtcagttcc

SEQ ID NO: 24617 - RNA, 435 nt, synthetic construct
  misc_feature 1..435: note = derived and/or modified sequence opt3 from anti-HIV_cap256-206-139519_VR-Chain
  source 1..435: mol_type = other RNA
caggagcaactggtggaaagcggcgggggagtcgttccccctggtacctccctcagactttcttgcgtggcctcaaggttcagttttggcagcttcgggatgcactgggtacggcaggctccaggaaagggcctggagtgggtggcaggtatctcctttgtcgggattaaaaagtactatggagactctgtgaaaggccgcttctttatatcgcgagataactcaaagaatacattgttcttagaaatgaacggcctgcgtggggaggacactgccagatactattgtgttaaagatatgagggaactagagtgcgaggaatgggcgagcgactactatgattttggaaagccgaatcagccctgtctcgaccggcgcggtgtgagtggcatctccgctatgtgggggcctggaacgatgctgaccgtctctagc

SEQ ID NO: 24618 - RNA, 432 nt, synthetic construct
  misc_feature 1..432: note = derived and/or modified sequence opt3 from anti-HIV_cap256-206-136316_VR-Chain
  source 1..432: mol_type = other RNA
caggagcaactggtggaaagcggcgggggagtcgttccccctggtaagtccctcaccctttcttgcgtggcctcaggcttcacatttagtgctttcgggatgcactgggtaagacaggcaccaggaaaaggcctggagtgggtggccggtatcagctttgtcgggattaagaaatactatggagactccgtgaagggcaggttcactatatctcgggataactcgaaaaatacgttgtttttacagatgaacggcctgcgcggggacgataccgcgctataccattgtgttaaggacatgcgacagctcgaatgcgaggaatggacatcagattattacgacttcggaaagccgcaaccctgtatcgatcctcgtggtgtgagcggcattagtgctatgtgggggcagggaactatggtcaccgtgtcctct

SEQ ID NO: 24619 - RNA, 438 nt, synthetic construct
  misc_feature 1..438: note = derived and/or modified sequence opt3 from anti-HIV_cap256-206-116098_VR-Chain
  source 1..438: mol_type = other RNA
cagatgatgctggtggagagcggcgggggagtcgttgaacccggtagatccctcaccctttcttgcgccgcttcacaattcacatttagtaactacggcatgcactgggtgaggcaggcacctgggcgggagctggaatgggtagccagcatctccaatgcgggaaacaagaaatatcatggcgaggctgtgtggggtcgcttgattatatctcgagacaattcgaagaacactttattcctgcacatgtcaaatctacgtccagatgacagcgccctctacttttgtgtcagagataggcaggaagacgagtgcgaggaatggtggagtgattattacgcattcgggcggggaggcccgtgtcgcaaatatcatggccaggggctggccggaatctttgacatttggggtagaggcacgatggtgaccgtttcctct

SEQ ID NO: 24620 - RNA, 432 nt, synthetic construct
  misc_feature 1..432: note = derived and/or modified sequence opt3 from anti-HIV_cap256-206-115862_VR-Chain
  source 1..432: mol_type = other RNA
caggagcaactggtggaaagcggcgggggagtcgttccccctggtaagtccctcagactttcttgcgtgggctcaaggttcacctttagtgccttcgggatgcactgggtacggcaggctccaggaaaaggcctggagtgggtggcaagcatctcctttgccggtacaaagaaatactatgtcgactctgtgaaggggcgcttctttatttcgcgagataacagcaaaaatactgttttcttggaaatgaacggattacgtggcgaggacacgggcctgtactattgtgtgaaggatatgagagaactagagtgcgaggaatgggcgtcagactactatgattttgggaagccgcagccctgtctcgacaggcggggagtcagtggtatatccgctatgtggggccaggggaccctggtgatcatttctagc

SEQ ID NO: 24621 - RNA, 435 nt, synthetic construct
  misc_feature 1..435: note = derived and/or modified sequence opt3 from anti-HIV_cap256-206-107018_VR-Chain
  source 1..435: mol_type = other RNA
caggagcaactggtggaaagcggcgggggagtcgttccccctggtaagtccctcaccctttcttgcgtggcctcaagattcagttttagcgctttcggcatgcactgggtaaggcaggcaccagggaaaggactggagtgggtggcctccatctcttttgtcggcattaagaaatactatggtgactcggtgaaggggcggttctttatatcacgcgataacagcaaaaatacagttttcttggaaatgaacggattacgaggcgaggacactggcctgtactattgtgtgaaggatatgcgtgaactagagtgcgaggaatgggcgagtgactactatgattttgggaagccgaatcagccctgtctcgacagaaggggagtctccggtatctctgctatgtggggccaggggacgctggtgattgtaagctcc

SEQ ID NO: 24622 - RNA, 438 nt, synthetic construct
  misc_feature 1..438: note = derived and/or modified sequence opt3 from anti-HIV_cap256-206-098644_VR-Chain
  source 1..438: mol_type = other RNA
cagatgctgctcgtggagagcggcgggggagtcgttgaacccggtagatcccttaccctgtcttgcgccgcttcacaattcacatttagtaactacggcatgcactgggtgaggcaggcacctgggggaggcttggagtgggtagccagcatctccaatgaaggtaacaagcggtatcatggggagtctgtgtggggacgcttcgtcatttcgcgagacaatagcaaaaacactttatttctgcacatgtcaacgctacgtccagatgacagtgcgctctacttctgtgtgagagataggcaggaagacgagtgcgaggaatggtggtccgattattacgcttttggccggggcgggccgtgtcgcaagtatcatggacagggtctggccggcatattcgacgtttgggggagaggaaccatggtgacaggccttttt

SEQ ID NO: 24623 - RNA, 417 nt, synthetic construct
  misc_feature 1..417: note = derived and/or modified sequence opt3 from anti-HIV_cap256-206-098135_VR-Chain
  source 1..417: mol_type = other RNA
caggagaagctggtggaaagcggcgggggagccgtccaacccggtggctccctcagactttcttgcgttgcttcagggttcacctttagtggattcggcatgcactgggtgaggcaggcacctggtaaagggctggagtgggtagccacaatcagcttttccggaatgaagaaatactatggcacttctgcgaagggccggttctcgatttaccgcgacaacagcaaaaatacgttgtatttacagatggatgggctgcgagaaaaggacaccgctctatactattgtgccaaggatctccgttacctggagtgcggagaatggtcaacatattacccacagccgtgtcttgacagaaggggtgtgagtggcatatccaacgtctgggggcccggaactatggtgaccgtttctagc

SEQ ID NO: 24624 - RNA, 435 nt, synthetic construct
  misc_feature 1..435: note = derived and/or modified sequence opt3 from anti-HIV_cap256-206-096276_VR-Chain
  source 1..435: mol_type = other RNA
caggagcaactggtggaaagcggcgggggagtcgttccccctggttcctctctcagactttcatgcgtggccagtaggttcacctttagcgctttcggcatgcactgggtacggcaggcaccagggaagggactggagtgggtggccggcatctcctttgtcggtattaaaaagtactatgcggactctgtgaaagggcgcttcacaatatcgcgagataactcaaagaatactttgtttttacagatgaacggactgcgtggcgaagacacgggcctatactattgtgttaaagatatgagagagctcgaatgcgaggagtggaggagcgactactatgatttcgggaagccgaatcagccctacctggaccggcgcggagtgagtggtatctccgctttttggggccaagggaccatggtcacagtgtctagc

SEQ ID NO: 24625 - RNA, 438 nt, synthetic construct
  misc_feature 1..438: note = derived and/or modified sequence opt3 from anti-HIV_cap256-206-092794_VR-Chain
  source 1..438: mol_type = other RNA
cagatgatgctggtggagagcggcgggggagtcgttgaacccggtagatccctcaccctttcttgcgccacatcacaattcacttttagtaactacggcatgcactgggtgaggcaggctcctgggcggggactggagtgggtagcaagcatctccaatgaaggcaacaagcgctatcatggtgagtctgtgtgggggcgattcattatatcgcgtgacaatagcaaaaacacgttgtttttacacatgtcaaccctgagagccgatgacagtgcgctatacttctgtgtcagggatcggcaggaagacgagtgcgaggaatggtggtccgattattacgcttttggacgcggcggcccatgtagaaagtatcatgggcagggactcgccggtatcttcgacattgtgggcagggggacactggttactgtgtctagc

SEQ ID NO: 24626 - RNA, 432 nt, synthetic construct
  misc_feature 1..432: note = derived and/or modified sequence opt3 from anti-HIV_cap256-206-086817_VR-Chain
  source 1..432: mol_type = other RNA
caggagcaactggtggaaagcggcgggggagtcgttccccctggtaagtccctcagactttcttgcgccgcttcaggcttcagttttggggcattcggaatgcactgggtgaggcaggccccaggcaaaggtctggagtgggtagcggggatcagctttgtgggaattaagtactattacgctgactccgtcaaaggccggttcaccatatctcgcgataactcgaagaatacagtgtttttgcagatgaacggcttacgaggggacgatactggacgttattactgtgttaaagacatgagagaactggagtgcgaagagtggacgtcagattattacgacttcggtaagccgcagccctgtatcgataggcggggcgtgagcgggattagtgccatgtggggacaaggcaccatggtcacaatctcctct

SEQ ID NO: 24627 - RNA, 432 nt, synthetic construct
  misc_feature 1..432: note = derived and/or modified sequence opt3 from anti-HIV_cap256-206-086446_VR-Chain
  source 1..432: mol_type = other RNA
caggagcaactggtggaaagcggcgggggagtcgttccccctggtaagtccctccggctttcttgcgtggcctcaaggttcacctttagtgctttcggcatgcactgggtacggcaggcaccagggaaaggactggagtgggtggccggcatcagctttgtcggtattaagaaatactattccgacgcggtgaaggggcgcttctacatatctcgagataactcgaaaaatacattgtttttagaaatgaacggactgcgtggcgacgatactgctagatattactgtgttaaggacctaagggagctcgaatgcgaggagtgggcctcagattattacgacttcggcaagccgcagccctgtctggatagcagaggggtgagtggaatctccgcaatgtggggtcagggcacgatggtcaccgtgtctagc

SEQ ID NO: 24628 - RNA, 432 nt, synthetic construct
  misc_feature 1..432: note = derived and/or modified sequence opt3 from anti-HIV_cap256-206-086180_VR-Chain
  source 1..432: mol_type = other RNA
caggagcaactggaagagagcggcgggggagtggttccccctggtaagtccctcagactttcttgcgtcgcctcaaggttcacctttagtgctttcggcatgcactgggtgcggcaggcaccagggaaaggactggaatgggtagccggcatcagctttgtgggtattaagaaatactatgcggactccgtcaaggggcgcttcacaatatctcgagataactcgaaaaatactttgtttttacagatgaacggactgcgtggcgacgatacgggcctatacttctgtgtgaaggacatgagagagctcgaatgcgagcagtggacctcagattattacgactttgggaagccgcaaccctgtatcgatcctaggggagttagcggtattagtgctatgtggggccaggggacaatggtgactgtctcctct

SEQ ID NO: 24629 - RNA, 435 nt, synthetic construct
  misc_feature 1..435: note = derived and/or modified sequence opt3 from anti-HIV_cap256-206-083708_VR-Chain
  source 1..435: mol_type = other RNA
caggagcaactggtggaaagcggcgggggagtcattccccctggtcagtccctccggctttcttgcgttgcctcaaggttcacctttagtgctttcggcatgcactgggtgcggcaggcaccagggaagggactggagtgggtaagctccgtgtcttttgccggcatcaaaaagtactatgcggactcggtcaaaggtcgcttctttatatcacgagataacagcaagaatacagtgttcttggaaatgaacgggttacgtggagaggacactggcctgtactattgtgttaaagatatgagagaactagagtgcgaggaatgggctagtgactactatgattttggcaagccggaccagccctgtctcgataggagaggggtgtccggaatctctgccatgtggggtcaaggcacgctggtcattgtgagctcc

SEQ ID NO: 24630 - RNA, 432 nt, synthetic construct
  misc_feature 1..432: note = derived and/or modified sequence opt3 from anti-HIV_cap256-206-079556_VR-Chain
  source 1..432: mol_type = other RNA
caggagcaactggtggaaagcggcgggggagtcgttccccctggtaagtccctcagactttcttgcgtggcctcaggcttcacctttagtgggttcggaatgcactgggtaaggcaggctccaggcaaaggtctggagtgggtggcagggatcagctttgtcggaattaagtactattacgccgactccgtgaaaggccggttctctatatcgcgcgataactcaaagaatacattgtttttacagatgaacggcctgcgaggggacgatactgcgctatattactgtgttaaagacatgcgtgaactcgagtgcgaagagtggacgagcgattattacgacttcggaaagccgcagccctgtatcgatagaaggggtgtgagtggcatttccgctatgtgggggcaaggaaccatggtcacagtgtctagc

SEQ ID NO: 24631 - RNA, 438 nt, synthetic construct
  misc_feature 1..438: note = derived and/or modified sequence opt3 from anti-HIV_cap256-206-078657_VR-Chain
  source 1..438: mol_type = other RNA
cagatgctgctcgtggagagcggcgggggagtcgttgaacccggtagatcccttaccctgtcttgcgccacatcacaattcacttttagtaactacggcatgcactgggtgaggcaggctcctgggcggggattggagtgggtagcaagcatctccaatgaaggctctaagaaatatcatggtgagccagtgtgggggcgcttcattatatcgcgagacaactcaaagaaaacgttatttctgcacatgagcaatctacgtgtcgatgacagtgccctctacttctgtgtgagagataggcaggaagacgagtgcgaggaatggtggtccgattattacgcgtttggacggggcggcccgtgtcgcaagtatcatgggcagggactggctggtatcttcgacatttggggcagagggaccatggttacagtgtctagc

SEQ ID NO: 24632 - RNA, 438 nt, synthetic construct
  misc_feature 1..438: note = derived and/or modified sequence opt3 from anti-HIV_cap256-206-075802_VR-Chain
  source 1..438: mol_type = other RNA
cagatgctgctcgtggagagcggcggggacgtcgttgaacccggaaagtcccttaccctgtcttgcgccacatcaagattcacttttagtaactacggtatgcactgggtgaggcaagctcctggcgggggattggagtgggtagcaagcatctccaatgaaggcaacaaaaagtatcatggtgagtctgtgtgggggcggttcattatatcgcgcgataatagcaaaaacacgttatttctgcacatgtcagccctacgaaccgacgatagtgcgctctacttctgtgtccgtgacagacaggaagatgagtgcgaggaatggtggtccgactattacgcttttggaaggggcggcccatgtcggaagtatcatgggcagggactggccggtatcttcgatatttggggccgcgggacaatggtgactgtttctagc

SEQ ID NO: 24633 - RNA, 438 nt, synthetic construct
  misc_feature 1..438: note = derived and/or modified sequence opt3 from anti-HIV_cap256-206-069097_VR-Chain
  source 1..438: mol_type = other RNA
cagatgctgctcgtggagagcggcgggggagtcgttgaacccggtagatcccttaccctgtcttgcgccacatcaaggttcacttttagtaactacggcatgcactgggtgcggcaagctcctgggcgcgagttggaatgggtagcaagcatctccaatgagggaaacaagaaatatcatgccgaatctgtgtggggccgattcattatatcgcgtgacaattcaaagaacacgttatttctgcacatgagcaatgtcagaggtgatgacagtgcgctatacttctgtgtgagggatcggcaggaggacgagtgcgaagagtggtggtccgattattacgcttttgggcgcggaggcccatgtagaaaatatcatggccaggggctcgccggaatcttcgacgtttggggtaggggcaccgtggtcacagtgtctagc

SEQ ID NO: 24634 - RNA, 438 nt, synthetic construct
  misc_feature 1..438: note = derived and/or modified sequence opt3 from anti-HIV_cap256-206-067758_VR-Chain
  source 1..438: mol_type = other RNA
cagatgctgctcgtggagagcggcgggggagtcgttgaacccggtagatcccttaccctgtcttgcgccgcttcacaattcacatttagtcactacggcatgcattgggtgaggcaggcacctgggcggggattggagtgggtagccagcatctccaacgaaggcaataagcgctatcacggtgagtctgtgtgggggcgattcattatatcgcgtgacaacagcaaaaatactttatttctgcatatgtcagcgctaagaacggatgacagtgctctctacttctgtgtcagggatcggcaggaagacgagtgcgaggaatggtggtccgattattacgcctttggacgcggcggcccatgtagaaagtggcacgggcagggactggcaggtatcttcgacatttggggcagggggaccgtggttacagtgtctagc

SEQ ID NO: 24635 - RNA, 417 nt, synthetic construct
  misc_feature 1..417: note = derived and/or modified sequence opt3 from anti-HIV_cap256-206-057019_VR-Chain
  source 1..417: mol_type = other RNA
caggagaagctggtggaaagcggcgggggagccgtccaacccggtggctccctcagactttcttgcgttgcttcagggttcagttttagcggatacggcatgcactgggtgaggcaggcacctggtaaagggctggagtggttggccaccatctccttctctggagtaaagaaatattacggcacatcggcgaagggccggttttatatttaccgcgacaacactaaaaatacgatgtatttagaaatgaacgggctgcgaggagaggataccgctctatactattgtgccaaggacctccgttacctggaatgcggtgagtggtcaacatactatccacagccgtgtcttgatactagaggcgtgagcgggataagtaatgtctggggacccggcaccatggtgacagtttcctct

SEQ ID NO: 24636 - RNA, 438 nt, synthetic construct
  misc_feature 1..438: note = derived and/or modified sequence opt3 from anti-HIV_cap256-206-055385_VR-Chain
  source 1..438: mol_type = other RNA
cagatgatgctggtggagagcggcgggggagtcgttgaacccggtagatccctcaccctttcttgcgccgcttcaaagttcacatttagtaactacggcatgcactgggtgaggcaagcacctgggcggggactggagtgggtagccagcatctccaatgaaggcaacaaaaagtatcatggtgagccagtgtgggggcgcttgattatatctcgagacaattcgaaaaacactttattcctgcacatgtcagatctacgtgcggacgatagcgctctctacttttgtgtcagagacaggcaggaagatgagtgcgaggaatggtggagtaattattacgccttcggacggggcggcccgtgtcgcaagtggagagggcagggactggcaggtatctttgacgtgtggggcagggggacgatggttaccgtgtcctct

SEQ ID NO: 24637 - RNA, 435 nt, synthetic construct
  misc_feature 1..435: note = derived and/or modified sequence opt3 from anti-HIV_cap256-206-053187_VR-Chain
  source 1..435: mol_type = other RNA
caggagcaactggtggaaagcggcgggggagtcgttccccctggttcctctctcagactttcatgcgtggccagtaggttcacctttagcgctttcggcatgcactgggtacggcaggcaccagggaagggactggagtgggtggccggcatctcctttgtcggtattaaatactattacgcggactctgtgaaggggcgcttcacaatatcgcgagataacagcaaaaatactttgtttttacagatgaacggactgcgtggcgaagacacgggcctatattactgtgttaaggatatgagagagctcgaatgcgaggagtgggcttcagactattacgatttcgggaaaccgaatcagccctgtctggacaggcggggagtgagtggtatctccgccttttggggccaagggaccatggtcacagtgtctagc

SEQ ID NO: 24638 - RNA, 438 nt, synthetic construct
  misc_feature 1..438: note = derived and/or modified sequence opt3 from anti-HIV_cap256-206-053139_VR-Chain
  source 1..438: mol_type = other RNA
cagatgctgctcgtggagagcggcggggacgtcgttgaacccggaagatcccttaccctgtcttgcgccacatcacaattcacttttagtaactacggtatgcactgggtgaggcaggctcctggccgggggttggagtgggtagcaagcatctccaatgaaggatctaagaaatatcatggcgagtcggtgtggggtcgcttcattatatcacgagataacagcaagaatacgttatttctgcacatgaccacactacgtccagacgatagtgccctctacttctgtgtcagagacaggcaggaagatgagtgcgaggaatggtggtccgactattacgcgtttgggcggggaggcccgtgtcgcaaatatcatggccaggggctggctggaatcttcgatatttggggtagaggcactatggtgaccgtttctagc

SEQ ID NO: 24639 - RNA, 432 nt, synthetic construct
  misc_feature 1..432: note = derived and/or modified sequence opt3 from anti-HIV_cap256-206-050350_VR-Chain
  source 1..432: mol_type = other RNA
caggagcaactggtggaaagcggcgggggagtcgttccccctggtaagtccctcaaactttcttgcgtggcctcaaggttcagttttggcgctttcgggatgcactgggtaaggcaggcaccaggaaagggcctggagtgggtggccggtatcagctttgtcgggattaaaaagtactatgcggactccgtgaaaggacggttctacatatctcgcgataactcgaagaataccgtgtttttggaaatgaacgctttacgaggcgaggacacagccctgtatcattgtgttaaggatatgcgtgaactagagtgcgaggaatgggcatcagactactatgatttcggcaaaccgcagccctgtctcgacagaagaggggtcagcggaatcagtgccatgtggggtcctggcactatggtgattgtatcctct

SEQ ID NO: 24640 - RNA, 432 nt, synthetic construct
  misc_feature 1..432: note = derived and/or modified sequence opt3 from anti-HIV_cap256-206-046207_VR-Chain
  source 1..432: mol_type = other RNA
caggagcaactggtggaaagcggcgggggagtcgttccccctggtacctccctccggctttcttgcgtggcctcaaggttcacatttagtgctttcggcatgcactgggtacggcaggcaccagggaagggactggagtgggtggccggcatcagctttgcgggtattaaaaagtactatgctgactccgtcaaagggcgcttcactatatctcgagataactcgaaaaattcattgtttttagaaatgaacggactgcgtggcgacgatacggccctatactattgtgtgaaggacctcagatacctggagtgcgaactttggaccagcgattattacgacttcggcaggccgcagccctgtatcgatagtagaggggtttccggaatttctgcaatgtggggtcctggcacaatggtgactgtcagcgcc

SEQ ID NO: 24641 - RNA, 417 nt, synthetic construct
  misc_feature 1..417: note = derived and/or modified sequence opt3 from anti-HIV_cap256-206-043389_VR-Chain
  source 1..417: mol_type = other RNA
caggagaagctggtggaaagcggcgggggagccgtccaacccggtggctccctcagactttcttgcgttgcttcagggttcacctttagtggattcggcatgcactggtttaggcaggcacctggtaaagggctggagtgggtggccacaatcagcttctccggaattaagaaatactataacacttctgcgaagggccggtttttcatatcgcgcgacaatacgaaagataccttgtacttacagatggacggcctgcaggaaaaggatacagctctatatctctgtgccaaggacctgcgataccttgagtgcgggtattggtcaacttactatccacaaccgtgtctggatacccgtggagtaagcggtatcagtaacgtgtggggccccgggacaatggtcaccgtgtcctct

SEQ ID NO: 24642 - RNA, 432 nt, synthetic construct
  misc_feature 1..432: note = derived and/or modified sequence opt3 from anti-HIV_cap256-206-042555_VR-Chain
  source 1..432: mol_type = other RNA
caggagcaactggtggaaagcggcgggggagtcgttccccctggtaagtccctcagactttcttgcgtggtatcaggcttcacctttagtgccttcgggatgcactgggtgaggcaggctccaggaaaaggcctggagtgggtcgcaggtatcagctttgccgggacaaagtcctactatgcggaatctgtgaaaggacggttcactatttcgcgcgacaactcaaagaatagcttgtttttacagatgaacggcctgcgaggcgatgacacggctctatactattgtgttaaagatatgcgtgagctcgaatgcgagctgtggaccagtgactactatgatttcgggagaccgcagccctgtatagacaggcggggagtgtccggtatctctgccatgtggggccaagggacaatggtcactattagctcc

SEQ ID NO: 24643 - RNA, 432 nt, synthetic construct
  misc_feature 1..432: note = derived and/or modified sequence opt3 from anti-HIV_cap256-206-029720_VR-Chain
  source 1..432: mol_type = other RNA
caggagaagctggtggaaagcggcgggggagtcgttcaacccggtagatccctcaccctttcttgcgtggcctcacacttcacatttagtggcgtagggatgcattgggtgaggcaggctcctggaaaaggcctggagtgggtcgcaggtatcagcttcgccgggactcggaagtactatgcggactccgtgaaaggacgctttacgatttctcgagataactcgaagaataccgtttacttgcagatgaacggcttacgtggcgaagacacagctctgtatcactgtgccaaagatctaagagagctcgaatgcgagctgtggacttcagactactatgatttcgggaggccacagccgtgtatagaccggcgcggagtgagcggtatctgcgatatgtggggccaagggaccatggtcattgtgagttcc

SEQ ID NO: 24644 - RNA, 432 nt, synthetic construct
  misc_feature 1..432: note = derived and/or modified sequence opt3 from anti-HIV_cap256-206-028848_VR-Chain
  source 1..432: mol_type = other RNA
caggagcaactggtggaaagcggcgggggagtcgttccccctggtaagtccctcagactttcttgcgtggcctcaggcttcacctttagtgggttcggaatgcactgggtaaggcaggctccaggcaaaggtctgcagtgggtggcagggatcagctttgccggaacaaagtactattacgaggactccgtcaaaggccggttcactatttctcgcgataactcgaagaatacggtgtttttgcagatgaacggcttacgaggggacgataccgcgctgtattactgtgttaaagacatgcgtgaactagagtgcgaagagtggacatcagattattacgacttcggaaagccgcaaccctgtatagatagaaggggtgtgagcggcatcagtgctatgtgggggcagggaactatggtcaccatttcctct

SEQ ID NO: 24645 - RNA, 432 nt, synthetic construct
  misc_feature 1..432: note = derived and/or modified sequence opt3 from anti-HIV_cap256-206-027652_VR-Chain
  source 1..432: mol_type = other RNA
caggagcaactggtggtcagcggcggggacgttgtgccccctggaaagtccctcagactttcttgcgtagcctcaggtttcacctttagtgctttcggcatgcactgggtgaggcaggcaccagggaaaggactggaatgggtcgccagcatctcctttgcgggcacaaagtactattacgctgattctgtgaaaggtcggttcgccatttcgcgcgacaactcaaagaatactttgtttttacagatgaacgggctgcgacgtgaggatacgggactatattactgtgttaaagacatgagacagctcgaatgcgaggaatggaccagcgattattacgacttcggcaggccgcaaccctgtatagatcggcgcggcgtgagtgggatctccgcaatgtggggacagggtacaatggtcactatttctagc

SEQ ID NO: 24646 - RNA, 417 nt, synthetic construct
  misc_feature 1..417: note = derived and/or modified sequence opt3 from anti-HIV_cap256-206-024075_VR-Chain
  source 1..417: mol_type = other RNA
caggagaagctggtggaaagcggcgggggagccgtccaacccggtggctccctcagactttcttgcgttgcttcagggttcacctttagtggattcggcatgcactgggtgaggcaggcacctggtaaagggctggagtggttggccacaatcagcttttccggagtaaagaaatactatggcacttctgcgaagggccggttctacatttcgcgcgacaacacgaaaaataccgtgtatttacagatggatgggctgcgaggagacgatacagctatatactattgtgccaaggacctacgttttctcgaatgcggtctgtggtcaacttactatccacagccgtgtcttgataccagaggcgtcagcgggatcagtaacgtgtggggacccggcacaatggttaccgtgtcctct

SEQ ID NO: 24647 - RNA, 417 nt, synthetic construct
  misc_feature 1..417: note = derived and/or modified sequence opt3 from anti-HIV_cap256-206-008748_VR-Chain
  source 1..417: mol_type = other RNA
caggagaagctggtggaaagcggcgggggagccgtccaacccggtggctccctcagactttcttgcgttgcttcagggttcacctttaacggattcggcatgcactgggtgaggcaggcacctggtaaagggctggagtgggtagccacaatcagttttagcggagtgaagaaatactatggcacttccgcgaagggccggttctttatttctcgcgaaaattcgaaaaacacgttgtacttacagatgaatgggctgcgaggagaggacaccgctctatattactgtgccaaggatctccgttatctggaatgcggtgagtggtcaacatactatccacagccgtgtcttgacactagaggcgtcagcgggataagtaacgtgtggggacccggcaccagggttacagtgtcctct

SEQ ID NO: 24648 - RNA, 432 nt, synthetic construct
  misc_feature 1..432: note = derived and/or modified sequence opt3 from anti-HIV_cap256-206-008530_VR-Chain
  source 1..432: mol_type = other RNA
caggagcaactggtggaaagcggcgggggagtcgttccccctggtaagtccctcagactttcttgcgtggcctcaggcttcagttttggggctttcggaatgcactgggtaaggcaggcaccaggcaaaggtctggagtgggtggccgggatcagctttgtcggaattaagtactattacgcggactccgtgaaaggccggttcaccatatctcgcgataactcgaagaaaacattgtttttacagatgaatggcctgcgaggggacgatactgctctatattactgtgttaaggacatgcgtgaactcgagtgcgaagagtggacgtcagattattacgacttcggaaagccgcagccctgtatcgatagaaggggtgtgagcggcattagtgccttttgggggcaaggaaccatggtcacaatctcctct

SEQ ID NO: 24649 - RNA, 432 nt, synthetic construct
  misc_feature 1..432: note = derived and/or modified sequence opt3 from anti-HIV_cap256-176-723043_VR-Chain
  source 1..432: mol_type = other RNA
caggagcaactggtggaaagcggcgggggagtcgttccccctggtaagtccctcagactttcttgcgtggcctcaggcttcacctttagtgctttcgggatgcactgggtaaggcaggcaccaggaaaaggcctggagtgggtggccggtgtcagctttgcggggatcaagtactattacgctgactccgtgaaaggacggttcacaatttctcgcgataactcgaagaatactttgtttttacagatgaacggcctgcgaggcgacgatacggccctatattactgtgttaaagacctccgtgaactggagtgcgaagagtggacctcagattattacgacttcgggagaccgcagccctgtatagatcctaggggagtgagcggtatcagtgcaatgtggggccaagggacagtcgtgactatttcctct

SEQ ID NO: 24650 - RNA, 432 nt, synthetic construct
  misc_feature 1..432: note = derived and/or modified sequence opt3 from anti-HIV_cap256-176-600049_VR-Chain
  source 1..432: mol_type = other RNA
gaggtgcagctggtccaaagcggcgggggagttgtgcagcccggtagatccctcaggctttcttgcgccgctccttacttcgaatttggccggtatgggttccactgggtacgccaggcaccaggaaagggcctggagtgggtggcctcaatcagttttgcgggtcgagggtactatcatagcccgtccgtctggggacgtttcaccatttctagagacaactcgaaaaatacattgtacttacagatgaactcactgaggatagaagatactgctctatatttttgtgcccgggacctccgcgagagcgaatgcgaggagtgggaaagtgattactatgacttcggcaagaaaggcccctgtgtgaagcctagaggggttgcaggaggtctggatctttggggccaagggacgatggtgatcgtctcctct

SEQ ID NO: 24651 - RNA, 432 nt, synthetic construct
  misc_feature 1..432: note = derived and/or modified sequence opt3 from anti-HIV_cap256-176-531926_VR-Chain
  source 1..432: mol_type = other RNA
caggtgcaactggtcgagagcggcgggggagttgtgccccctggtaagtccctcaccctttcttgcgtagcctcaagattcacatttagtgctttcggcatgcactgggtgaggcaggcaccagggaaaggactggaatgggtcgccggcatcagctttgtgggtattcggaagtactatgcggactccgttaaagggcgcttctctatatcgcgagataactcaaagaatactgtgtttttggagatgaacggattacgtggcgaagacacgggcctgtactattgtgtcaaagatatgagagagctagaatgcgaggagtgggctagcgactactatgatttcgggaagccgcagccctgtctcgacaggcggggagtgagtggtatctccgccatgtggggccaggggaccctggtaattatctctagc

SEQ ID NO: 24652 - RNA, 432 nt, synthetic construct
  misc_feature 1..432: note = derived and/or modified sequence opt3 from anti-HIV_cap256-176-504134_VR-Chain
  source 1..432: mol_type = other RNA
gaggtgcagctggtcgaaagcggcgggggagttgtgccccctggtaagtccctcagactttcttgcgtaacctcaaggctggccttcggcgcttttgggatgcactgggtgcggcaagcaccaggaaaaggcttggagtgggtcgccagtatcagcttcgcgggtattaagaaatactatgctgactccgtgaaggggcgctttacaatatctcgagataactcgaaagacactgttttcttagaaatgaatggactgcgtggcgatgacacgggcctatactattgtgtgaaggatatgagatacctcgagtgcgaagagtgggcctcagactattacgattttgggaggccgcagccctgtctggaccctcggggagtcagcggtatcagtgcaatgtggggccaggggacccttgtgattatctcctct

SEQ ID NO: 24653 - RNA, 432 nt, synthetic construct
  misc_feature 1..432: note = derived and/or modified sequence opt3 from anti-HIV_cap256-119-186229_VR-Chain
  source 1..432: mol_type = other RNA
cagatgcaactggtggagagcggcgggggagtcgttcagcccggtggctccctcaggcttctgtgctctgcctcagggttcacctttagtacatacggaatgcactgggtgaggcaggctcctggcaagggtttggaatgggtagcaagcatctcctatgacgggtctgataaataccatgccggattagtgtggggccggttcattatatcgcgcgacaactcaaagaatactctgtatctacagatgaacagcctccgagcggaggatacggctctgtactattgtgtccgtgacgaaagagagagtgaatgcgagctttgggagtccgattactataattttggcaaaaagctgccatgtgtgaaaccgagaggggttgccggaaccttggacatctggggtcaaggcacaactgtgattgtctctagc

SEQ ID NO: 24654 - RNA, 432 nt, synthetic construct
  misc_feature 1..432: note = derived and/or modified sequence opt3 from anti-HIV_cap256-119-183891_VR-Chain
  source 1..432: mol_type = other RNA
caggtgcaactggtcgagagcggcgggggagttgtgcagcccggtggctccctccggctttcttgcgccgcttcagggttcacctttagtagctacggaatgcactgggtaaggcaggcacctggcaagggtctggaatgggtggccttcacacggtatgacgggtccgataaatactatttggactctgtcaagggacgctttactatctcgcgagataactcaaaatacacgttattcctgcagatggtgagcctacgtaccgaggacacagcgctctatttttgtgctagagatctgagggaaagtgagtgcgaagagtgggagtcctactattacgacttcggcaagaaaggcccatgtgttaagccgagaggggtggtcggagtgcttgatatttggggtcaaggcactctggtaaccgtttctagc

SEQ ID NO: 24655 - RNA, 435 nt, synthetic construct
  misc_feature 1..435: note = derived and/or modified sequence opt3 from anti-HIV_cap256-119-183631_VR-Chain
  source 1..435: mol_type = other RNA
caggtgcaactggtccagagcggcgggggagttgtgcagcccggtagatccctcaggctttcttgcgccgcttcaaagttcacctttagtacatacactctgcactgggtacggcaggcacctggcaaagggttggagtgggtggccgtcatcagccatgacggaggcaaccgcttctatgcggattccgtgaagggtcgatttacgatttctcgtgacaattcgaaaaacaatttattcctgcaaatgaactcactaagagttgaagataccgctctctactattgtgccagggacctgcgggagatggaatgcgaggaatggacactttacaattattacgattttgggagccgcggaccatgtgtggacccgagaggcgtcgtgggcagtttcgatgtatgggggcagggaactatggttaccgtgtcctct

SEQ ID NO: 24656 - RNA, 432 nt, synthetic construct
  misc_feature 1..432: note = derived and/or modified sequence opt3 from anti-HIV_cap256-119-182676_VR-Chain
  source 1..432: mol_type = other RNA
caggtgcaactggtcgagagcggcgggggagttgtgcagcccggtaagtccctcaggctttcttgcgtagtgtcaggcttcacctttagtaactaccctatgcactgggtcaggcaggccccagggaaaggactggaatgggtggctagcatctccttcgcaggcattaagaaatattacggtgactctgttaaggggcggtttacaatatcgcgcgataatagcaaaaacactttgtatttacagatggacggactgcgaggcgaggatacggccctatactattgtgcgaaggacctccgtgaactggagtgcgaagagtgggcttcagattactatgacttcggcagaccgcaaccctgtcttgatcctagaggggtgagtggaatctccaatgtctggggtcagggcaccatggtgacagtatctagc

SEQ ID NO: 24657 - RNA, 432 nt, synthetic construct
  misc_feature 1..432: note = derived and/or modified sequence opt3 from anti-HIV_cap256-119-180772_VR-Chain
  source 1..432: mol_type = other RNA
caggtgcaactggtcgagagcggcgggggagttgtgcagcccggtagatccctcaggctttcttgcgccgcttcagagttcacctttagtaactacgcaatgcactgggtacggcaggcccctggcaaggggctggaatgggtggcgagcatctccttcgacggacgcgataaatatcattcttcgttggtctggggccgattaacaatttcacgtgacaatagcaagagtactctgtttctacagatgaactccctcagaccagaagatacggctctgtactattgtgccagggacgtgcgggagtctgaatgcgaggagtggcaaagcgattactatgcattctaccgcaaacttccgtgtgttaagcccagaggtgtggccgggaccctggacatatggggacagggcacaatggtcactgtgtcctca

SEQ ID NO: 24658 - RNA, 435 nt, synthetic construct
  misc_feature 1..435: note = derived and/or modified sequence opt3 from anti-HIV_cap256-119-180508_VR-Chain
  source 1..435: mol_type = other RNA
caggtgcacctggtcgagagcggcgggggagttgtgcaacccggtagatccctcaggctttcttgcgccgcttcacatttcagtctgagctcctacggcatgcactgggtacggcagacccctgggaagggattggaatgggtggcaggcatctcttttgccggtgtcaagacatattacgggacttcggtgaagggacgcttcacgatttcacgagacaacagcaaaaataacttatatctgcagatgaatagtctacgtccagaggataccgcgctctactattgtgctagagacctgagggaaatggagtgcgaagagtggaaactttacaactattacgattttcggacacgcggcccgtgtgttgaccccagaggcgtggtcgggtccttcgatgtgtggggacagggtactgtagttaccgtgtctagc

SEQ ID NO: 24659 - RNA, 432 nt, synthetic construct
  misc_feature 1..432: note = derived and/or modified sequence opt3 from anti-HIV_cap256-119-180260_VR-Chain
  source 1..432: mol_type = other RNA
gaggtgcagctggtcgaaagcggcgggggagttgtgagacccggtggctccctcaggctttcttgcgccgcttcacaattcacctttagtaacttcgggatgcactgggtacggcaggcacctggaaagggcctggagtgggtggccagcatctcctttgtcggtattaaaacacattacgctaattctgtgcgcgggcgattcactatatcgcgtgaccagtcaaagaacacgttgtatttacagatgaatagcgttagagtggaagataccggaaggtactattgtgcgcgggacatgcgcgagtacgaatgcgagctgtgggccagtgattattacgactttggcaaaccacaaccgtgtgaggatcccagaggcgtcgtggggacattcgacatgtggggactaggtactctcgtaaccgtttcctct

SEQ ID NO: 24660 - RNA, 432 nt, synthetic construct
  misc_feature 1..432: note = derived and/or modified sequence opt3 from anti-HIV_cap256-119-180173_VR-Chain
  source 1..432: mol_type = other RNA
gaggtgcagctggtcgaaagcggcgggggactcgttcaacccggtggctcccttaggctgtcttgcgccgcttcagggttcaccgtgagtagcaactacatgtcctgggtaaggcaggcacctggaaagggcttggagtgggtggcctctatctcgtttgcgggtactaaaaagcactatggaaattcagtcaaagggcggttcacaattagccgcgacaacagtaagaatacgttatacctgcagatgaactccctacgaggcgaagataccgctctctattactgtgccaaagacctgcgtgagtatgaatgcgaggagtggacatctgattactatgactttggcagaccacagccgtgtatagatagcagaggggtggttggaatccttgacatttggtcccaaggtactatggtgaccgtctcaagt

SEQ ID NO: 24661 - RNA, 432 nt, synthetic construct
  misc_feature 1..432: note = derived and/or modified sequence opt3 from anti-HIV_cap256-119-179839_VR-Chain
  source 1..432: mol_type = other RNA
caggtgcaactggtcgagagcggcgggggagttgtgcagcccggtagatccctcaggctttcttgcgccgcttcaggcttcagttttgggaccagcgacgtacactgggtgcggcaggcacctggagaaggcctggagtgggtcgccttgatctccttcgatggtcgccagaaggacttagcggattctgtgcgagggcgttttacaatttcgagagactcaagcaaaaacactctgtacctagaaatgaatagtctcaggccagaggatacggctctgtattactgtgccaaggacatgcggggatatgaatgcgaggagtggacctccgattactatgacttcggccgcccgcaaccctgtatagattctagaggcgttgtggggacatttgacgtctggggacagggtactatggtgaccgtaagctcc

SEQ ID NO: 24662 - RNA, 423 nt, synthetic construct
  misc_feature 1..423: note = derived and/or modified sequence opt3 from anti-HIV_cap256-119-179262_VR-Chain
  source 1..423: mol_type = other RNA
caggtgcaactggtcgagagcggcgggagagttgtgcagtccggaggttctctcaggctttcatgcggcgccagtgggttcagctttaccacatccgctatgcactgggtacggcaggcacccggaaagggcctggaatgggtggccatcaacggtgcgaataaacattacgctgagtctgtcaaggggcgcttcactatttcgcgagacaacagcaaaaatacgttgtttttagaaatgaactcactgcgtcctgatgacaccgccctatatttctgtgtgaaggatcagagagaggacgaatgcgaggagtggtggagtgattactatgactttggaagggaacaaccatgtctcgatccgcggggcgttgtgggcatattcgacctgtgggggcagggaacaatggtcactgtgtcctct

SEQ ID NO: 24663 - RNA, 432 nt, synthetic construct
  misc_feature 1..432: note = derived and/or modified sequence opt3 from anti-HIV_cap256-119-178995_VR-Chain
  source 1..432: mol_type = other RNA
caggtgcaactggtcgagagcggcgggggagttgtgcagcccggtaagtccctcagactttcttgcgccgcttcaggcttcaccctgacaaggtttgcaatgcactgggtacggcaggcccctgggaaaggattggaatgggtggcggtcatctggtacgacggcagtaacaagtattacgctgatagcgtgaaaggtcgcttcactgtttcccgagacaattctaagaacacgttatatctgcagatgaactcgctacgtaccgaggatacagccctctactattgtgtgagagacaggcgggaatcagagtgcgaactgtgggagagcgattactataattttgggcgcagacttccatgtgtcaaaccgaggggagtggcaggcattctggacatatggggccaagggactaccgtaacagttagtccc

SEQ ID NO: 24664 - RNA, 432 nt, synthetic construct
  misc_feature 1..432: note = derived and/or modified sequence opt3 from anti-HIV_cap256-119-178455_VR-Chain
  source 1..432: mol_type = other RNA
gaggtgcagctggtcgaaagcggcgggggactcgttcaacccggtggctcccttagactgtcttgcgtggtatcagggttcacctttagtaacttctggatgagctgggtgaggcaggcccctggaaagggcttggagtgggtcgcttccatctcttacgacggtcgggataaatatcactcgtcattagtgtgggggcgcctgacaattagccgagacaatagtaagtccactctatttctccagatgaactctctgcgtgcagaagatacggccctttactattgtgcgagagacctgagggagagcgaatgcgaggagtggcagtccgattactatgctttctacaaaaagttgccatgtgttaaaccgcggggagtggccggcaccctcgacatatggggccaagggacaatggtcactgtgtcaagt

SEQ ID NO: 24665 - RNA, 438 nt, synthetic construct
  misc_feature 1..438: note = derived and/or modified sequence opt3 from anti-HIV_cap256-119-177993_VR-Chain
  source 1..438: mol_type = other RNA
caggtgcacctggtcgagagcggcgggggagttgtgcaacccggtaagtccctcagaatctactgcgccgtatctgagttcaccttttcaaactatgctatgcattgggtgaggcttgcacctggccgggggctgcagtggttggccgtcattagttacgacggaagcaaaaagtattacgcggattccttagaaggccgcttcacaatatctaaagacaattcgaagaacactctgtttctacagatgaactcactccgagtggaagatacggctctgtatttctgtgttaaagaccagcgtgaggatgaatgcgaggagtggtggagcgactactatgattttggtgaaagagccccacttccgaaggtgcccgggcctggaccaggctggaatctggacatgtggggccacgggaccatggtcacagtgagttcc

SEQ ID NO: 24666 - RNA, 438 nt, synthetic construct
  misc_feature 1..438: note = derived and/or modified sequence opt3 from anti-HIV_cap256-119-177727_VR-Chain
  source 1..438: mol_type = other RNA
caggtgcaactggtcgagagcggcgggggagttgtgcagcccggtagatccctcaggctttcttgcgccgcttcaggcttcaccctgagtcggtacgacatgcactgggtacgccaggcacctgggaagggattggaatgggtggccagcatctccaaagatggcacaaagaaatatcatggtgactctgtctgggggcgatttattatatcgcgtgataactcaaagaatactttattcctgcagatgagcagtctaagagcggaggacacggctctctacttttgtgtgagggatcaacgggaagccgagtgcgaagagtggtggtccgactattacgatttcggacgcgagctgccatgtagaaaatttaggggccttggcctggcagggatcttcgacatttggggacacggtaccatggttacagtgtctagc

SEQ ID NO: 24667 - RNA, 432 nt, synthetic construct
  misc_feature 1..432: note = derived and/or modified sequence opt3 from anti-HIV_cap256-119-176746_VR-Chain
  source 1..432: mol_type = other RNA
gaggtgcagctggtcgaaagcggcgggggactcgttcaacccggtggctcccttagactgtcttgcgccgcttcagacttcacctttgatgactacgcaatgcactgggtgaggcaggcccctgggaagggattggagtgggtaggcggtatcagttatgatgggagcgacaaataccatacaaattccgtgtggggacggttcattgtctctcgcgataattcgaagaacactttatatctgcagatgaactcactacgaccagaagacacggcgctctactattgtgtgcgtgatagaagggagagcgaatgcgaggagcggtggagtgactactatgattttggcaaacagctgccgtgtgttaagccccgcggcgtggctgggatattcgacatctggggacaaggtaccatggtcacagtgtcctct

SEQ ID NO: 24668 - RNA, 432 nt, synthetic construct
  misc_feature 1..432: note = derived and/or modified sequence opt3 from anti-HIV_cap256-119-176241_VR-Chain
  source 1..432: mol_type = other RNA
caggtgcaactggtcgagagcggcgggggagttgtgcagcccggtagatccctcaggctttcttgcgccgcttcaggcttcacctttagtaactacgcaatgcactgggtacggcaggcccctgggaagggactggaatgggtggcggtcatcagctatgacggctccaataaatactatgctgattctgtgaagggtcgcttcacaatttcgcgagacaacagcaaaaatactttgtacttacagatggatgggctgcgtggagaggacacggccctatattactgtgcaaaggatctcagagaactggagtgcgaagagtgggcctcagactattacgattttggcaggccacaaccgtgtcttgacccccggggcgttagtgggatatccaacgtgtggggacagggtaccatggtcacagtgtctagc

SEQ ID NO: 24669 - RNA, 432 nt, synthetic construct
  misc_feature 1..432: note = derived and/or modified sequence opt3 from anti-HIV_cap256-119-175215_VR-Chain
  source 1..432: mol_type = other RNA
caggtgcaactggtcgagagcggcgggggagttgtgcagcccggtagatccctcaggctttcttgcgccgtatcacagttcacctttggccggtacgggatgtattgggtgcgccaggctcctggaaagggcctggaatgggtcgcaggtatcagttacgacgggagcgataaatatcacacaaactccgtgtggggacgattcattgtttctcgtgacaattcgaagaacatgttgtacttacaaatgaataacctgagaccagaggatactgccctatattactgtgtgagggaccggcgcgaatcagagtgcgaagagagatggagcgattattacgactttggcaaacagctcccgtgtgtcaagcccaggggcgtggcggggatattcgatatctggggacagggtacgatggtaaccgttagttcc

SEQ ID NO: 24670 - RNA, 432 nt, synthetic construct
  misc_feature 1..432: note = derived and/or modified sequence opt3 from anti-HIV_cap256-119-173928_VR-Chain
  source 1..432: mol_type = other RNA
ggcgtggagctgctcgaaagcgggggaggtcttgtcgagcccggcgggtccctgcggttgtcttgcgttggatcacagttcagttttgacaggtacggcatgcactgggtgcggcaagcccctggtaaggggttagaatgggtagctgcagtgagcttcgatggaaccgacaaatatcatgccgatgacgtctggggccgctttacaatctcccgagataactctaagaatactctgtacctacagatgaactcgctccgtgcggaggacacggctctgtattactgtgccaaagatcttagagaagacgagtgcgaggaatggtggtcagattattacgacctgggcaagcagttgccatgtaggaaaagcagaggggtggcaggagttctcgataagtggggtctgggcaccatggtgacagtcagttcc

SEQ ID NO: 24671 - RNA, 432 nt, synthetic construct
  misc_feature 1..432: note = derived and/or modified sequence opt3 from anti-HIV_cap256-119-173495_VR-Chain
  source 1..432: mol_type = other RNA
caggtgcaactggtcgagagcggcgggggagttgtgcagcccggtaagtccctcagactttcttgcgccgcttcaaggttcacctttaaccggtacggcatgcactgggtacgccaggcacctgggaaaggactggaatgggtggccgcgatcagtttcgacggcacagataagtatcatagcgacgatgtctggggtcgatttactatttcccgtgacaattctaaaaacacgttgtacttacagatgaactcgctgagagctgaggataccgccgtgtattactgtgcaaaggacctaagggaagatgagtgcgaggaacggtggtcagactattacgatttcgggaaacaactcccatgtcgcaagagcagaggagttgccggcatatttgacaattggggccaggggacaatggtgactgtcagttcc

SEQ ID NO: 24672 - RNA, 432 nt, synthetic construct
  misc_feature 1..432: note = derived and/or modified sequence opt3 from anti-HIV_cap256-119-172882_VR-Chain
  source 1..432: mol_type = other RNA
caggtgcaactggtcgagagcggcgggggagttgtgcagcccggtagatccctcaccctttcttgcgaagtatcaggcttcacatttaagacttacgggatgcactgggtgaggcaggcccctggaaaaggcctggagtgggtcgctagtatcagctatgacggttccgataagtaccatgcagaccgggtgtgggggcgcttcacgatttctcgagataactcgaaaaataccttgtatttacagatgaactcactgcgtgccgaagacacagcgctatactattgtgttagagatgctagggagagcgaatgcgagctctgggagagtgactactataattttggacggaagctgccatgtgtgaaaccgcgcggcgtcgccggcactcttgatatatgggggcaaggaaccatggtgacagtatcctct

SEQ ID NO: 24673 - RNA, 432 nt, synthetic construct
  misc_feature 1..432: note = derived and/or modified sequence opt3 from anti-HIV_cap256-119-172429_VR-Chain
  source 1..432: mol_type = other RNA
gaggtgcagctggtcgaaaccggcgggggactcatccaacccggtggcagccttagactgtcctgcgttgcctctcagttcacattttcagggtgtggattgcactgggtgaggcaggctcctggcaagggtttagagtgggtagcaagtattagcttcgccgggactaaaaagcattacggaaactccgtgaaaggccggtttacgatatctcgcgacaattcgaagaacaccctgtatctagaaatgaatacactccgagcggaggatactgctctgtactattgcgccaaagaccttcgtgaatacgagtgtgaggaatggacctcagattattacgacttcggcagaccacagccgtgcatcgatagcaggggagtcgtggggattctggacatctggggtcaaggcacaatggttagtgtgtcctct

SEQ ID NO: 24674 - RNA, 432 nt, synthetic construct
  misc_feature 1..432: note = derived and/or modified sequence opt3 from anti-HIV_cap256-119-172223_VR-Chain
  source 1..432: mol_type = other RNA
caggtgcaactggtcgagagcggcgggggagttgtgcagcccggtagatccctcaggctttcttgcgccgcttcaggcttcacctttagtagctacgcaatgcactgggtacggcaggcccctgggaagggactggaatgggtggcggtcatctcctatgacggccgcgatttctaccatgctcgatctgtgtggggtcgttttacaatttcgagagacaacagcaaaaatactttgcacttacagatgaactcactgaggccagaggatacggccctatatttctgtgcacgggacctccgcgaaagtgagtgcgaagagtgggagtcctactattacgattttgggaagaaagacccgtgtgttaagcccagaggagtggtcggcgtgctggatatatggggccaagggacccttgtaacagtttctagc

SEQ ID NO: 24675 - RNA, 432 nt, synthetic construct
  misc_feature 1..432: note = derived and/or modified sequence opt3 from anti-HIV_cap256-119-171838_VR-Chain
  source 1..432: mol_type = other RNA
caggtgcaactgggcgagagcgggggaggtgtcgttcagcccggcagatccctcaggctttcttgcgccgcttcagggttcacctttagtacattcgcaatgcactgggtgcggcaggcccctggaaagggcctggaatgggtagcggtgatcagctacgacggttccaataaatattacgctgattctgtcaaggggcgctttgccatttcgcgagacaatgccaaaaacttgttacatctgcagatgaactcactacgtccagaggatactgcactctattactgtgctaaggacctgcaagaagatgagtgcgaagagtggtggagcgactattacgatttcggaaaacagcttccgtgtagaaagagtaggggcgtggcaggcatatttgacgattgggggcagggaacgatggttaccgtgtcctct

SEQ ID NO: 24676 - RNA, 432 nt, synthetic construct
  misc_feature 1..432: note = derived and/or modified sequence opt3 from anti-HIV_cap256-119-171587_VR-Chain
  source 1..432: mol_type = other RNA
gaggtgcagctggtcgaaagcggcgggggactcgttcaacccggtggctcccttagactgtcttgcgccgcttcagggttcacctttagtgactactatatgagctggatcaggcaggcacctggaaagggcttggagtgggtggcctccatttctttcgcgggtacaaaacagcactacgggaactcggtaaagggacggtttactatatcacgcgataatagcaaaaacacggtgtatttacagatgaatagtctgcgactagaagacaccgctctctactattgtgccaaggatctgcgtgagtacgaatgcgaggagtggacatccgactattacgatttcggcagaccacaaccgtgtatcgactctaggggcgtcgtggggattcttgatatctggggacagggtactatggttaccgtgagctcc

SEQ ID NO: 24677 - RNA, 432 nt, synthetic construct
  misc_feature 1..432: note = derived and/or modified sequence opt3 from anti-HIV_cap256-119-169596_VR-Chain
  source 1..432: mol_type = other RNA
ctggtgcagctcgtcgagagcggcgggggagttgtgcaacccggtagatcccttaggctgtcttgcaccgcctcaggcttcacatttagtagcttcgctatgcaccgggtacgccagactcctgggaagggattggaatgggtggcatccatctcttacgacggctcggataaatatcatgccgaccgagtctggggtcgttttacgatttcaagagataacagcaagaataccttatacctgcagatgaacagtctaagggcggaggacacagctctctattactgtgtgcgggatgcccgcgaatccgagtgcgaactgtgggagtctgactattacaatttcgggagaaaacttccatgtgttaagccgaggggagtggcaggcactctggatatatggggccaggggaccatggtcacagtgagctcc

SEQ ID NO: 24678 - RNA, 432 nt, synthetic construct
  misc_feature 1..432: note = derived and/or modified sequence opt3 from anti-HIV_cap256-119-169523_VR-Chain
  source 1..432: mol_type = other RNA
caggtgcaactggtcgagagcggcgggggagttgtgcagcccggtgaatccctcagactttcttgcgccgcttcaggcttcagttttgggaccagcgacgtacactgggtgaggcaggcacctggagagggcctggaatgggtcgcctccatctctttcgcgggtattaagaaatactatggggattcggtgaagggacggtttacaatatcacgcgacaacagcaaaaatactttgtacttacagatggatggcctgcgaggcgaggacacggctctatattactgtgccaaggatctccgtgaactggagtgcgaggaatgggcaagtgactattacgatttcgggagaccacaaccgtgtcttgaccccaggggagtttccggtatctctaacgtgtggggccaggggaccatggtcacagtgagctcc

SEQ ID NO: 24679 - RNA, 432 nt, synthetic construct
  misc_feature 1..432: note = derived and/or modified sequence opt3 from anti-HIV_cap256-119-169462_VR-Chain
  source 1..432: mol_type = other RNA
gaggtgcagctggtcgaaagcggcgggggactcgttcaacccggtggctcccttagactgtcttgcgccgcttcagggttcacctttacaacttacagtttgcactgggtgaggcagagccctggaaagggcttagagtgggtagcagccatctccttcgcgggtacgaaagaaaactatgctaattctgtgcgggggcgctttaccatttcgcgagacaactcaaagaatacactgtacctacagatgaacagcctccgtgccgaggatactgcactgtattactgtaccaaagacatgagagaatatgagtgcgaggaatggacaagtgattactatgacttcggaaggccacagccgtgtatagattcccggggcgtcgtgggcacctttgacgtttgggggcaaggaactatggtgacagtctctagc

SEQ ID NO: 24680 - RNA, 432 nt, synthetic construct
  misc_feature 1..432: note = derived and/or modified sequence opt3 from anti-HIV_cap256-119-169092_VR-Chain
  source 1..432: mol_type = other RNA
gaggtgcagctggtcgaaagcggcgggggactcgttcaacccggtggctcccttagactgtcttgcgtgatctcagggttcacctttagtagctacgagatgaattgggtaaggcaggcccctggaaagggcttggaatgggtggctggtatttcctatgacgggcgggataaataccacgcacatttcgtctggggacgcataacaatctctcgagacaattcgaagaacactttatatctgcagatgaactcactacgtgccgaggatacggcgctctaccactgtgtgagagacctgagggaaagcgagtgcgagctttgggaaagtgattattacgactttggcaaaaagctgccatgtgttaaaccgcggggcgtggctgggattttcgatttgtggggacagggtaccatggtcacagtgtcctct

SEQ ID NO: 24681 - RNA, 432 nt, synthetic construct
  misc_feature 1..432: note = derived and/or modified sequence opt3 from anti-HIV_cap256-119-168680_VR-Chain
  source 1..432: mol_type = other RNA
caggtgcaactggtcgagagcggcgggggagttgtgcagcccggtagatccctcagggtatcttgcgccgcttcacacttcacctttagtcggtacggcatgcattgggtgcgccaggcacctgggaagggacttgaatgggtcgccagcatctcctatgacggccgagatttctaccacgcgcgttctgtgtggggtagatttgctatttcgagggacaacagcaaaaatacactgcatttgcagatgaactcattacggactgaggatacggccctgtatcactgtgttcgcgacctaagagaaagtgagtgcgaactctgggagtccgattactatgacttcgggaagaaactgccatgtgtgaagccgaggggagtcgcaggcacctttgatctttggggccaagggacaatggtgactgtatctagc

SEQ ID NO: 24682 - RNA, 438 nt, synthetic construct
  misc_feature 1..438: note = derived and/or modified sequence opt3 from anti-HIV_cap256-119-166385_VR-Chain
  source 1..438: mol_type = other RNA
caggtgcaactggtcgagagcggcgggggagttgtgcaccccggtagatccctcaggctttcttgcgccgcttcaggcttcagttttgggaacttcggaatgcattgggtacggcaggcacctggcaagggtctggaatgggtggccagcatctccaatgacgggaccaaaaagtaccacgcggagtctgtctgggatcgcttttcgatttcaaaagacaacagcaagaatacattgttcttacagatgaacagtctgcgagtggaagatactgctctatatttttgtgttaaagaccagcgtgaggatgaatgcgaggagtggtggtccgactactatgatttcggaagagaactcccatgtaggaagtctcggggcctgggccttgccgggatatttgacatgtggggacatggtacgatggtgaccgtcagctcc

SEQ ID NO: 24683 - RNA, 432 nt, synthetic construct
  misc_feature 1..432: note = derived and/or modified sequence opt3 from anti-HIV_cap256-119-165943_VR-Chain
  source 1..432: mol_type = other RNA
gaggtgcagctggtcgaaagcggcgggggactcgttcaacccggtcggtcccttaggctgtcttgcgccgtgtcaggcttcaccgtaagtagcaactacatgtcctgggtgcggcaggctcctgggaagggattggagtgggtcgcatctatctcgtttgccggcattaaaaagtattacggtgactcagtgaaagggcgcttcacaataagccgagataatagtaagaacactttatatctgcagatggacggactacgtggcgaagatacggcgctctactattgtgctaaagacctgagagagcttgaatgcgaggagtgggcctccgattactatgactttggcaggccacagccgtgtctggatcccagaggggtttctggaatcagcaatgtgtggggtcaaggcaccatggtcacagtgtcctca

SEQ ID NO: 24684 - RNA, 432 nt, synthetic construct
  misc_feature 1..432: note = derived and/or modified sequence opt3 from anti-HIV_cap256-119-165738_VR-Chain
  source 1..432: mol_type = other RNA
gaggtgcagctggtcgaaagcggcgggggactcgttcaacccggtagatcccttaggctgtcttgcgccgcttcaggcttcacctttgacgattacgcaatgaactgggtgcggcaggcccctgggaagggattggagtgggtagcgacaatcagtttcgacggcactgataaatatcacgctgacgatgtgtggggtcgctttacgattagccgagacaattccaagaaaaccttatacctgcagatgaactctctacgtgccgaagatacagcactctattactgtgccaaggacctgagagaggatgaatgcgaggagtggtggtcggactattacgatcttgggaaacagctgccatgtaggaagtcacggggagtcgctggcgtgttggacaagtggggcctcgggactatggttaccgtgagcagt

SEQ ID NO: 24685 - RNA, 432 nt, synthetic construct
  misc_feature 1..432: note = derived and/or modified sequence opt3 from anti-HIV_cap256-119-164913_VR-Chain
  source 1..432: mol_type = other RNA
caggaccacctggtggagagcggcgggggaggtgtccaacccggcaagtccctcagactttcttgcgccgcttcagggttcacctttagtgcacatgccatgcactgggttaggcaggcgcctggaaaaggcccagaatgggtggctgtaatcagccatgatggtgggcagcagttctaccgggagtccgtgaagggacgctttacaatttctcgagacaactcgaaaaatactctgtatttgcaaatggatggcttacgtggcgaagacacggccctgtactattgtgcaaaggatctaagagagctcgaatgcgaggagtgggcctcagactactatgatttcgggaggccgcagccctgtctggaccctcggggagtcagcggtataagtaacgtgtggggccaggggaccatggttacagtgtcctct

SEQ ID NO: 24686 - RNA, 432 nt, synthetic construct
  misc_feature 1..432: note = derived and/or modified sequence opt3 from anti-HIV_cap256-119-164167_VR-Chain
  source 1..432: mol_type = other RNA
gaggtgagactggtcgaaagcggcgggggactcatccagcccggtggctcccttaggctgtcttgcgccgcttcagggttgaccgttagtagcaatcacatgtcctgggtgcggcaagcacctggaaagggcttagagtgggtagcctctatttcgtacgacggtcgcgatttctatcatgcgcgatcagtgtgggggcgttttacaataagcagagacaatagtaaaaacactctgcacctacagatgaactccctcaggccagaagatacggctctgtacttctgtgcccgggaccttcgcgagtctgaatgcgaggagtgggaaagctattactatgattttggaaagaaaggcccgtgtgtcaagcccagaggcgtggttggggtgctggacatctggggacagggtaccttggtcacagtgtcctca

SEQ ID NO: 24687 - RNA, 432 nt, synthetic construct
  misc_feature 1..432: note = derived and/or modified sequence opt3 from anti-HIV_cap256-119-163558_VR-Chain
  source 1..432: mol_type = other RNA
cagatgcaactggtggagagcggcgggggagtcgttcagcccggtagatccctcaccctttcttgcgccgcttcacagttcaactttgcaaattacggcatgcactgggtgaggcaggcccctgggaagggactggaatgggtagcgagtatcagctatgacggctccgataaataccatgctgaccgggtgtggggtcgcttcacaatttctcgagataactcgaagaatactttgtatttacaaatgaactcactgcgtgccgaggacacggcactatactattgtgtcagagatgccagggaaagcgagtgcgaactctgggagagtgactactataattttgggcggaaactgccatgtgtgaagccgcgcggagttgctggcacccttgatatatggggccaggggacaatggtgactgtctcctct

SEQ ID NO: 24688 - RNA, 432 nt, synthetic construct
  misc_feature 1..432: note = derived and/or modified sequence opt3 from anti-HIV_cap256-119-162043_VR-Chain
  source 1..432: mol_type = other RNA
caggtgcaactggtcgagagcggcgggggagttgtgcagcccggtagatccctcagggtatcttgcgccgcttcacacttcacctttagtcggtacggcatgcattgggtgcgccaggcacctgggaagggacttgaatgggtcacaggcatcagcttcgccgcgactaaaacgtattacggtgactccgtgcgagggcgttttaccgtttctagagatatttcgaagaatacactgtatttgcagatgaactcattaaggccagaggacactgctatgtactattgtgcccgggatcaacgctactatgaatgcgaggaatgggcaagcgactactacgatttcggaagagagcagccgtgtcaggaccccaggggcgtggtcggcatactggatctatgggggcagggaaccatggtgacagtaagttcc

SEQ ID NO: 24689 - RNA, 432 nt, synthetic construct
  misc_feature 1..432: note = derived and/or modified sequence opt3 from anti-HIV_cap256-119-161718_VR-Chain
  source 1..432: mol_type = other RNA
caggtgcaactggtcgagagcggcgggggagttgtgcagcccggtaagtccctcagactttcttgcgccgcttcacacttcagttttaacaggtacggcatgcattgggtacggcaggcacctgggaaaggactggaatgggtggccgcgatcagctatgacggcaccgataagtaccacgctgaccaggtctggggtcgcttcacaatttcccgagataattctaaaaacactttgtatttacaaatgaatagcctgcgtccagaggacacggccctatactattgtgcaaaggatctcagagaagacgagtgcgaagagtggtggtcagattactatgacctggggaaacagcttccgtgtaggaagtcgcggggagtggccggcatatttgataagtggggccaggggaccatggttacagtgagttcc

SEQ ID NO: 24690 - RNA, 432 nt, synthetic construct
  misc_feature 1..432: note = derived and/or modified sequence opt3 from anti-HIV_cap256-119-161675_VR-Chain
  source 1..432: mol_type = other RNA
caggtgcaactggtcgagagcggcgggggagttgtgcagcccggtagatccctcaggctttcttgcaccgcctcaggcttcacatttagtatctacagcatgaactgggtacggcaggctcctgggaagggactggactgggtggcaggcatttccttcgccgcgactaaaacgtattacggtgggtctgtcaagggacgctttaccgtgtcgcgagatataagcaaaaatacattgtatttacagatgaactcactgcgtccagaagacactgctatgtactattgtgccagagatcaaaggtactatgagtgcgaagagtgggcaagtgactactacgatttcggccgggaacagccgtgtcaggacccccgcggcgttgtgggggtctttgatatgtggggacagggtaccatggtgacagtatcctct

SEQ ID NO: 24691 - RNA, 432 nt, synthetic construct
  misc_feature 1..432: note = derived and/or modified sequence opt3 from anti-HIV_cap256-119-161053_VR-Chain
  source 1..432: mol_type = other RNA
caggtgcacctggtcgagagcggcgggggagttgtgcaacccggtacctccctcagactttcttgcgtagcctcaggcttcacatttagtaatttcgctatgcattgggtgaggcaggcacctgggaagggactggaatgggccgcgatcattagcactcggggcaataaccgcaattacgctgactccgtccgaggtcgttttacggtgtctagagatatatcgaaaaacaccttgtatttacagatgaactcactgaggccagaggacacagccatgtactattgtgcacgggatcagcgctactatgaatgcgaggaatgggccagcgactactatgatttcgggagagagcaaccgtgtcaggaccccaggggagttgtgggcatcctagatctctggggccaggggactatggtcaccgtgagttcc

SEQ ID NO: 24692 - RNA, 432 nt, synthetic construct
  misc_feature 1..432: note = derived and/or modified sequence opt3 from anti-HIV_cap256-119-159499_VR-Chain
  source 1..432: mol_type = other RNA
caggtgcaactggtcgagagcggcgggggagttgtgcagcccggtagatccctcaggctttcttgcgccgcttcaggcttcgcatttagtcactacgggatcttctgggtacggcaggcccctggaaagggcctggaatgggtggcgagcatttcctttgacggtcgcgattattaccattctccacacgtctgggggcgattgaccatatcgcgtgacaacagcaaaaatacattatatctgcagatgaactcactaagagctgaggatactgccctctactattgtgcaagggacctgcgggaaagtgagcgcgaagagtgggagtccgattactatgacttcggaaagaaaggcccgtgcgtgaagcccagaggcgttgccgggtctcttgatatgtggggacaaggtacgatggtgatcgtcagctcc

SEQ ID NO: 24693 - RNA, 432 nt, synthetic construct
  misc_feature 1..432: note = derived and/or modified sequence opt3 from anti-HIV_cap256-119-159114_VR-Chain
  source 1..432: mol_type = other RNA
gaggtgcagctggtcgaaagcggcgggggactcgttcaacccggtggctcccttagactggcctgcgctgcatctgggttgaccttcaggaagcacggaatgcattgggtgcggcaggcccctggcaaaggtttagagtgggtatcatacatcagtagcgacggggtgaacaattatctgattgattccgtccgcggacgatttacagtgtctcgtgacaactcgaagaatactctatacctccagatggatggcctgagaggcgaagacacggcgctttattactgtgctaaagatctgagggagttggaatgcgaggagtgggcctcagactattacgatttcgggcggccacagccgtgtctcgacccccgcggagttagcggtataagtaacgtgtggggccaagggaccatggtcacagtgtcctct

SEQ ID NO: 24694 - RNA, 432 nt, synthetic construct
  misc_feature 1..432: note = derived and/or modified sequence opt3 from anti-HIV_cap256-119-156751_VR-Chain
  source 1..432: mol_type = other RNA
gaggtgcagctgctcgaaagcggcgggggacttgtccaacccggtggctccctgagattgtcttgcgccgcttcagggttcgcatttagtagctacggaatgcactgggttaggcaggcccctggcaagggtttagagtgggtggcgtccatctcttatgacgggcgggatttctaccatgctcgctcggtatggggacgatttaccatttcacgtgacaacagcaaaaatacactgcacctacagatgaacagtctcagaccagaagatactgccctgtatttctgtgcaagggaccttcgggagtccgaatgcgaggagtgggaatcttactattacgattttggcaagaaaggcccgtgtgtgaagccccgcggggtcgtgggagttctggacatatggggtcagggcacgttggtgaccgtcagctcc

SEQ ID NO: 24695 - RNA, 432 nt, synthetic construct
  misc_feature 1..432: note = derived and/or modified sequence opt3 from anti-HIV_cap256-119-155656_VR-Chain
  source 1..432: mol_type = other RNA
gaggtgcagctggtcgaaagcggcgggggactcgttcaacccggtggctcccttagactgtcttgcgccgcttcagggatcaccttcagtagctacggaatgcactgggtgaggcaggcacctggcaagggtttggagtgggtagcctttattcggtatgacgggtcctctaaatactatgcggattcggtgaagggacgcttcacaatatcacgagacaacagcaaaaatactttatacctgcagatggatggcctacgtggcgaagacacggctctctattactgtgccaaggatctgagagagcttgaatgcgaggagtgggcaagtgactattacgattttgggaggccacagccgtgtctggacccccggggagtctccggtatctctaacgtgtggggccaagggaccatggttacagtgagctcc

SEQ ID NO: 24696 - RNA, 432 nt, synthetic construct
  misc_feature 1..432: note = derived and/or modified sequence opt3 from anti-HIV_cap256-119-154420_VR-Chain
  source 1..432: mol_type = other RNA
caggtgagactggtcgagagcggcgggggagttgtgcaacccggtaggtccctccggatctcttgcgccgcttcacagttcatgtttagtcgctacggcatgcactgggtacgacaggcacctgggaagggacttgaatgggtggccagcatttcctatgacggcaccgataaataccatgcggacctggtctggggtcgtttcacaatatctagagataactcgaagaatactttgtatttacagatgaactcactgagggctgaggacacggccctatactattgtgcacgggatctccgcgaaagcgagtgcgaagagtgggagagtgactactatgattttgggaaaaagggaccatgtgtgaaaccgagaggcgttgccggctccctggacatgtgggggcaaggaaccatggtgatcgtctctagc

SEQ ID NO: 24697 - RNA, 432 nt, synthetic construct
  misc_feature 1..432: note = derived and/or modified sequence opt3 from anti-HIV_cap256-119-153954_VR-Chain
  source 1..432: mol_type = other RNA
gaggtgcaggtcctggaaagcggcgggggactcgttcaacccggtggctcccttaggctgtcttgcgtggcctcacagttcacctttagtgggtgtggattgcactgggtaaggcaggctcctggcaagggtttagagtgggtggcaagcatctccttcgccgggactaaaaagcattacggaaactctgtcaaaggccggtttacaatttcgcgcgacaattcaaagaacacggtgtatctggaaatgaatagcctacgagcggaggataccgctctctactattgcgccaaagacctgcgtgaatacgagtgtgaggaatggacaagtgattattacgacttcggcagaccacagccgtgcatagattccagaggggttgtgggaatccttgacatttggggtcaaggcactatggtcaccgtgtctagc

SEQ ID NO: 24698 - RNA, 432 nt, synthetic construct
  misc_feature 1..432: note = derived and/or modified sequence opt3 from anti-HIV_cap256-119-153864_VR-Chain
  source 1..432: mol_type = other RNA
caggtgcacctggtcgagagcggcgggggagttgtgcaacccggtggctccctcagactttcttgcgccgcttcagggttcacctttagtggatgtggcctgcattgggtaaggcaggcacctggtaaggggttggaatgggtggccagcatctccttcgcgggaactaaaaagcactacgggtcttcggtccggggccgcttttcaattagccgagacaacagtaaaaatacattatatctgcagatgaactccctacgtacggaggataccgctctctacttctgcgccaaggacctgagagaatatgagtgtgaagagtggacatctgattactatgactttggcaggccacagccgtgcatagatagccggggagtggttggtatccttgacatttggggccaagggactatggtgaccgtctcctca

SEQ ID NO: 24699 - RNA, 432 nt, synthetic construct
  misc_feature 1..432: note = derived and/or modified sequence opt3 from anti-HIV_cap256-119-153793_VR-Chain
  source 1..432: mol_type = other RNA
gaggtgcagctggtcgaaagcggcgggggagttgtgcaacccggtggctccctcagactttcttgcgccacctcagggttcacatttggaactttcggcatgcactgggtaaggcaggctcctggtaaggggctggactgggtggcatacatccggtatgatggaaaaacgaagaactacggcgagagtgtcaaaggccgctttaccattagccgagacaattccaagaacacaatgtctttgcagatgaatagcttacgtccagaagatactgccctgtattactgtgcgaaagacctaagagaggatgaatgcgaggagaggtggtcagactattacgatttcgggaagcagctcccgtgtcggaagtcgcgcggagtggctggtgtttttgacaactggggccaagggaccatggtgacagtcagttcc

SEQ ID NO: 24700 - RNA, 432 nt, synthetic construct
  misc_feature 1..432: note = derived and/or modified sequence opt3 from anti-HIV_cap256-119-153462_VR-Chain
  source 1..432: mol_type = other RNA
caggtgcaactggtcgagagcggcgggggagttgtgcagcccggtggctccctcagactttcttgcgccgcttcagggttcacctttagtaattacggaatgcagtgggtaaggcaggcacctggcaagggtctggaatgggtggccgcgatcagctatgacgggcggaatgagtactatgctgaatccgtcaaaggacgcttcacaatttctcgagataactttaagtcgactttgttcttacaaatgaactcactgcgtgccgaggacacggcactatactattgtgccagagatctcagggaaagcgagtgcgaggaatgggagagtgactactatgctttttaccggaaactgccatgtgtgaagccgcgcggcgttgcaggcacccttgatatatgggggcagggaacaatggtgactgtctcctct

SEQ ID NO: 24701 - RNA, 438 nt, synthetic construct
  misc_feature 1..438: note = derived and/or modified sequence opt3 from anti-HIV_cap256-119-153124_VR-Chain
  source 1..438: mol_type = other RNA
caggtgcaactggtcgagagcggcgggggagttgtgcagcccggtagatccctcaccctttcttgcatcgcctcacagttcaactttgctagttacggcatgcactgggtaaggcaggcacctgggaagggactggaatgggtggccagcatttcccatgacggcactaaaaagtatcacgcggagtctgtctggggtcggttcacaatatcgaaagataattcaaagaacacgttgtttttacaaatgaatagcctgcgcgtggaagacaccgctctatacttctgtgttaaagatcagcgagaggacgaatgcgaggagtggtggagtgattattacgactttgggcgtgaactcccatgtagaaagtccaggggactgggccttgccggcatcttcgatatgtgggggcatggaacaatggtgactgtctctagc

SEQ ID NO: 24702 - RNA, 438 nt, synthetic construct
  misc_feature 1..438: note = derived and/or modified sequence opt3 from anti-HIV_cap256-119-153025_VR-Chain
  source 1..438: mol_type = other RNA
cagatgcaactggtggagagcggcgggggagtcgttcagcccggtaagtccctcaccctttcttgcgccgcttcacagttcacatttagtaactacggcatgcactgggtgagacaggcacctgggaaaggactggaatgggtagccagcatctccaatgacggcaacaagaaatatcatggtgattctgtgtgggggaggttgactatttcgcgggacaattcaaagaacacgttattcctgcaaatgaatagcctacgcccagaggataccgcgctctacttttgtgtcaaagaccagcgagaagatgagtgcgaagagtggtggagtgactattacgatttcggacgtgagctgccgtgtagaaagtttaggggccttggcctggctgggatattcgacatctggggacacggtacaatggtgactgtttcctct

SEQ ID NO: 24703 - RNA, 432 nt, synthetic construct
  misc_feature 1..432: note = derived and/or modified sequence opt3 from anti-HIV_cap256-119-152713_VR-Chain
  source 1..432: mol_type = other RNA
gaggtgcagctggtcgaaagcggcgggggactcgttaggcccggtggctcccttaggctgtcttgcgccacctcagggttcacatttagtagccactggatgtcctgggtgcggcaagctcctggaaagggcttggagtgggtagcaggtatctctttcgccgggactaaaacgtactatggagactcggtgaagggccgctttaccgtctcaacagatattagcaaaaacactttatacctacaggtgaatagtctgcgaccagaagacaccgcgatgtattactgtgctcgtgatcagagatattacgagtgcgaagagtgggcctccgactattacgatttcggcaaggagcagccgtgtctcgaccccagaggggttgtgggaatatttgatatctggggtcaaggcacaatggtcaccgtgtctagc

SEQ ID NO: 24704 - RNA, 438 nt, synthetic construct
  misc_feature 1..438: note = derived and/or modified sequence opt3 from anti-HIV_cap256-119-151794_VR-Chain
  source 1..438: mol_type = other RNA
cacgtgcagctggtcgagagcggcgggggagttgtgcaacccggtacctccctcagactttcttgcgtagcctcagagttcagttttaagaactacggcatgcattgggtgaggcaggctcctgggaaaggactggaatgggtcgcaagcatctccaatgacggcacaaagaaatatcacgccgaatctgtgtgggatcggttctcgatttcaaaggacaacagcaaaaatactttgtttttacagatgaacagtctgcgcgttgaggatacggcgctatacttctgtgtgaaggaccagcgagaagatgagtgcgaggaatggtggtccgactattacgattttggtcgtgagctcccatgtagaaagtctagggggctgggacttgctggcatattcgacatgtggggccatgggaccatggtcacagtgagctcc

SEQ ID NO: 24705 - RNA, 438 nt, synthetic construct
  misc_feature 1..438: note = derived and/or modified sequence opt3 from anti-HIV_cap256-119-150980_VR-Chain
  source 1..438: mol_type = other RNA
caggtgcaactggtcgagagcggcgggggagttgtgcagcccggtaagtccctcagactttcttgcgccgcttcaggcttcatcctgagtaactacgcaatgcactgggtaaggcaggcccctgggaaaggattggaatgggtggcgagcatttccaatgacggctctaagaaatatcatggtgattcggtctgggctcggtttataatctcacgcgacaacagcaagaataccttattcctgcagatgagttccctacgagccgaggatacagcactctacttttgtgtgcgtgaccacagagaagatgagtgcgaagagtggtggtctgactattacgatttcgggagggagctgccatgtcggaaatttcgcggacttggcctggccggcattttcgacatctgggggcatggaactatggttacggtgagctcc

SEQ ID NO: 24706 - RNA, 432 nt, synthetic construct
  misc_feature 1..432: note = derived and/or modified sequence opt3 from anti-HIV_cap256-119-148895_VR-Chain
  source 1..432: mol_type = other RNA
caggtgcaactggtcgagagcggcgggggagttgtgcagcccggtagatccctcaggctttcttgcgccgcttcaggcttcacctttcggagttacgggatgcactgggtacgccaggcacctggaaagggcctggaatgggtggccgtcatcagctccgacggtgatattgagtattacacacagtctgtgaaagggcgattcactatatcgcgtgacaactcaaagaatacgttgtatttacaaatgaacgcgctgagaccagaagataccgctatgtactattgtgccagggaccagcggtactatgagtgcgaagagtgggcaagcgattactacgactttggacgcgagcagccgtgtcaggatcccagaggcgttgtgggcgtcttcgacatgtgggggcaaggaacaatggtgactgtaagttcc

SEQ ID NO: 24707 - RNA, 438 nt, synthetic construct
  misc_feature 1..438: note = derived and/or modified sequence opt3 from anti-HIV_cap256-119-148848_VR-Chain
  source 1..438: mol_type = other RNA
cagatgcaactggtggagagcggcgggggagtcgttcagcccggtagatccctcaccctttcttgcgccgcttcacagttcagttttacaagctacggcatgcactgggtgaggcaggcacctgggaagggactggaatgggtagcctccatctctaacgacggcactaaaaagtatcatggtgagtcggtgtgggatcggttctcaattagccgcgacaatagtaaaaacacgttgtttttacaaatgaactccctgcgagtcgaagataccgcgctatacttctgtgtgaaggaccagcgtgaggatgaatgcgaggagtggtggtctgactattacgattttgggaaagaactcccatgtagaaagtggaagacaaggggagttgctggcatactggacaattggggccaggggactatgcttaccgtgagctcc

SEQ ID NO: 24708 - RNA, 432 nt, synthetic construct
  misc_feature 1..432: note = derived and/or modified sequence opt3 from anti-HIV_cap256-119-148743_VR-Chain
  source 1..432: mol_type = other RNA
caggtgcaactggtcgagagcggcgggggagttgtgcagcccggtagatccctcaccctttcttgcgccgcttcacagttcaactttgcaaattacggcatgcactgggtaaggcaggcccctgggaagggactggaatgggtggcgagtatcagcaacgacggcactaaaaagtatcatgctgagtccgtctgggatcggttctctatttcgaaagacaattcaaagaacacattgtttttacaaatgaatagcctgcgcgtggaagatacggccctatacttctgtgttaaagaccagcgagaggatgaatgcgaggagtggtggagtgactattacgattttggtaagaagctcccatgtcgtaaatccagagggctggcaggaatattccacgtgtggggccatggcaccatggtcacagtgtctagc

SEQ ID NO: 24709 - RNA, 432 nt, synthetic construct
  misc_feature 1..432: note = derived and/or modified sequence opt3 from anti-HIV_cap256-119-148595_VR-Chain
  source 1..432: mol_type = other RNA
gaggtgcagctggtcgaaagcggcgggggactcgttcaacccggtggctcccttagactgtcttgcgccgcttcaaggttcacctttgacaactacgggatgcactgggtgcggcaggcacctggaaagggcttggagtgggtagccttactgaattatgatggtagtaaaaagtactatgtggacagcgtcaaagggcgcttcatcatttttcgagataactccaagaatacactattcctccagatgaactctctgcgtccagaagacactgcgctttacttttgtgtgaaagatcagagagaggacgcttgcgaagagtggtggtcggattattacgacttcggaaagaagctgccgtgtaggaaatcacggggcttggccggcatatttcatgtttgggggcacggaacgatggtgaccgtcagcagt

SEQ ID NO: 24710 - RNA, 432 nt, synthetic construct
  misc_feature 1..432: note = derived and/or modified sequence opt3 from anti-HIV_cap256-119-148490_VR-Chain
  source 1..432: mol_type = other RNA
caggtgcaactggtcgagagcggcgggggagttgtgcagcccggtagatccctcaggctttcttgcgtagcctcaggcttcacctttagtgactacgctatgcactgggtgcggcaggcacctgggaagggactggaatgggtcgccacaatcagcttcgatggcgcggacaaatatcatgctgatgacgtgtggggtcgctttactatttcccgagataactctaagaatacgttgtacttacagatgaactcgctgcgtccagaggacaccgccctatattactgtgcaaaagatctcagagaagacgagtgcgaagagaggtggtcagattattacgacttcgggaagcaactgccgtgtcggaaaagccgcggagttgccggcgtgtttgataattggggccaggggacaatggtcactgtgagttcc

SEQ ID NO: 24711 - RNA, 438 nt, synthetic construct
  misc_feature 1..438: note = derived and/or modified sequence opt3 from anti-HIV_cap256-119-148470_VR-Chain
  source 1..438: mol_type = other RNA
caggtgcaactggtcgagagcggcgggggagttgtgcagcccggtagatccctcaggctttcttgcgtagcctcaggcttcacctttagtagctacgggatccactgggtgcggcaggctcctggaaagggcctggaatgggtcgcagtgatttccgacgatggttctaaaaagtatcatgaggaatcggtttgggggcgcttcacaatatcaaaagacaacagcaagaatactttgtttttacagatgaacagtctgcgaatcgaggatacggccctatacttctgtgtgaaagaccaacgtgaagatgagtgcgaggaatggtggtccgactattacgattttggaagagagctcccatgtaggaagtctcggggcctgggccttgcggggattttcgacatgtggggacacggtaccatggtcacagtgagctcc

SEQ ID NO: 24712 - RNA, 432 nt, synthetic construct
  misc_feature 1..432: note = derived and/or modified sequence opt3 from anti-HIV_cap256-119-148107_VR-Chain
  source 1..432: mol_type = other RNA
gaggtgcagctggtcgaaagcggcgggggactcgttcaacccggtggctcccttagactgtcttgcgccgcttcagggttcaccgtgagtagcaactacatgacatgggtaaggcaggcacctcggaagggattggagtgggtgggctccatctcttatgacggttcggataaataccacactaattcattatgggggcgctttattgtcagccgagacaacagtaagaatacgctgtatctacagatgaacaatctccgtccagaagataccgccctgtactattgtgtgagagacaggcgggagtccgaatgcgaggagcgctggtctgattactatgacttcggaaaacagcttccgtgtgttaagcccagaggcgtggcgggcatatttgatatctgggggcaaggaacaatggtcactgtgagctcc

SEQ ID NO: 24713 - RNA, 432 nt, synthetic construct
  misc_feature 1..432: note = derived and/or modified sequence opt3 from anti-HIV_cap256-119-147933_VR-Chain
  source 1..432: mol_type = other RNA
gagctgcagctcgtggaaagcggcgggggacttgtccaacccggttggtccctgagattgtcttgcgaggcctcaggcttcccttttagtgctttctggatgacctgggttaggcaggcaccagggaagggattaggctgggtggcctttatccggtacgacggtagcaacaaatattacgcggattccgtaaaggggcgcttcacaatttctcgagacaattcgatgactacgctgtatctacagatgaactcactccgtgctgaagatgccgcagtgtactattgtgccaaagacctgagagaggatgaatgcgaggagtggtggagcgactactatgattttggaaagaggcttccgtgtcggaaaagtcgcggcgtcgctggcgtgttcgacaagtgggggcagggaaccatggttacagtgtcctct

SEQ ID NO: 24714 - RNA, 432 nt, synthetic construct
  misc_feature 1..432: note = derived and/or modified sequence opt3 from anti-HIV_cap256-119-147434_VR-Chain
  source 1..432: mol_type = other RNA
caggtgcaactggtcgagagcggcgggggagttgtgcaggccggtagatccctcaggctttcttgcgctgcatcacagttcacctttggccggtacgggatgcactgggtacgccaggcccccggaaagggcctggaatgggtgggtagtatcagctatgacgggtccgataaataccatacaaactctgtctggggacgattcattgtgtcgcgtgacaattcaaagaacactttgtatttacaaatgaatagcctgagacctgaggatacggcgatgtactattgtgctagggaccagcggtactatgaatgcgaggaatgggccagtgattactacgactttggccgcgagcagccatgtcaggatccgagaggcgttgtgggggtcttcgacatgtggggacaaggtaccatggtgacagtatcctct

SEQ ID NO: 24715 - RNA, 435 nt, synthetic construct
  misc_feature 1..435: note = derived and/or modified sequence opt3 from anti-HIV_cap256-119-146106_VR-Chain
  source 1..435: mol_type = other RNA
caggtgcaactggtcgagagcggcgggggagttgtgcagcccggtagatccctcaggctttcttgcgccgcttcaggcttcacctttagtagctccgggatgcactgggtacggcaggcacctggaaagggcctgcagtgggtggccgtcatctcttacgacggtgggaacaaatattacgcggattcggtgaagggacgcttcacaatttcacgagacaatagcaaaaacaatttgtatttacaaatgaacagtctgcgtccagaagatactgctctatactattgtgccagagacctcagggagatggaatgcgaggaatggaagctgtacaattattacgattttcggacgcgcggcccgtgtgttgaccccagaggcgtggtcgggtccttcgatgtgtggggacagggtaccgtagttacagtgtctagc

SEQ ID NO: 24716 - RNA, 438 nt, synthetic construct
  misc_feature 1..438: note = derived and/or modified sequence opt3 from anti-HIV_cap256-119-145604_VR-Chain
  source 1..438: mol_type = other RNA
gacgtgcagctggccgagagcggcgggggactcgtccaacccggtggctcccttagactgtcttgcgttgcttcagggttcacctttagtagcttcgaaatgcactgggtgaggcaggcacctggaaagggcttggagtgggtagcctccatctctaatgatggtacaaaacggtaccatgcggaatcggtgtgggaccgcttttcaattagcaaggataatagtaaaaacactttattcctgcagatgaactccctacgagtcgaggacacggctctctatttttgtgtgaaggatcagcgtgaagacgagtgcgaggaatggtggtctgattactatgacttcgggagagagctgccatgtaggaaaagccggggacttggcctggccggcatatttgatatgtgggggcacggaaccatggttacagtgtcctca

SEQ ID NO: 24717 - RNA, 438 nt, synthetic construct
  misc_feature 1..438: note = derived and/or modified sequence opt3 from anti-HIV_cap256-119-143998_VR-Chain
  source 1..438: mol_type = other RNA
caggtgcaactggtcgagagcggcgggggagttgtgcagcccggtagatccctcaggctttcttgcgccgcttcaggcttcacctttcggaactacgggatgcactgggtacgccaggcacctggaaagggcctggaatgggtggccagtatcagcaatgacggttccaaaaagtatcatggggattctgtctgggcgcgattcattatatcgcgtgacaacagcaaaaatacattgtttttacagatgtcaagtctgagagctgaggatactgccctatacttctgtgtgaaggaccaaagggaagatgagtgcgaagagtggtggtccgactattacgattttggacgggagctcccatgtcgcaaatctagaggcctgggccttgcagggatcttcgacatgtggggacacggtacgatggttaccgtgagctcc

SEQ ID NO: 24718 - RNA, 438 nt, synthetic construct
  misc_feature 1..438: note = derived and/or modified sequence opt3 from anti-HIV_cap256-119-143441_VR-Chain
  source 1..438: mol_type = other RNA
gaggtgcacctggtcgaaagcggcgggggactcgcccagcccggtagatcccttaggctgtcttgcgctgcatcacaattcaactttgccagttacggcatgcattgggttcggcaggcgcctgggaagggattggagtgggtggctagcatctccaatgacggcaccaaacgctatcacgccgaatctgtatgggatcgattctcgatttcaaaggacaacagcaaaaatacattatttctgcagatgaacagtctacgtgtggaggatactgcactctacttctgtgtcaaggaccagagagaagatgagtgcgaggaatggtggtccgactattacgattttggtagggagctgccatgtcggaaatctcgcgggcttggactggccggcatattcgacatgtggggccatgggacgatggtgaccgttagctcc

SEQ ID NO: 24719 - RNA, 432 nt, synthetic construct
  misc_feature 1..432: note = derived and/or modified sequence opt3 from anti-HIV_cap256-119-141307_VR-Chain
  source 1..432: mol_type = other RNA
caggtgcacctggtcgagagcggcgggggagttgtgcaacccggtagatccctcaggctttcttgcgccgcttcacagttcacctttaatcggtacggcctgcattgggtacgccaggcacctgggaagggattggaatgggtggccggcatcagttatgacggtcgagataaataccacgcgcatttcgtctgggggcgttttattataagcagagacaattccaagaacacattatatctgcagatgaactctctaagggctgaggatactgccctctactattgtgtgcgggacctgcgcgaatcggagtgcgaactttgggagtcagattactatgacttcggaaaaagactgccatgtgttaagccgaggggcgtggcaggcacgtttgatttgtgggggcaaggaaccatggtcacagtgagcagt

SEQ ID NO: 24720 - RNA, 432 nt, synthetic construct
  misc_feature 1..432: note = derived and/or modified sequence opt3 from anti-HIV_cap256-119-140896_VR-Chain
  source 1..432: mol_type = other RNA
gaggtgaagctggtcgaaagcggcgggggactcgttcagcccggtggctcccttaaactgtcttgcgccgcttcagggttcacctttagttactatgcaatgcactgggtgagacaagcccctggaaagggcttggagtgggtagcggtgatcagctacgacggttccgataaatattacgctgactctgtcaaggggaggttcacaatttcgcgggataacagcaaaaatactttacatctgcagatgaactcactacgcccagaagacacggccctctatttttgtgcacgagatctgcgtgagagtgaatgcgaggagtgggaatcctactattacgacttcggaaagaagggcccgtgtgtgaaacccagaggcgttgtgggggtccttgatatatggggacagggtaccctggtgacagtatctagc

SEQ ID NO: 24721 - RNA, 432 nt, synthetic construct
  misc_feature 1..432: note = derived and/or modified sequence opt3 from anti-HIV_cap256-119-140090_VR-Chain
  source 1..432: mol_type = other RNA
gaggtgcagctggtcgaaagcggcgggggactcgttcaacccggtggctcccttagactgtcttgcgccgcttcagggttcgcatttagtagctactggatgacctgggtgaggcaggcccctggaaagggcttggagtgggtagcggtgatctcctatgacggttctaacaaatactatgctgattcggtccgggggcgcttcacaatttcacgagacagcagtaagaatactttatacctggaaatgaactccctacgtccagaggatacggccctctattactgtgcaaaagacatgagaggatatgaatgcgaggagtggacctctgattactacgactttggcaggccgcagccctgtatagatagccggggcgtggttgggacattcgacgtgtggggacagggtactatggtcaccgtgtcctca

SEQ ID NO: 24722 - RNA, 438 nt, synthetic construct
  misc_feature 1..438: note = derived and/or modified sequence opt3 from anti-HIV_cap256-119-140037_VR-Chain
  source 1..438: mol_type = other RNA
caggtgcaactggtcgagagcggcgggggactcgttcagcccggtagatcccttaggctgtcttgcgccgcttcaggcttcacctttgacgattacgtgatgcactgggtacggcaggcacctgggaagggattggaatgggtggccagtatcagcaacgacggcactaaaaagtatcatgaggaatccgtctggggtcgcttcacaatttctaaagataattcgaagtcaacgttatttctgcagatgaacagcctacgaatagaggacaccgcgctctacttctgtgtgaaagatcaacgtgaagacgagtgcgaggaatggtggagtgattattacgactttgggagagagctgccatgtaggaagtcccggggacttggcctggctggcatcttcgatatgtgggggcacggaacaatggttactgtgtctagc

SEQ ID NO: 24723 - RNA, 432 nt, synthetic construct
  misc_feature 1..432: note = derived and/or modified sequence opt3 from anti-HIV_cap256-119-139135_VR-Chain
  source 1..432: mol_type = other RNA
gaggtgcagctggtcgaaagcggcgggggagttgtgaggcccggtggctccgtaaggctctcttgcgtggcctcagggttcagttttcggagctacggaatgcactgggtccgccaagctcctggcaagggtcttgagtgggtggcatccatctcttatgacgggcgagatttctaccatgcccgttcggtttggggaagatttaccatttcaagggacaacagcaaaaatacactgcacttgcagatgaacagtttacggccagaagatactgcgctgtatttctgtgctcgcgacctaagagagtccgaatgcgaggagtgggaatcttactattacgattttggcaagaaaggcccgtgtgtgaagcccagaggggtcgtgggagtactcgacatatggggtcagggcacgctggttaccgtgagctcc

SEQ ID NO: 24724 - RNA, 438 nt, synthetic construct
  misc_feature 1..438: note = derived and/or modified sequence opt3 from anti-HIV_cap256-119-137881_VR-Chain
  source 1..438: mol_type = other RNA
caggtgcaactggtcgagagcggcgggggactcgttaagcccggtagatcccttaccctgtcttgcgccgcttcacagttcacatttagtaactacggcatgcactgggtgaggcaggcacctgggaaaggattggaatgggtagccagcatctccaatgacggcaacaagaaatatcatggtgattctgtgtgggcgcggttcactatttcgcgcgacaattcaaagaacacgttatttctgcagatgagcagtctacgaaccgaggatacagctctctacttctgtgtccgtgacagaagggaagatgagtgcgaagagtggtggtccgactattacgattttgggcgggagctgccatgtcgcaaattcagaggacttggcctggccggcatatttgacatctgggggcacggaactatggtgaccgtttctagc

SEQ ID NO: 24725 - RNA, 432 nt, synthetic construct
  misc_feature 1..432: note = derived and/or modified sequence opt3 from anti-HIV_cap256-119-137643_VR-Chain
  source 1..432: mol_type = other RNA
gaggtgcagctggtcgaaagcggcggggacctcgttcaacccggaggttcccttagactgtcttgcgccgcttcaggcttcagttttagctcctacgggatgcactgggtgaggcaggcacctgataagggattggagtgggtaaccgtgatctcttatgacggctcgaacaaacattacgccgattcagtcaagggtcggttcacaattagccgcgacaatagtaaaaacactttatatctggaaatgaatacgctacgagcggaggataccgctctctactattgtgccaaggacctgcgtgaatacgagtgcgaggaatggacatccgattattacgactttgggagaccacagccgtgtatagattctaggggagtggttggcatccttgacatttggggccaggggactatggtgagcgtctcctca

SEQ ID NO: 24726 - RNA, 438 nt, synthetic construct
  misc_feature 1..438: note = derived and/or modified sequence opt3 from anti-HIV_cap256-119-137170_VR-Chain
  source 1..438: mol_type = other RNA
caggtgcaactggtcgagagcggcgggggagttgtgcagcccggtagatccctcaggctttcttgcgccgcttcagagttcacctttagtcggtacagcatgcactgggtacgccaggcacctggcaaggggctggaatgggtggccgtcatctcctctgacggatcgaaccagttccatgcggattcagtgtggggccgatttacaattagcaaagacaatagtaagaacactttgttcttacaaatgaatagcctgcgtatagaagatacggctctatatttttgtgttaaagaccagagagaggatgaatgcgaggagtggtggtctgactactatgatttcggtagggaactcccatgtcggaagtcccgcgggctgggacttgccggcatctttgacatgtggggccacgggaccatggtgacagtctcctca

SEQ ID NO: 24727 - RNA, 432 nt, synthetic construct
  misc_feature 1..432: note = derived and/or modified sequence opt3 from anti-HIV_cap256-119-136616_VR-Chain
  source 1..432: mol_type = other RNA
caggtgcaactggtcgagagcggcgggggagttgtgcagcccggtagatccctcaggctttcttgcgccgcttcaggcttcacctttagtcggaacgcaatcaattgggtacgccaggcccctgggcgaggactggaatgggtggcggtcattagcgacgatggctccttgaagtactatgctgactctgtgaaaggtcgtttcacaatatcgagagataactcaaagaatactttatacctgcagatgaacaatctaaggccagaggacacggccctctattactgtgttcgggatcgcagagaaagcgagtgcgaagagaggtggagtgactattacgattttgggaaacaactgccgtgtgtgaagccccggggagtcgcaggcatcttcgacatttggggccaggggaccatggtgacagtatcctct

SEQ ID NO: 24728 - RNA, 432 nt, synthetic construct
  misc_feature 1..432: note = derived and/or modified sequence opt3 from anti-HIV_cap256-119-136206_VR-Chain
  source 1..432: mol_type = other RNA
caggtgcaactggtcgagagcggcgggggagttgtgcagcccggtaggtccctcaggctttcttgcgccgcttcacagttcacctttggccggtacgggatgcactgggtacgccaggcacctggaaagggcctggaatgggtggccgcgatcagtttcgctggtactaaaaagtattacggggacagcgcccgaggacgttttacaatttccagagataactctaaaaatatgttgttcttacaaatgaactcgctgagggcagaggacacggccctatattactgtgctcgggatctccgcgactatgaatgcgaggaatgggaggcatactattacgattttggcagagtcggcccatgtaccgacccgagaggggtggttggaatactggatgtgtggggtcagggcacacttgtcactgtgtcaagc

SEQ ID NO: 24729 - RNA, 438 nt, synthetic construct
  misc_feature 1..438: note = derived and/or modified sequence opt3 from anti-HIV_cap256-119-135565_VR-Chain
  source 1..438: mol_type = other RNA
caggtgcacctggtcgagagcggcgggggagttgtgcaacccggtaagtccctcagactttcttgcgccgcttcacagttcacctttgacaggtacggcatgcattgggtacggcaggcacctgggaaaggactggaatgggtggccagtatcagcaacgatggcacagacaagtatcacgcggataatgtctggggtcgcttcactatttcccgagacaactctaaaaatacgttgtacttagagatgaactcgctgcgtggggaagataccgctctatatttttgtgtgaaggaccagagagaggatgaatgcgaggagtggtggtcagactactatgatttcggaagggaactcccatgtcggaaaagccgcggcctgggccttgccgggatatttgacatgtggggacatggtacaatggttactgtgagttcc

SEQ ID NO: 24730 - RNA, 432 nt, synthetic construct
  misc_feature 1..432: note = derived and/or modified sequence opt3 from anti-HIV_cap256-119-135025_VR-Chain
  source 1..432: mol_type = other RNA
gaggtgcagctggtcgaaagcggcgggggactcgttcaacccggtggctcccttagactgtcttgcgaggcctcagggttcacctttaacacatacgaaatgaattgggtgaggcagcctccaggacggggcttggagtgggtagctggtatcagtttcgcagccactaagacgtattacgggggaagcgtgaaaggccgctttaccgtctcccgagacatttctaagaacacattatatctgcagatggatggcctacgtggggaagacactgcgctctactattgtgctaaagatctgagagagcttgagtgcgaagagtgggcctcggactactatgatttcggaaggccgcagccctgtctggaccctcggggtgtgtcaggcataagcaatgtttgggggcaaggaaccatggtgacagtcagttcc

SEQ ID NO: 24731 - RNA, 432 nt, synthetic construct
  misc_feature 1..432: note = derived and/or modified sequence opt3 from anti-HIV_cap256-119-133983_VR-Chain
  source 1..432: mol_type = other RNA
cagatgcaactggtggagagcggcgggggagtcgttcagcccggtagatccctcaccctttcttgcgccgcttcacagttcaactttgcaaattacggcatgcactgggtgaggcaggcccctgggaagggactggaatgggtagcgagtatcagcaacgacggcactaaaaagtatcatgaggaatccgtgtggggtcggttcacaatttctaaagataattcgaagaacacgttgtttttacaaatgaactcactgcgcccagaggacaccgctctatactattgtgccaaagatctccgagaagacgagtgcgaggaacgttggagcgattactatgacttcgggaagcagctgccgtgtagaaagagtaggggagtcgcaggcgtgtttgataattggggccaggggacaatggttactgtgtcctct

SEQ ID NO: 24732 - RNA, 438 nt, synthetic construct
  misc_feature 1..438: note = derived and/or modified sequence opt3 from anti-HIV_cap256-119-133917_VR-Chain
  source 1..438: mol_type = other RNA
cagatgcaactggtggagagcggcgggggagtcgttcagcccggtagatccctcaccctttcttgcgccgcttcacagttcacatttagtaactacggcatgcactgggtgaggcaggcacctgggaagggactggaatgggtagccagcatctccaatgacggctctaaaaagtatcatggtgattcggtgtgggcgcggttcactatttcacgcgacaacagcaaaaatacgttgtttttacaaatgagttccctgcgagtcgaggataccgctctatacttctgtgtgcgtgaccagagagaagatgagtgcgaagagtggtggtctgactattacgattttgggagggagctcccatgtcggaagttccgcggactgggccttgccggcatatttgacatctgggggcacggaacaatggttactgtgagctcc

SEQ ID NO: 24733 - RNA, 432 nt, synthetic construct
  misc_feature 1..432: note = derived and/or modified sequence opt3 from anti-HIV_cap256-119-132663_VR-Chain
  source 1..432: mol_type = other RNA
caggcccaactggtggagagcggcgggggagtcgttcagcccggtagatccctcaggatctcttgcgctgtgtcacagttcacctttagtcggtacggcatgcactgggtacgccaggcacctgggaagggacttgaatgggtggccagcatttccttcgacggccgagataaatatcattctccactggtctggggtcgtttgacaatatcgagagacaactcaaagaatactttatttctggagatgaacagcctaagggcggaagatacggctgtgtactattgtgcccgggacctccgcgagagtgaatgcgaggagtggcaatccgattactatgcattctacaaaaagctgccgtgtgttaaacccagaggggtggccggatctcttgacatctggggccagggcaccgtcgtgacagtaagctcc

SEQ ID NO: 24734 - RNA, 438 nt, synthetic construct
  misc_feature 1..438: note = derived and/or modified sequence opt3 from anti-HIV_cap256-119-132113_VR-Chain
  source 1..438: mol_type = other RNA
caggtgcaactggtcgagagcggcgggggactcgttaagcccggtggctcccttagactgtcttgcgccgcttcacagttcaactttgcaaattacgggatgcactgggtgaggcaggcccctggaaaaggcttggaatgggtagcgagtatcagcaacgacggtaccaagaaatatcatgaggaatccgtgtgggggcggttcacaatttctaaggataattcgaaatcaactttatttctgcagatgaacagcctacgcatagaggacacggctctctacttctgtgtcaaggatcaacgagaagacgagtgcgaggaatggtggagtgattattacgactttggacgtgagctgccatgtagaaagtccaggggccttggcctggccgggatcttcgatatgtggggacacggtaccatggtgacagtttctagc

SEQ ID NO: 24735 - RNA, 432 nt, synthetic construct
  misc_feature 1..432: note = derived and/or modified sequence opt3 from anti-HIV_cap256-119-131839_VR-Chain
  source 1..432: mol_type = other RNA
caggtgcaactggtcgagagcggcgggggagttgtgcagcccggtagatccctcaggctttcttgcgccgcttcaggcttcacctttagtagctacgcaatgcactgggtacggcaggcccctgggaagggactggaatgggtggcggtcatctcctatgacggctctaacaaatactatgctgattcggtgaagggtcgcttcacaatttcacgagacaatagcaaaaacactttgtacttacagatgaatagtctgcgtgccgaggatacggcagtttattactgtgccagagaccaaaggtattacgaatgcgaggaatgggcttccgattactatgactttgggcgggagcagccatgtcaggatccgcgcggagtggtcggcgtgttcgacatgtggggccaggggaccatggtaacagtttctagc

SEQ ID NO: 24736 - RNA, 435 nt, synthetic construct
  misc_feature 1..435: note = derived and/or modified sequence opt3 from anti-HIV_cap256-119-130626_VR-Chain
  source 1..435: mol_type = other RNA
gaggtgcagctggtcgaaagcggcgggggactcatccaccccggtggctgccttagactgtcctgtgccgtttctgggttcaccttttcagactaccctatgcattgggtgaggcaaagtccaggaaagggcttggagtgggtagctgtgattagctatgatggtataaactactattacgcagactccgtcaaagggcggttcacaatctctcgcgataattcgaagaacaatttatttctgcagatgaactcactacgactcgaagacactgccctgtattactgcgcgcgtgatcttagagagctggactgtgaagagtggacgttgtataattactacgatttcggaagcaggggcccgtgcgtggacccccggggcgttgggggaagttttgatgtgtggggtcagggcaccatggtcacagtgtcctct

SEQ ID NO: 24737 - RNA, 438 nt, synthetic construct
  misc_feature 1..438: note = derived and/or modified sequence opt3 from anti-HIV_cap256-119-130191_VR-Chain
  source 1..438: mol_type = other RNA
gaggtgcagctggtcgaaagcggcgggggactcatccaacccggtagatcccttaggctgtcttgcgccgcttcaggcttcaccgttagtagcaactttatgacatgggtgcggcaggcacctgggaagggattggagtgggtagcctccatttctaatgacggcactaagaagtaccacgcggaatcggtgtgggatcgcttctcaataagcaaagacaacagtaagaatacgttatttctgcagatgaactccctacgagtcgaggataccgctctctatttctgtgtgaaagaccagcgtgaagatgagtgcgaggaatggtggtctgactactatgattttggtagagagctgccatgtaggaaaagccgggggcttggactggccggcatcttcgacatgtggggccatgggacaatggttactgtgtcctca

SEQ ID NO: 24738 - RNA, 438 nt, synthetic construct
  misc_feature 1..438: note = derived and/or modified sequence opt3 from anti-HIV_cap256-119-129798_VR-Chain
  source 1..438: mol_type = other RNA
caggtgcaactggtcgagagcggcgggggagttgtgcagcccggtaagtccctcagactttcttgcgccgcttcaggcttcatctttagtagctacttcatgcactgggtaaggcaggcacctgggaaaggactggaatgggtggccgtcgtgaccgacgatggctccaagaaatattacgcggactctgttaagggtcggtttacaatttcgcgcgattatagcaaaaacactttgttcttacagatgaatcgactgcgtgtggaggacacggctctatacttttgtgtcaaggatcaaagagaagacgagtgcgaagagtggtggtcagattattacgacttcgggagggagctcccatgtcggaagtttcgcggactgggccttgccggcatattcgatatgtgggggcatggaaccatggtgacagtaagttcc

SEQ ID NO: 24739 - RNA, 432 nt, synthetic construct
  misc_feature 1..432: note = derived and/or modified sequence opt3 from anti-HIV_cap256-119-128745_VR-Chain
  source 1..432: mol_type = other RNA
caggtgcaactggtcgagagcggcgggggagttgtgcagcccggtagatccctcaggctttcttgcgccgcttcaggcttcacctttagtaactacgcaatgcactgggtacggcaggcccctgggaagggactggaatgggtggcgagcatctccttcgctggcacaaaaactcattatggtaattctgtcaaggggcgcttttcgatttcacgagacaacagcataaatacggtgtacttgcagatgaacagtttacgtgccgaggataccgcactgtattactgtgccaaagacctaagagaatatgagtgcgaagagtggacatccgattactatgacttcggaaggccacaaccgtgtatcgattctcggggcgttgtgggcattctcgacatctggagccaggggactatggtcaccgtgtcctca

SEQ ID NO: 24740 - RNA, 438 nt, synthetic construct
  misc_feature 1..438: note = derived and/or modified sequence opt3 from anti-HIV_cap256-119-128593_VR-Chain
  source 1..438: mol_type = other RNA
caggtgcaactggtcgagagcggcgggggagttgtgcagcccggtagatccctcaggctttcttgcgccgcttcaggcttcacctttagtagctacgcaatgcactgggtacggcaggcccctgggaagggactggaatgggtggcgtccatctcttatgacggccgcgatttctaccatgctcgatcggtctggggtcgttttacaatttcaagagacaacagcaaaaatactttgcacttacagatgaacagtctgagggtggaggatacggccctatatttctgtgttaaggaccaacgggaagatgagtgcgaagagtggtggtccgactactatgattttgggcgcgagctcccatgtagaaaatctaggggactgggccttgcaggcatattcgacatctgggggcatggaaccatggtgacagtcagctcc

SEQ ID NO: 24741 - RNA, 438 nt, synthetic construct
  misc_feature 1..438: note = derived and/or modified sequence opt3 from anti-HIV_cap256-119-128152_VR-Chain
  source 1..438: mol_type = other RNA
caggtgcaactggtcgagagcggcgggggagttgtgcagcccggtagatccctcaggctttcttgcgccgtatcaggcttcacctttacaagttaccctatgcactgggtgcggcaggctccagggaagggactggaatgggtcgcaagcgtgtccaacgacggcactaaaaagtatcatggtgattctgtttgggaccgcttcacgatctcgcgagataatagcaaaaacaccttgtttttacagatgtcaagtctgcgtgccgaggacacagcggtgtacttctgtgtcagagatgaaagggaggacgaatgcgaggagtggtggtccgattattacgactttgggcgggaactaccgtgtcgcaagttcagaggactcggcctggctggcatttttgatatatgggggcacggaactcttgtgaccgtatctagc

SEQ ID NO: 24742 - RNA, 438 nt, synthetic construct
  misc_feature 1..438: note = derived and/or modified sequence opt3 from anti-HIV_cap256-119-127693_VR-Chain
  source 1..438: mol_type = other RNA
gaggtgcagctgctcgaaagcggcgggggacttgtccaacccggtggctccctgagattgtcttgcgccgcttcagggttcacctttagtagctacgcaatggcctgggttaggcaggcgcctggaaagggcttagagtgggtggcttccatctctaacgacggttcgaaaaagtatcacggggattcagtatgggcccggttcattataagccgcgacaatagtaaaaacacactgtttctacagatgtcctctctccgagtggaagatactgcactgtacttctgtgtccgtgaccatagagaggatgaatgcgaggagtggtggagcgactattacgattttggaagggaacttccatgtcggaagttccgcggcctgggcttggccgggatctttgacatttggggacacggtacgatggtgaccgtttcctca

SEQ ID NO: 24743 - RNA, 432 nt, synthetic construct
  misc_feature 1..432: note = derived and/or modified sequence opt3 from anti-HIV_cap256-119-126684_VR-Chain
  source 1..432: mol_type = other RNA
caggtgcaactggtcgagagcggcgggggagccgttagacccggtaggtccctccggctttcttgcgctacctcaggcttcacatttagtaactacgcaatgcactgggtgcgccaggcccctgggaagggactggaatgggtaactggcatcagcttcgcgggtacgaaaacctattacggggactccgtgcgaggacgttttacagtctctagagatatttcgaagaatactttgttcttacagatgaactcactgaggccagacgataccgctatgtattactgtgcccgggaccagcgctattacgagtgcgaagagtgggcaagcgattattacgactttggcagagaacaaccgtgtctagatcccaggggcgtggttgggatattcgacctctggggacagggtacaatggtgaccgtcagttcc

SEQ ID NO: 24744 - RNA, 438 nt, synthetic construct
  misc_feature 1..438: note = derived and/or modified sequence opt3 from anti-HIV_cap256-119-126056_VR-Chain
  source 1..438: mol_type = other RNA
gaggtgcagctggtcgaaagcggcgggggactcgttcaacccggtggctcccttagactgtcttgcgccgactcagggttcacctttagtagctactggatgtcctgggtgaggcaggctcctggaaagggcttggagtgggtagcatctatctcgaatgatggtactaaaaagtatcacgccgaatcagtgtgggaccggttcagcattagtaaagataattccaagaacacattatttctgcagatgaactctctacgcgtcgaggacacggcgctctacttctgtgtgaaagatcagcgagaagacgagtgcgaggaatggtggagcgattattacgactttgggcgtgagctgccatgtagaaagtccaggggacttggcctggctggcatattcgatatgtgggggcatggaaccatggttacagtgtcaagt

SEQ ID NO: 24745 - RNA, 432 nt, synthetic construct
  misc_feature 1..432: note = derived and/or modified sequence opt3 from anti-HIV_cap256-119-125765_VR-Chain
  source 1..432: mol_type = other RNA
caggtgcaactggtccagagcggcgggggagttgtgcagcccggtagatccctcaggctttcttgcgccgcttcaggcttcacctttagtagctacgtaatgcactgggtgcggcaggcacctgggaagggactggagggcgtcgccgtgatctccttcgacggtaacaatgaatattacgcggattctgttaaagggcgctttacaatttcgcgagacaactcaaagaatactgtgtatttgcaaatgaacagcttacgtgtcgaggatacggctctgtactattgtgccaaagacatgagagaatacgagtgcgaagagtggaccagtgattattacgacttcggaaggccacagccgtgtatagattcccggggcgtggtaggcatcctagacatttgggggcagggaatcatggttacagtgtctagc

SEQ ID NO: 24746 - RNA, 438 nt, synthetic construct
  misc_feature 1..438: note = derived and/or modified sequence opt3 from anti-HIV_cap256-119-125106_VR-Chain
  source 1..438: mol_type = other RNA
caggtgcaactggtcgagagcggcgggggagttgtgcagcccggtagatccctcaggctttcttgcgccgcttcaggcttcatctttcggagttacgggatgcactgggtacgccaggcacctggaaagggcctggaatgggtggccagcatttccaacgacggtaccaaacgatatcatgcggagtctgtctgggatcgtttctcgatatcaaaggacaatagcaaaaacacattgtttttacagatgaatagtctgagagtggaagatactgctctatacttctgtgttaaggaccaaagggaggatgaatgcgaggagtggtggtccgactattacgattttgggcgggaactcccatgtcgcaaatctagaggactgggccttgccggcatcttcgacatgtgggggcacggaacgatggtgaccgtcagctcc

SEQ ID NO: 24747 - RNA, 435 nt, synthetic construct
  misc_feature 1..435: note = derived and/or modified sequence opt3 from anti-HIV_cap256-119-124026_VR-Chain
  source 1..435: mol_type = other RNA
caggtgcaactggtcgagagcggcgggggagttgtgcagtccggtagatctctcaggcttacctgctcaggcagtgccttccggtttagctcctacacagtacactgggtgcgccaggctcccgggaagggactggaatggttggcattaatctcttatgacggccagaaaaagcatttcgccgattcggtcaaaggtcgatttactatttcacgtgacaacagcaagaataacctgttcctacaaatgaatagtctcagactggaggatacggcgctttactattgtgctagggacctgcgggaattggattgcgaggaatggaccctctacaactattacgactttgggtcccgcggaccttgtgtggatccaagaggcgttggcgggtctttcgacgtgtggggacagggtacaatggtcactgtgagctcc

SEQ ID NO: 24748 - RNA, 432 nt, synthetic construct
  misc_feature 1..432: note = derived and/or modified sequence opt3 from anti-HIV_cap256-119-121783_VR-Chain
  source 1..432: mol_type = other RNA
ctgggcagactcgtggccagcgggggaggtgtcgttccccctggcgggtcccttaccctgtcttgcgtgacatcacagttcacttttagtggatgtggcttgcactgggtaaggcaagctccaggtaaggggttagagtgggtggcaagcatctccttcgccggaacgaaaaagcattacgggtcttcggtccggggccgcttttcaattagccgagacaacagtaaaaataccctgtatctacagatgaactccctccgtacagaagatactgcgctgtacttctgcgctaaggaccttagagagtatgaatgtgaggaatggacctctgattactatgactttggcaggccgcagccctgcatagatagccggggagtggttggtatcctggacatttggggccaggggacaatggtgaccgtctcctca

SEQ ID NO: 24749 - RNA, 432 nt, synthetic construct
  misc_feature 1..432: note = derived and/or modified sequence opt3 from anti-HIV_cap256-119-121208_VR-Chain
  source 1..432: mol_type = other RNA
ctgggccggctcgtggccagcgggggaggtgtcgttccccctggcaagtcccttaccctgtcttgcgtggcttcacagttcacatttagtgggtgtggattgcactgggtaaggcaagcaccaggcaaaggtttagagtgggtggccagcatctccttcgcggggactaagaaacattacggaaattttgtccggggccgcttcacgatttctcgagacaattcgaagaacaccctgtatctacagatgaactcactccgtgctgaagatacagccctgtactattgcgcaaaagaccttagagagtacgaatgtgaggaatggactagcgattattacgactttggcaggccgcagccctgcatagatagtagaggggtggttggaatcctggacatttggggtcagggcaccatggtgacagtctcctct

SEQ ID NO: 24750 - RNA, 432 nt, synthetic construct
  misc_feature 1..432: note = derived and/or modified sequence opt3 from anti-HIV_cap256-119-120945_VR-Chain
  source 1..432: mol_type = other RNA
caggtgcaactggtcgagagcggcgggggagttgtgcagcccggtggctccctccggctttcttgcgtagcctcagggttcacctttagtaactacggaatgcactgggtgaggcaggctcctggcaagggtctggcatgggtcgccttcatccggtatgacgggagcaataaatactatgtggattccgtttggggacgctttacaatttctcgagacaactcgaagaatactttgcatttacagatgaactcactgcgtccagaagatacggcgctatacttctgtgctagagacctcagggagagcgaatgcgaggaatgggagagttattactatgattttggcaataaaggcccgtgtgtgaagcccagaggggtcgtgggagtactggacatatggggtcaaggcacccttgttacagtgtcctct

SEQ ID NO: 24751 - RNA, 432 nt, synthetic construct
  misc_feature 1..432: note = derived and/or modified sequence opt3 from anti-HIV_cap256-119-118229_VR-Chain
  source 1..432: mol_type = other RNA
caggtgcaagtcgttgagagcggcgggggagtggtacagcccggtagatccctgaggctctcttgcgccgcttcaggcttcacctttagtaattacgcaatccactgggtgcggcaggcccctgggaagggacttgaatgggtcgcgctgattagctatgacggctacaataaatattacgctgattccgtgcgcggtcgattcacaatatctcgtgacaactcgaataacactgtttatttgcagatgaactcattaaagccagaggatacggccgtgtactattgtgcaagagacctgagggaaagcgagtgcgaagagtgggagagttactactatgattttgggaaaaagggaccgtgtgtcaaaccccggggcgtggtaggcgttctagacatctgggggcaaggaaccctcgtgacagtctcctct

SEQ ID NO: 24752 - RNA, 432 nt, synthetic construct
  misc_feature 1..432: note = derived and/or modified sequence opt3 from anti-HIV_cap256-119-118025_VR-Chain
  source 1..432: mol_type = other RNA
gaggtgcagctggtcgaaagcggcgggggagttgtgcaacccggtaagtccctcagactttcttgcaccgcctcacagttcacatttagtaacttcggcatgcactgggtaaggcaggctcctgggaaaggactggagtgggtggcaagcatctcctttgtcggcattaagactcattacgccaattctgtgcggggtcgcttcacgatatcgcgagaccagtcaaagaacaccttgtatttacaaatgaatagcgttcgtatcgaagatacagcgagatacttttgtgctagggacatgcgggagtatgaatgcgagctgtgggccagtgattactatgacttcgggaaaccacagccgtgtgaggatccccgcggagtggtcggcacttttgacatgtggggcctagggaccctcgtgacagtatcctct

SEQ ID NO: 24753 - RNA, 432 nt, synthetic construct
  misc_feature 1..432: note = derived and/or modified sequence opt3 from anti-HIV_cap256-119-117418_VR-Chain
  source 1..432: mol_type = other RNA
caggtgcaactggtcgagagcggcgggggagttgtgcagcccggtagatccctcaggctttcttgcgccgcttcaggcttcaactttcggaattacgacatcaactgggtacgccaggtgcctgggaagggactggaatgggtcgcagccattagtttcgatggcgcggacaaatatcacgctgataatgtgtggggtcgattgagcatatcccgtgacaactctaagtcgaccttatacctgcagatgaactcactaagaccagaggatacagccgtttatttttgtgcaaaagacctcagggaagatgagtgcgaggaacggtggagcgactactatgatttcgggaagcaactgccgtgtcgcaaaagtagaggagtggccggcatctttgacaattggggccaggggactatggtcacggtgtccgct

SEQ ID NO: 24754 - RNA, 432 nt, synthetic construct
  misc_feature 1..432: note = derived and/or modified sequence opt3 from anti-HIV_cap256-119-117250_VR-Chain
  source 1..432: mol_type = other RNA
caggtgagactggtcgagagcggcgggggagttgtgcaacccggtggctccctcaggctttcttgcgccgcttcacagttcacctttagtgcatacgggatgcactgggtacggcaggcccctggaaagggcctggaatgggtggcgagcatctccttcgacggtacagataaatttcatgctgacaaggtctgggggcgcttggtgatttctcgagataactcgaaaaatactttatatctgcagatgaactcactacgtccagaggacacggccgtttactattgtgcaaaggatctcagagaagacgagtgcgaagagaggtggagcgattactatgacttcggaaaacaactgccgtgtcggaagagtcgcggcgtggccggcgtctttgataattgggggcagggaaccatggtgacagtatcctct

SEQ ID NO: 24755 - RNA, 432 nt, synthetic construct
  misc_feature 1..432: note = derived and/or modified sequence opt3 from anti-HIV_cap256-119-117230_VR-Chain
  source 1..432: mol_type = other RNA
caggtgcaactggtcgagagcggcgggggaggtgttcagcccggcagatccctcaggctttcttgcgccgcttcagggttcaccctgagtagctacggaatgcactgggtgcggcaggcacctggcaagggtttggaatgggtagcctccatctcttttgacgggcgcgattattaccattcgccacacgtgtggggacgattaacaatttcacgtgacaacagcaaaaatactctgtatctacagatgaacagtctcagagcggaggatacggctctgtactattgtgccagggaccttcgggaatccgagtgcgaagagtgggagtctgattactatgacttcggcaagaaaggcccgtgtgtcaagccccgcggggtggcaggaagcctggatatgtggggtcaaggcaccatggttatagtgtcctca

SEQ ID NO: 24756 - RNA, 432 nt, synthetic construct
  misc_feature 1..432: note = derived and/or modified sequence opt3 from anti-HIV_cap256-119-116999_VR-Chain
  source 1..432: mol_type = other RNA
caggtgcaactggtcgagagcggcgggggagttgtgcagcccggtacctccctcagaatctcttgcgccgcttcacagttcacatttagtaggtacggcatgcactgggtacggcaggcacctgggaagggacttgaatgggtggccagcatttcctatgacggccgcgattactatcatgcgggtcgagtctgggggcgtttcactatatctagagacaactcgaaaaatacgctgtacttgcaaatgaactcattaaggccagaggataccgctctgtatttttgtgtgcgggacagccgcgaaagtgagtgcgaagagtgggagtccgattactatgacttcggaaagaaactaccgtgtgttaagcccagaggcgtggtcggcgtgctcgatctgtgggggcagggaacacttgtaactgtttctagc

SEQ ID NO: 24757 - RNA, 432 nt, synthetic construct
  misc_feature 1..432: note = derived and/or modified sequence opt3 from anti-HIV_cap256-119-116558_VR-Chain
  source 1..432: mol_type = other RNA
caggtgcaactggtcgagagcggcgggggagttgtgcagcccggtagatccctcaggctttcttgcgccgcttcaggcttcacctttaaccggtacagtctgcactgggtacgccaggcacctgggaagggattggaatgggtggccttcacaagctatgacggctccaataaatactatccagattctgtcaagggtcgatttactatctcgcgtgactcaagcaaaaacacgttatacctggagatgaatagtctaagaccggaagataccgcgctctattactgtgctaaggacatgagggggtatgagtgcgaagagtggacatccgattactacgacttcggacggccccagccttgtattgattctcgcggcgtggttggcacttttgacgtgtgggggcaaggaaccatggtcacagtgagctcc

SEQ ID NO: 24758 - RNA, 432 nt, synthetic construct
  misc_feature 1..432: note = derived and/or modified sequence opt3 from anti-HIV_cap256-119-116484_VR-Chain
  source 1..432: mol_type = other RNA
gacgtgcagctgctcgagagcggcggggatcttgtccaacccggaggttccctgagattgtcttgcgccgcttcaggcttcacctttacaaagtacgaaatgacttgggttaggcaggcacctgggaaaggattagagtgggtggccagtatcagctatgacggctccgataagtaccacacgtcttcgctgtggggtcggttcattgtatcacgcgacaacagcaaaaataccctatatctccagatgaacagtctgcgaccagaagatacagcgctttactattgtgtgcgtgacagaagggagtccgaatgcgaggagcggtggtctgattactatgactttgggaagcagctgccgtgtgtcaaaccccgcggagtggctggcatattcgatatctggggccaagggactatggttaccgtgagctcc

SEQ ID NO: 24759 - RNA, 438 nt, synthetic construct
  misc_feature 1..438: note = derived and/or modified sequence opt3 from anti-HIV_cap256-119-114844_VR-Chain
  source 1..438: mol_type = other RNA
gaggtgcagctggtcgaaagcggcggggacctcgttcaacccggaagatcccttaggctgtcttgcgccgcttcaggtttcacctttagtagctactggatgtcctgggtgcggcaggcacctggcaaggggttggagtgggtagcctctatctcgaacgatggaactaaaaagtatcacgaagagtcagtgtggggccgcttcacaattagcaaagacaatagtaagtccacgttatttctgcagatgaactctctacgagtcgaagataccgcgctctacttctgtgtgaaagaccagcgtgaggatgagtgcgaagagtggtggagcgactattacgattttggtagagaactgccatgtaggaagtcccgggggcttggactggctggcatattcgacatgtggggccatgggacaatggttactgtgtcaagt

SEQ ID NO: 24760 - RNA, 438 nt, synthetic construct
  misc_feature 1..438: note = derived and/or modified sequence opt3 from anti-HIV_cap256-119-114141_VR-Chain
  source 1..438: mol_type = other RNA
ggcgggagaagcggaggtggcggggtgggaaccacacccaggcggggccctctgcgcctctcctgcgccgcttctggtttcactcttgacgattacgcaatgcactgggtccgacaggccccagggaagggactggagtgggttgcgtcaatcagtaatgacggcacgaaaaagtatcatgctgaaagcgtgtgggatcgtttttccatttctaaagacaattcgaagaacaccttgttcttacaaatgaactcactgagagtagaggatacagccctatacttttgtgtgaaagaccagagggaagatgagtgcgaagagtggtggagcgactattacgtcttctgggagcgggcaccgtgtcgcactgtgcccggcagagggcctggatggtattttgatatggttggtaggcggaccatggtgacagtcagttcc

SEQ ID NO: 24761 - RNA, 432 nt, synthetic construct
  misc_feature 1..432: note = derived and/or modified sequence opt3 from anti-HIV_cap256-119-111917_VR-Chain
  source 1..432: mol_type = other RNA
gaggtgcacctggtcgaaagcggcgggggactcgttcagcccggtggctcccttagactgtcttgcgccgcttcagggttcacctttagtagctacggaatgcattgggtgaggcaagcacctggcaagggtttggagtgggtagccacaatctccttcgacggggcggataaatatcacgctgacgatgtgtggggacggttttctatttcgcgcgacaactcaaagaatactttatacctgcagatgaacaatctacgaccagaagatacggccctctattactgtgcaaaagacctgcgtgaggatgaatgcgaggagagatggagcgactattacgatttcggcaagcagcttccgtgtaggaaaagtcggggcgtcgccggggtgtttgacaactggggacagggtaccatggttacagtgtcctct

SEQ ID NO: 24762 - RNA, 432 nt, synthetic construct
  misc_feature 1..432: note = derived and/or modified sequence opt3 from anti-HIV_cap256-119-111862_VR-Chain
  source 1..432: mol_type = other RNA
caggtgcaactggtcgagagcggcgggggagttgtgcagcccggtggctccctcaggctttcttgcgccgcttcagggttcacctacagtgactatggaatgcactgggtaaggcaggcacctggcaagggtctggaatgggtggccagcatctcctttgcggggacaaaacagcattacggaaactctgtcaagggccggttcactatttcgcgcgataattcaaagaacacggtgtatttgcaaatgaatagcttacgagttgaggacaccgctctgtactattgtgccaaagatatgcgtgaatacgagtgcgaagagtggacaagtgactattacgattttggcagaccacagccgtgtatagactccagaggggtggtcggaatcctagatatttggggtcagggcatcatggtgactgtatctagc

SEQ ID NO: 24763 - RNA, 432 nt, synthetic construct
  misc_feature 1..432: note = derived and/or modified sequence opt3 from anti-HIV_cap256-119-110064_VR-Chain
  source 1..432: mol_type = other RNA
ctgggcagactcgtggccagcgggggaggtgtcgttccccctggcaggtcccttcggctgtcttgcgtggcttcacagttcacctttagtgggtgtggattgcactgggtacgccaagcaccaggcaagggtttagagtgggtggccagcatctccttcgcggggacaaaacagcattacggaaactctgtcaagggccgatttactatttcgcgtgacaattcaaagaacacggtgtatctgcagatgaatagcctaagagttgaagataccgctctctactattgcgccaaagacatgagggagtacgaatgtgaggaatggacaagtgattattacgacttcggccggccgcagccctgcatagattcccgcggggtggtcggaatcctggacatttggggtcaaggcactatggtgaccgtatctttt

SEQ ID NO: 24764 - RNA, 432 nt, synthetic construct
  misc_feature 1..432: note = derived and/or modified sequence opt3 from anti-HIV_cap256-119-109192_VR-Chain
  source 1..432: mol_type = other RNA
caggtgcaactggtcgagagcggcgggggagttgtgcagcccggtagatccctcaggctttcttgcgccgcttcaggcttcacctttagtaactacgcaatgcactgggtacggcaggcccctgggaagggactggaatgggtggcggtcatcgcttatgacggcgataataagtactatgccgacagcgtgaagggtcgcttcacaatttcccgagataactctaaaaatactttgtacttacagatgaactcgctgcgtgcagaggacacggccctatattactgtgctaaggatctcagagaagacgagtgcgaagagtggtggtcagattattacgacctggggaaacaacttccatgtaggaaaagccggggagttgcaggcgtgctggataagtggggcttggggaccatggtcacagtgagttcc

SEQ ID NO: 24765 - RNA, 435 nt, synthetic construct
  misc_feature 1..435: note = derived and/or modified sequence opt3 from anti-HIV_cap256-119-108793_VR-Chain
  source 1..435: mol_type = other RNA
cagttccaactggtggagagcggcgggggagtcgttcagcccggtagatccctcaggctttcttgcgccgcttcaggctttaccttcagtagctaccctatgcactgggtgcggcaggcaccagggaagggactggaatgggtagccttgatctcctatgacggcacagataaatactatgcggactctgtgaagggtcgctttactatttcgcgagataacagcaaaaatacgttatacctgcagatgaactcactacgtgtcgaggacaccgctgtgtatcattgtgccaaggatctcgggggaagtaaatccgacgaatgggcaacagattactattacgactggtctaaggcctacccggttcacgatcccagagctgtggtcggcgtgttcgacatatggggccaagggactctggtaaccgttagctcc

SEQ ID NO: 24766 - RNA, 432 nt, synthetic construct
  misc_feature 1..432: note = derived and/or modified sequence opt3 from anti-HIV_cap256-119-108127_VR-Chain
  source 1..432: mol_type = other RNA
caggtgcaactggtcgagagcggcgggggagttgtgcagcccggtagatccctcaggatctcttgcgccgcttcacagttcacctttaatcggtacggcatgcactgggtacgccaggcacctgggaagggacttgaatgggtggccagtattagctatgacggctccgataaataccatgcgggtctggtctgggggcgattcataatctctcgtgacaattcgaagaacacattgtatttacaaatgaactcactgagagctgaggatactgccctatactattgtgtgagggaccggcgcgaaagcgagtgcgaagagagatggagtgattactatgactttggaaaacagctcccatgtgttaagccgaggggcgtggcaggcattttcgatatctgggggcagggaacgatggtcaccgtgtcctct

SEQ ID NO: 24767 - RNA, 438 nt, synthetic construct
  misc_feature 1..438: note = derived and/or modified sequence opt3 from anti-HIV_cap256-119-107758_VR-Chain
  source 1..438: mol_type = other RNA
gaggtgcagctggtcgaaagcggcgggggactcgttaagcccggtggctcccttagactgtcttgcgccgcttcagggttcacctttagtaacgcatggatgagctgggtgaggcaagcccctggaaaaggcttggagtgggtagcgtccatctctaatgacggtacaaagaaataccacgaagagtcggtgtgggggcggttcactatttcaaaggataacagcaaaaatacgttatttctgcagatgaacagtctacgcatagaagacaccgctctctatttctgtgtcaaggatcagcgagaggacgagtgcgaagagtggtggtccgattactatgactttggacgtgaactgccatgtagaaagtctaggggccttggcctggccgggatcttcgatatgtggggacatggtacaatggtgactgttagctcc

SEQ ID NO: 24768 - RNA, 432 nt, synthetic construct
  misc_feature 1..432: note = derived and/or modified sequence opt3 from anti-HIV_cap256-119-107209_VR-Chain
  source 1..432: mol_type = other RNA
gaggtgcagctggtcgaaagcggcgggggactcgttcaacccggtagatcccttaggctgtcttgcaccgcctcaggcttcacatttggggactacggaatgcactgggtgcggcaggctcctggcaagggtttggagtgggtagcagccatcagtttcgatggggcggacaaatatcatgctgataacgtgtggggacgcttaagcatttcccgagacaattctaagtcgactctgtacctacagatgaactcactccgtccagaagatacggccgtctatttttgtgcaaaagacctgagagaggatgaatgcgaggagaggtggagcgactactatgatttcggcaagcagcttccgtgtcggaaaagtcgcggcgtggccgggatatttgacaattggggacaaggtaccatggttacagtgtccgct

SEQ ID NO: 24769 - RNA, 432 nt, synthetic construct
  misc_feature 1..432: note = derived and/or modified sequence opt3 from anti-HIV_cap256-119-107184_VR-Chain
  source 1..432: mol_type = other RNA
caggcccaactggtggagagcggcgggggagtcgttcagcccggtagatccctcggcctttcttgcgctgcatcaaagttcagtctgagctcctacgggatgcactgggtgaggcaggcccctggacggggcttggaatgggtagcgggtatctcttttgctgggaccaaaaagtattacgccgactcggtgcgcggacgattctcagtcagcacagatattagtaaaaatactttatatctgcagatgaactccctacgtccagcagacacggccctctacttttgtgctagagatctgaggtattacgagtgcgaagagtgggcatctgactattacgatttcggcaaggaacaaccgtgtcttgacccccggggcgtggttgggatatttgatctgtggggacagggtaccatggtgacagtcagctcc

SEQ ID NO: 24770 - RNA, 438 nt, synthetic construct
  misc_feature 1..438: note = derived and/or modified sequence opt3 from anti-HIV_cap256-119-106827_VR-Chain
  source 1..438: mol_type = other RNA
gccgtgcagctggtcgagagcggcgggggactcgttcaacccggtggctcccttagactgtcttgctcagtgagtcagttcacctttgggaggtacggaatgtattgggtacggcaggctcctggcaagggtttggaatgggtggcagtcatcagctacgacgggggaaaccgctattacgccgattccgtgaaaaatcgattctctatttcgcgtgacaactcaaagaatacattatttctgcagatgagcagtctaagagcggaggatactgctctctatttctgtgttagggaccaccgggaagatgagtgcgaagagtggtggtccgactactatgattttggccgcgagctgccatgtagaaaattcaggggccttgggctggccggaatatttgacatctggggtcatggcacgatggtgaccgtctctagc

SEQ ID NO: 24771 - RNA, 432 nt, synthetic construct
  misc_feature 1..432: note = derived and/or modified sequence opt3 from anti-HIV_cap256-119-106511_VR-Chain
  source 1..432: mol_type = other RNA
caggtgcaactggtcgagagcggcgggggagttgtgcagcccggtagatccctcaggctttcttgcgtagcctcacagttcagttttgaccggtacggcatgcactgggtgcgccaggctcctgggaagggactggaatgggtcgcaagcatctccttcgatggcaccgacaaatatcatgccgataaggtgtggggtcgatttacaatttctcgtgacaactcgaaaaatactttgtacttacaaatgaactcactgagaccagaggatacggcgctatattactgtgctaaggacatgagggaagatgagtgcgaagcctggtggagcgactattacgatctcgggaaacagctgccgtgtcgggagagtcgcggagttgcaggcatattcgacgagtggggccaggggaccatggtgacagtctcctct

SEQ ID NO: 24772 - RNA, 432 nt, synthetic construct
  misc_feature 1..432: note = derived and/or modified sequence opt3 from anti-HIV_cap256-119-106327_VR-Chain
  source 1..432: mol_type = other RNA
caggtgcaactggtcgagagcggcgggggagttgtgcagcccggtcggtccctcaggctttcttgcgccgcttcaggcttcacctttagtagctacgcaatgcactgggtacggcaggcccctgggaagggactggaatgggtggcggctatctccggcggtgggggaaacacatatgtcgccgactctgtgaaaggccgcttcactatttcgcgagataattcaaagaacacggtttacttgcagatgaatagcttacgtctggaggacaccgcactatattactgtgccaaagatctcagagaatatgagtgcgaagagtggacaagtgactactatgattttggcaggccacaaccgtgtatagactccagaggggtggtcggaatcctggatatttggggtcagggcactatggtgaccgtatctagc

SEQ ID NO: 24773 - RNA, 438 nt, synthetic construct
  misc_feature 1..438: note = derived and/or modified sequence opt3 from anti-HIV_cap256-119-105486_VR-Chain
  source 1..438: mol_type = other RNA
caggtgcaactggtcgagagcggcgggggagttgtgcagcccggtggctccctcagactttcttgcgccgcttcagggttcaccgtaagtggatacggcatgcactgggtgaggcaggcccctgcaaagggtctggactgggtcgcgtttatcagccatgatgggtccaacaaatattacgctgactctgtgcggggacgcttcattatatcgcgagataattcaaacaatacattgtatgttcagatgagcagtttacgtgccgaagacactgcactgtacttttgtgtgagagatcacagggaggacgaatgcgaggaatggtggtccgattattacgacttcggccgggagctaccatgtcgcaagtttagaggcctcgggctggccggaatcttcgatatttggggtcatggcacgatggtcaccgtgtctagc

SEQ ID NO: 24774 - RNA, 432 nt, synthetic construct
  misc_feature 1..432: note = derived and/or modified sequence opt3 from anti-HIV_cap256-119-105197_VR-Chain
  source 1..432: mol_type = other RNA
caggtgcaactggtcgagagcggcgggggagttgtgcagcccggtagatccctcaggctttcttgcgccgtatcacagttcacctttggccggtacgggatgcactgggtgcgccaggctcctggaaagggcctggaatgggtcggtagtatcagctatgacgggtccgataaataccatacaaactctttgtggggacgattcattgtgtcgcgtgacaattcaaagaacactttatatctgcaaatgaataacctaagaccagaggatacggcactctactattgtgttagggaccggcgcgaaagcgagtgcgaagagagatggagtgattactatgactttggcaaacagctgccgtgtgtgaagcccaggggcgtcgtgggggtacttgatatatggggacagggtaccctggttacagtgtcctct

SEQ ID NO: 24775 - RNA, 432 nt, synthetic construct
  misc_feature 1..432: note = derived and/or modified sequence opt3 from anti-HIV_cap256-119-104946_VR-Chain
  source 1..432: mol_type = other RNA
caggagcaactggtggaaagcggcgggggagtcgttcagcccggtagatccctcaggctttcttgcgtggcctcacggttcacctttagtgctttcggcatgcactgggtacgccaggcacctgggaagggactggagtgggtggccagcatctcctttgcgggcattaaaaagtactatggtgactctgtcaaagggcgattcacaatatcgcgtgataactcaaagaatactttgtacttacagatggacggactgagaggcgaagatacggctctatattactgtgccaaagacctcagggagctggaatgcgaggagtgggcaagcgattattacgactttggccggccacaaccgtgtatcgatagtcgcggggtggttggtattcttgacatctggggacagggcattatggtgaccgtctcctct

SEQ ID NO: 24776 - RNA, 432 nt, synthetic construct
  misc_feature 1..432: note = derived and/or modified sequence opt3 from anti-HIV_cap256-119-103667_VR-Chain
  source 1..432: mol_type = other RNA
caggtgcacctggtcgagagcggcgggggagttgtgcaacccggtaagtccctcagactttcttgcgccgcttcacagttcacctttaataggttcggcatgcattgggtacggcaggcacctgggaaaggactggaatgggtggccggcatcagttacgacggtagcgataagtatcacgcggacaaagtctgggggcgctttacaatttcccgagataattctaagaacactttgtacttacagatgaactcgctgcgtgctgaggacacggccctatattactgtgcaaaagatctcagagaagacgagtgcgaagagtgggcctcagattattacgacttcggaaaggagcaaccatgtctggatccgaggggcgtggttggcatatttgacatctgggggcagggaaccatggtgacagtcagcagt

SEQ ID NO: 24777 - RNA, 438 nt, synthetic construct
  misc_feature 1..438: note = derived and/or modified sequence opt3 from anti-HIV_cap256-119-103385_VR-Chain
  source 1..438: mol_type = other RNA
gaggtgcagctggtcgaaagcggcgggggactcgttcaaaccggtggctcccttagactgtcttgcgccgcttcagggttcacatttagtaggtacgacatgaactgggtgcggcaggcacccggaaagggcttggagtgggtagccagcatctccaatgatggttctaaaaagtatcacggggactcggtgtgggcgcgcttcactatttcacgagataacagcaaaaatacgttatttctgcagatgagttccctacgtgtcgaagacaccgctctctacttctgtgtgagagatcagagggaggacgaatgcgaggagtggtggtctgattattacgactttggacgggaactgccttgtcgcaagttcagaggccttggcctggccgggatatttgatatctggggacatggtacaatggttactgtgagctcc

SEQ ID NO: 24778 - RNA, 438 nt, synthetic construct
  misc_feature 1..438: note = derived and/or modified sequence opt3 from anti-HIV_cap256-119-103267_VR-Chain
  source 1..438: mol_type = other RNA
gaggtgcccagcgtcgaatccggcgggggactggttcagaccggtggctctctcacactttcatgcgccgctagtcaattcacttttagcaactacgggatgcactgggtgagacaggcacctggaaagggcctggagtgggtagcctccatctctaatgacggttcgaaaaagtatcatggggattcagtgtgggcgaggttcattataagccgggacaacagtaaaaatacgttgtttttacagatgtcctctctgcgcgctgaagataccgccctatacttctgtgtccgagaccaccgtgaggatgaatgcgaggagtggtggagcgactattacgattttggaagagaactcccatgtaggaagttccggggcctgggccttgcagggatctttgacatttggggacatggtacaatggtgactgtttcctca

SEQ ID NO: 24779 - RNA, 432 nt, synthetic construct
  misc_feature 1..432: note = derived and/or modified sequence opt3 from anti-HIV_cap256-119-103011_VR-Chain
  source 1..432: mol_type = other RNA
caggtgcaactggtcgagagcggcgggggagttgtgcagcccggtggctccctcagactttcttgcgccacctcagggttcacatttggaactttcggcatgcactgggtaaggcaggctcctggtaaggggctggactgggtggcagccatcagttttgcgggaacgaaaaagaactacgctgatagcgtccggggccgcttcaccatttcccgagactcttcgaaaaatacattgtatttacagatgaactcactgcgtccagaagatactgccctatactattgtgtgaaggacatgagaggctacgagtgcgaagagtggaccagcgattattacgactttgggaggccgcaaccctgtatagatagtcggggagttgtgggtacattcgacgtctggggccaggggaccatggtgactgtatcctct

SEQ ID NO: 24780 - RNA, 438 nt, synthetic construct
  misc_feature 1..438: note = derived and/or modified sequence opt3 from anti-HIV_cap256-119-102072_VR-Chain
  source 1..438: mol_type = other RNA
gaggtgcagctggtcgaaagcggcgggggactcgttcaacccggtggctcccttagagtgtcttgcgccgtatcagggttcacctttagtaactacgagatgaattgggtgaggcaggctcctggaaagggcctggaatgggtcgcaagcatctccaacgacggtactaaaaagtatcacgccgagtctgtgtgggatcggttctcgatttcaaaagacaatagcaagaacacattgtttttacagatgaatagtctgcgcgttgaagatacggcgctatacttctgtgtgaaagaccagcgagaggatgagtgcgaagagtggtggtccgactattacgattttgggcgtgaactcccatgtagaaagtctaggggactgggccttgctggcatattcgacatctgggggcatggaaccatggtcacagtgagctcc

SEQ ID NO: 24781 - RNA, 438 nt, synthetic construct
  misc_feature 1..438: note = derived and/or modified sequence opt3 from anti-HIV_cap256-119-101945_VR-Chain
  source 1..438: mol_type = other RNA
gaggtgcagctggtcgaaagcggcgggggactcgttcaacccggtggctcccttagactgtcttgcgccgcttcagggttcacctttagtagctacgtgatgcactgggtaaggcaggcacctggaaagggcttggagtgggtggcctccatctctaacgacggtactaaaaagtatcatgaagagtcggtctgggggcggttcacaatttcaaaagataatagcaagaacacgttatttctgcagatgaatagtctacgcatagaagacaccgcgctctacttctgtgtgaaagatcagcgagaggacgagtgcgaagagtggtggtccgattattacgactttggacgtgaactgccatgtagaaagtctaggggccttggcctggctgggatcttcgatatgtggggacacggtacaatggttactgtgagctcc

SEQ ID NO: 24782 - RNA, 432 nt, synthetic construct
  misc_feature 1..432: note = derived and/or modified sequence opt3 from anti-HIV_cap256-119-101319_VR-Chain
  source 1..432: mol_type = other RNA
caggtgcaactggtcgagagcggcgggggagttgtgcagcccggtaagtccctcagactttcttgcgtaggctcagggttcacctttgacgattacggaatgcactgggtgaggcaggcccctggcaaaggtctggaatgggtcgctagtatcagctatgacgggcgggatttctaccatgcacgctccgtgtggggacgatttacaatttctcgtgacaactcgaagaatactttgcacttacagatgaactcactgagaccagaggatacggccctatatttctgtgcgagggacctccgggaaagcgagtgcgaagagtgggagagttactattacgattttggcaaaaagggcccgtgtgttaaaccccgcggggtggtcggagtgctggacatatggggtcaaggcacccttgtaacagtttcctct

SEQ ID NO: 24783 - RNA, 432 nt, synthetic construct
  misc_feature 1..432: note = derived and/or modified sequence opt3 from anti-HIV_cap256-119-100871_VR-Chain
  source 1..432: mol_type = other RNA
caggtgcaactggtcgagagcggcgggggagttgtgcagcccggtgaatccctcagaatctcttgcgccgcttcacagttcacctttagtaggtacggcatgcactgggtacggcaggcacctgggaagggacttgagtgggtggccagcatttccttcgacggccgcgataaatatcattcttcgctggtctggggtcgattgacaatatcacgtgacaatagcaagagtactttatttctgcaaatgaactccctaagagcggaagatacggctctctactattgtgccagggacctgcgggagtctgaatgcgaggagtgggaaagcgattactatgacttcgggaaaccacagccgtgtgaggatccccgcggagtggttggcacctttgacatgtggggccttgggacactggtgactgtctcctca

SEQ ID NO: 24784 - RNA, 432 nt, synthetic construct
  misc_feature 1..432: note = derived and/or modified sequence opt3 from anti-HIV_cap256-119-100838_VR-Chain
  source 1..432: mol_type = other RNA
gaggtgcagctggtcgaaagcggcgggggagttgtgcaacccggtggctccctcagactttcttgcgccgcttcagggttcacctttagtagctacggaatgcactgggtaaggcaggcacctggcaagggtctggagtgggtggccttcatccggtatgacgggtccaacaaatactatgcggattctgtcaagggacgctttacaatttcgcgagacaattcaaaccatactttgtacatgcagttagatagcctgcgtgctgaagacacggccctatattactgtgcaaaagatctcagagagtatgaatgcgaggagtggaccagtgactactacgatttcggcaggccacagccgtgtatagactcccggggcgtggttgggatcctggatatttggtctcaaggaacaatggtgactgtcagctcc

SEQ ID NO: 24785 - RNA, 438 nt, synthetic construct
  misc_feature 1..438: note = derived and/or modified sequence opt3 from anti-HIV_cap256-119-100025_VR-Chain
  source 1..438: mol_type = other RNA
caggtgcaactggtcgagagcggcgggggagttgtgcagcccggtagatccctcaggctttcttgcgccgcttcagtattcacctttagttactatggcatgcactgggtgcggcaggcacctgggaagggactggaatgggtcgccttcatcagccatgacggctccaacaaatactatgcggattctgtgcgcggtcgatttattatatcgcgtgacaattcaaacaatacattgtacgttcagatgaacagcttaagagctgaggatactgccctgtatttctgtgtgaaggaccaaagggaagatgagtgcgaagagtggtggagtgactactatgattttgggcgggagctaccatgtcgcaaattcagaggactcggcctggcaggcacgtttgacatctgggggcacggaaccatgcttattgtctcctct

SEQ ID NO: 24786 - RNA, 432 nt, synthetic construct
  misc_feature 1..432: note = derived and/or modified sequence opt3 from anti-HIV_cap256-119-100000_VR-Chain
  source 1..432: mol_type = other RNA
cagatgcaactggtggagagcggcgggggagtcgttcagcccggtagatccctcaccctttcttgcgccgcttcacagttcacatttagtaactacggcatgcactgggtgaggcaggcacctgggaagggactggaatgggtagccagcatctccaatgacggcaacaaaaagtatcatggtgattctgtgtgggcgcggttcactatttcgcgcgacaatagcaaaaacacgttgtttttacaaatgtcaagtctgcgaaccgaggatacagctctatacttctgtgtccgtgacagaagggaatccgagtgcgaggaacggtggtctgattattacgactttgggaagcagctcccatgtgtgaaaccgcgcggagttgccggcatattcgatatctggggccaggggactatggtgaccgtcagctcc

SEQ ID NO: 24787 - RNA, 432 nt, synthetic construct
  misc_feature 1..432: note = derived and/or modified sequence opt3 from anti-HIV_cap256-119-098890_VR-Chain
  source 1..432: mol_type = other RNA
caggtgcaactggtcgagagcggcgggggagttgtgcagcccggtgaatccctcagaatctcttgcgtagcctcacagttcacctttggcaggtacgggatgcactgggtgcggcaggctcctggaaagggccttgagtgggtcgcaagtattagcttcgacggtcgcgataaatatcattccccactggtgtgggggcgattgacaatatctcgtgacaactcgaagaatactttatttctgcaaatgaactcactaagaacggaagataccgccctctactattgtgcgagggacctgcgggagagcgaatgcgaggagtgggaaagtgattactatgctttctggcgcaaacttccgtgtgttaagcccagaggagtggccggcacactggacatctggggccaggggactatggtctccgtgtctagc

SEQ ID NO: 24788 - RNA, 435 nt, synthetic construct
  misc_feature 1..435: note = derived and/or modified sequence opt3 from anti-HIV_cap256-119-098715_VR-Chain
  source 1..435: mol_type = other RNA
caggtgcaactggtcgagagcggcgggggagttgtgcagcccggtagatccctcaggctttcttgcgccgcttcaggcttcagttttaacaatcacgggatgcattgggtacggcaggcacctggaaagggcctggaatgggtggccggtatcagcttcgcggggattaaaaagtactatggaacctccgtcaaaggccgctttacaatatctcgagacaactcgaagaataacttgttcttacagatgaactcactgcgtgtggaggatactgctctatactattgtgccagagacctcagggaaatggagtgcgaagagtggacgctgtacaattattacgattttggcagccgggggccatgtgttgacccgcgcggagtggtcggtagtttcgatgtgtggggccaagggaccatggtaacagtttcctct

SEQ ID NO: 24789 - RNA, 438 nt, synthetic construct
  misc_feature 1..438: note = derived and/or modified sequence opt3 from anti-HIV_cap256-119-098632_VR-Chain
  source 1..438: mol_type = other RNA
cagatgcaactggtggagagcggcgggggagtcgttcagcccggtagatccctcaccctttcttgcgccgcttcacagttcaattttgcaaattacgacatgcactgggtgaggcaggcccctggcaaggggctggaatgggtagcgttcatccggtatgatggaaacaataaatactatgctgacagtgtgaagggccgctttacaattagccgagataactccaaatctactttgttcttacaaatgaactcgctgcgtatagaggacacggccctatacttttgtgtcaaggatcagagagaagacgagtgcgaagagtggtggtcagattattacgacttcggtagggagctcccatgtcggaaaagccgcgggctgggacttgcaggcatctttgatatgtggggccatgggaccatggtgacagttagttcc

SEQ ID NO: 24790 - RNA, 432 nt, synthetic construct
  misc_feature 1..432: note = derived and/or modified sequence opt3 from anti-HIV_cap256-119-097199_VR-Chain
  source 1..432: mol_type = other RNA
caggtgcaactggtcgagagcggcgggggagttgtgcagcccggtagatccctcaggctttcttgcgccgcttcaggcttcgcatttagtagctacgccttccactgggtacggcaggcgcctgggaagggactggaatgggtggcttatatcccatttcatggcaaccagcaatactatggtgactccgtcaaagggcgcttcaccatttctcgagataattcgcgtgacacattgtttttagagatgaactcactgagaccggaagatactgccctatacttctgtgcaagggaccagcggtattacgagtgcgaagagtgggccagcgattattacgactttggacgcgagcagccctgtctcgatcctagaggcgtggttggcatattcgacctgtgggggcagggaacgatggtgaccgtcagttcc

SEQ ID NO: 24791 - RNA, 432 nt, synthetic construct
  misc_feature 1..432: note = derived and/or modified sequence opt3 from anti-HIV_cap256-119-096189_VR-Chain
  source 1..432: mol_type = other RNA
caggtgcaactggtcgagagcggcgggggagttgtgcagcccggtagatccctcaggctttcttgcgccgcttcaggcttcaagtttgggagtttcggaatgcactgggtacggcaggcacctggcaaaggtctggaatgggtggccgtcatcagctacgacgggtccgataagtattacggatcttcggtgcgcggccgattttcaattagccgtgacaacagtaaaaataccttgtatttacagatgaactccctgagaacagaggatactgcgctatacttctgtgctaaggacctcagggaatatgagtgcgaagagtggacgtctgattactatgactttggccggccacaaccgtgtatagatagccgcggggttgtgggaatcctggacatttggggtcagggcaccatggtcacagtgtcctca

SEQ ID NO: 24792 - RNA, 432 nt, synthetic construct
  misc_feature 1..432: note = derived and/or modified sequence opt3 from anti-HIV_cap256-119-094581_VR-Chain
  source 1..432: mol_type = other RNA
caggtgcacctggtcgagagcggcgggggagttgtgcaacccggtagatccctcaggctttcttgcgccgcttcaggcttcaactttagtaattacgcaatccattgggtacggcagacccctgggaagggactggaatgggtgacattgattagcaacgacggctccaataaatattacgccgattctttaaagggtcgcttcactatatcgcgagacaacagcaaaaatacgctgtatctacagatgaactcactccgtgcggaggataccgctctgtactattgtgccaaggaccttagagaagatgagtgcgaagagtggtggagtgactactatgattttgggaaacagctgccatgtaggaagtcccggggagtcgcaggcatcttcgacggctgggggcaaggaacaatggtgactgtttctagc

SEQ ID NO: 24793 - RNA, 432 nt, synthetic construct
  misc_feature 1..432: note = derived and/or modified sequence opt3 from anti-HIV_cap256-119-094200_VR-Chain
  source 1..432: mol_type = other RNA
gaggtgcagctggtcgaaagcggcgggggactcgttcaacccggtggctcccttagactgtcttgcgccgcttcagggttcatctttagtagctacgcattgcactgggtgaggcaggcccctggaaagggcttagagtgggtagcgtccatttctttcgctggtaccaaaaaccattatggaaattcggtgaaggggcggtttacaatatcacgcgacaacagcaaaaatactgtctacctgcagatgaacagtctacgagccgaagatacggcactctattactgtgccaaggacctgcgtgagtatgaatgcgaggagtggacctccgattactatgacttcggcagaccacagccgtgtatcgattctaggggcgtggttgggattcttgacatctggagccaaggaacaatggtgactgtctcctca

SEQ ID NO: 24794 - RNA, 432 nt, synthetic construct
  misc_feature 1..432: note = derived and/or modified sequence opt3 from anti-HIV_cap256-119-094158_VR-Chain
  source 1..432: mol_type = other RNA
cagatgcaactggtggagagcggcgggggagtcgttcagcccggttcctctctcaccctttcatgcgccgctagtcagttcacatttagcaactacggcatgcactgggtgagacaggcacctgggaagggactggaatgggtagcctccatctctaatgacggcactaaaaagtatcatggtgattcggtgtgggacaggttcacgatttcacgggataacagcaaaaataccttgtttttacaaatgaacagtctgcgcgcggaggacacagctctatacttctgtgtcaaggatcagcgagaagacgagtgcgaagagtggtggtccgattattacgactttgggaaacagctcccatgtcgtaagtctagaggagtggccggcatattcgatagctggggccaggggactatggttaccgtgtcctca

SEQ ID NO: 24795 - RNA, 432 nt, synthetic construct
  misc_feature 1..432: note = derived and/or modified sequence opt3 from anti-HIV_cap256-119-092814_VR-Chain
  source 1..432: mol_type = other RNA
caggtgcaactggtcgagttcggcgggggagttgtgcagcccggtggcagcctcagactttcctgcgccgcttctgggttttacttcaccgactatggaatgcactgggtaaggcaggcacctggcgaaggtctgcagtgggtggcctttatctcatacgatgggaatacaaagactacggcggacagtgtccggggacgcttcaccttgagccgagataattccaaaaacacattatatctgcaaatgaactctgtgcgtgttgaggacactgctagatacttttgtgccagggatatgcgggaatatgagtgcgaactatgggcatcggactactatgatttcggcaagccacagccgtgtgaggacccccgcggcgtggtcgggacctttgatatgtggggactcggtacactggtgaccgtatcaagc

SEQ ID NO: 24796 - RNA, 432 nt, synthetic construct
  misc_feature 1..432: note = derived and/or modified sequence opt3 from anti-HIV_cap256-119-092808_VR-Chain
  source 1..432: mol_type = other RNA
caggtgcaactggtcgagagcggcgggggagttgtgcagcccggtagatccctcaggctttcttgcgccgcttcacagttcagttttggcaactacgggatgcactgggtacggcaggcacctggaaagggcctggaatgggtggccgcgatcagcttcgctggtaccaaaacaaattatgccgactccgtcaaggggcgctttactatttctcgagataactcgaaaaatacggtgtacttgcaaatgaactcattacgtgcagaggacaccgccctgtatttctgtgctaaggatataagagaatacgagtgcgaatattggacaagcgactactatgattttggaaggccacagccgtgtatcgacagtcggggcgttgtgggcactttcgatgtctgggggcagggaaccatggtgacagtatcctct

SEQ ID NO: 24797 - RNA, 432 nt, synthetic construct
  misc_feature 1..432: note = derived and/or modified sequence opt3 from anti-HIV_cap256-119-092573_VR-Chain
  source 1..432: mol_type = other RNA
caggagcaactggtggaaagcggcgggggagtcgttcagcccggtacctccctcagactttcttgctcagccagtggcttcacatttagcaacttcgctatgaattgggtgaggcaggcacctgggaagggactggagtgggtatcctttatctcttcggacggcaaaaacaagaattacgtggattcagtcaaaggtcggttcactattagccgcgacaactataagaatacgttgtacttacagatgaacagtctgcgaaccgaagatacagccgtgtattactgtgcgaaagacctagggggaactaaggatgacgagtgggctaccgattattacgactggtccacagcctatccagttcaagatccgcgtgcagtggccggcggctttgacctctgggggctgggaaccatggtcactgtgtctagc

SEQ ID NO: 24798 - RNA, 432 nt, synthetic construct
  misc_feature 1..432: note = derived and/or modified sequence opt3 from anti-HIV_cap256-119-090815_VR-Chain
  source 1..432: mol_type = other RNA
caggtgcaactggtcgagagcggcgggggagttgtggaacccggtagatccctcaggctttcttgcgccgcttcacagttcagttttagctcctacggcatgcactgggtacggcaggcacctgggaagggactggagtgggtggccgcgatctctttcgacggcgctgataaatatcatgccgacaacgtctggggtcgcttgtcgatttcacgagataatagcaagagtaccttatacctgcagatgaactccctacgtccagaagacacagcagtgtatttttgtgccaaagatctcagagaggacgaatgcgaggagaggtggtctgattactatgacttcgggaagcaactgccgtgtcggaaaagccgcggagttgctggcatatttgataattggggccaggggactatggtgacggtctccgca

SEQ ID NO: 24799 - RNA, 438 nt, synthetic construct
  misc_feature 1..438: note = derived and/or modified sequence opt3 from anti-HIV_cap256-119-090368_VR-Chain
  source 1..438: mol_type = other RNA
caggtgcaactggtcgagagcggcgggggagttgtgcagcccggtagatccctcaggctttcttgcgccgcttcaggcttcgcatttagtcactacgggatcttctgggtacggcaggcccctggaaagggcctggaatgggtggcgagcatttccaacgacggtaccaaaaagtatcatgctgagtctgtctgggatcgcttttcgatatcaaaagacaatagcaagaacacattgttcttacagatgaatagtctgcgagtggaagatactgccctatacttttgtgttaaagaccaacgtgaggatgaatgcgaggagtggtggtccgactattacgatttcgggagagaactcccatgtaggaagtctcggggactgggccttgcaggcatctttgacatgtgggggcacggaacgatggtgaccgtcagctcc

SEQ ID NO: 24800 - RNA, 432 nt, synthetic construct
  misc_feature 1..432: note = derived and/or modified sequence opt3 from anti-HIV_cap256-119-089710_VR-Chain
  source 1..432: mol_type = other RNA
caggtgcaactggtcgagagcggcgggggagttgtgcagcccggtagatccctcaggctttcttgcaccgcctcaggcttcgggtttagtaactacgctatgcactgggtacggctggcacctggaaagggcttggaatgggtggccagcatctcctatgacggtcgcgattaccatcacgcgggggctgtctggggacgattcattatatctcgtgacaattcgaaaaactcattacatctgcagatgaatagcctaagaccagaggatacagccctctatttttgtgcaagggacctgcgggaaagtgagtgcgaagagtgggagtccgattactataacttctggaagaaacttccgtgtgtgaagccccgcggcgttgtgggcatcctggacatttgggggcagggaactgtcgtgacggtatctagc

SEQ ID NO: 24801 - RNA, 432 nt, synthetic construct
  misc_feature 1..432: note = derived and/or modified sequence opt3 from anti-HIV_cap256-119-088555_VR-Chain
  source 1..432: mol_type = other RNA
caggtgcaactggtcgagagcggcgggggagttgtgcaggccggtagatccctcaggctttcttgcgctgcatcacagttcacctttagtcggtacggcatgcactgggtacgccaggcccccgggaagggactggaatgggtggcgggcatcagctatgacggtcgagataaataccatgctcacttcgtctgggggcgttttattatatccagagacaactctaagaatacattgtatttacaaatgaactcgctgagggccgaggatactgcactatactattgtgtgcgggacctccgcgaatcagagtgcgaactgtgggagagcgattactatgacttcggaaaaagacttccttgtgttaagccaaggggcgtggccggcacgtttgatctgtgggggcagggaaccatggtcacagtgagttcc

SEQ ID NO: 24802 - RNA, 432 nt, synthetic construct
  misc_feature 1..432: note = derived and/or modified sequence opt3 from anti-HIV_cap256-119-087962_VR-Chain
  source 1..432: mol_type = other RNA
gagatgcagctggtggaaagcggcgggggactcgtcaagcccggtagatcccttaggctgtcttgcgccgcttcaggcttcacctttagtagctacgcaatccactgggttcggcaagcccctgggaaaggattggagtgggtggcggtaatttcctatgacggctctaacaagtactatgctgattcggtgaaaggtcgcttcacaatatcacgagacaatagcaagaacactgtctacttacagatgaatagtctgcgtgtggaagatacggccctatattactgtgcaaaagacctcagagagtatgaatgcgaggagtggacctccgattactacgactttgggaagccacagccgtgtatcgattctaggggagttgtgggcattctggacatctggggccaggggattatggtcacagtgagctcc

SEQ ID NO: 24803 - RNA, 432 nt, synthetic construct
  misc_feature 1..432: note = derived and/or modified sequence opt3 from anti-HIV_cap256-119-086903_VR-Chain
  source 1..432: mol_type = other RNA
caggtgcacctggtcgagagcggcgggggagttgtgcaacccggtaagtccctcagactttcttgcgccgcttcacagttcacctttgacaggtacggcatgcattgggtacggcaggcacctgggaaaggactggaatgggtggccagtatcagcaacgatggcacagacaagtatcacgcggataatgtctggggtcgcttcactatttcccgagacaactctaaaaatacgttgtacttagagatgaactcgctgcgtggggaagataccgctctatattactgtgccaaggacatgagagaggatgaatgcgaggagtggtggtcagactattacgattttggaaggccacagccgtgtatagacagccggggcgtggttggcacattccatgtgtgggggcaaggaactatggtcaccgtgagttcc

SEQ ID NO: 24804 - RNA, 432 nt, synthetic construct
  misc_feature 1..432: note = derived and/or modified sequence opt3 from anti-HIV_cap256-119-086804_VR-Chain
  source 1..432: mol_type = other RNA
gaggtgcagctggtcgaaagcggcgggggagttgtgcaacccggtagatccctcaggcttttctgcgccggctctgggtttaccttctcaagttacggactgcactgggtacggcaggctcctggcaagggtttggagtgggtgagctttatctcctatgacgggtctacaactaaatacgcagattcgttaaagggacgcttcacggtctcacgagacaacagcaaaaataccgtgtatctggaaatgaacagtctacgtgccgaggatacagcgctctactattgtgctaaggacctgagagaatacgagtgcgaggaatggacttccgattattacgactttggcaggccacagccgtgtattgattctcggggcgttgtggggatacttgacatctggggacagggtaccatggtcacagtgagctcc

SEQ ID NO: 24805 - RNA, 432 nt, synthetic construct
  misc_feature 1..432: note = derived and/or modified sequence opt3 from anti-HIV_cap256-119-085910_VR-Chain
  source 1..432: mol_type = other RNA
gaggtgcagctgctcgaaagcggcgggggacttgtccaacccggtggctccctgagattgtcttgcgccgcttcagggttcacctttagtagctacggaatgcactgggttaggcaggcagccggcaagggtttagagtgggtggcgtccatctcttatgacgggcgggattaccatcacgctggagccgtatggggccgcttcattatatcgcgagacaacagcaaaaattcactgcatctacagatgaacagtctccgtcctgaagatacagcactgtatttttgtgccagagaccttagggagtccgaatgcgaggagtgggaatctgattactataatttctggaagaaactgccatgtgtgaagccgcggggcgtcgtggggatcttggacatttggggacagggtactgttgtgacggtcagctcc

SEQ ID NO: 24806 - RNA, 432 nt, synthetic construct
  misc_feature 1..432: note = derived and/or modified sequence opt3 from anti-HIV_cap256-119-085772_VR-Chain
  source 1..432: mol_type = other RNA
gaggtgagactggtcgaaagcggcgggggactcatccagcccggtggctcccttaggctgtcttgcgccgcttcagggttgaccgttagtagcaatcacatgtcctgggtgcggcaagcacctggaaagggcttagagtgggtagccgtgatttcttacgacggttcgaatacattctatggggattcagtcaaaggacgctttactgtgagccgagacataagtaagaacacgctgtacctacagatgaactccctccgtccagaagataccgcgatgtattactgtgctagagaccagaggtattacgagtgcgaagagtgggcctctgattattacgacttcggccgggagcagccgtgtcaagatccccgcggcgttgtgggggtctttgacatgtggggacagggtacaatggtgactgtaagctcc

SEQ ID NO: 24807 - RNA, 432 nt, synthetic construct
  misc_feature 1..432: note = derived and/or modified sequence opt3 from anti-HIV_cap256-119-084603_VR-Chain
  source 1..432: mol_type = other RNA
caggtgcaactggtcgagagcggcgggggagttgtgcagtccggtagatctctcaggctttcatgcgccgctagtggcttcccctttagcgacttcgcaatgcactgggtacggcaggcccctgggaagggactggaatgggtggcgtccatctcttttgtcggcattaaaacccattacgctaactcggtgcgcggtcgattcacaatatcacgtgatcagagcaagaatactttgtatttacaaatgaacagtgttagagtggaggacacggggaggtactattgtgcccgggatatgcgcgaatacgagtgcgaactgtgggcatccgactattacgattttggaaaaccacagccgtgtgaggaccccagaggcgtcgtgggcaccttcgatatgtgggggctaggaacactcgtaactgtttctagc

SEQ ID NO: 24808 - RNA, 432 nt, synthetic construct
  misc_feature 1..432: note = derived and/or modified sequence opt3 from anti-HIV_cap256-119-084276_VR-Chain
  source 1..432: mol_type = other RNA
caggtgcaactggtcgagagcggcgggggagttgtgcagcccggtagatccctcaggctttcttgcgccgcttcacggttcacctttagtagctacgcaatgcactgggtacgccaggcccctggcaaggggctggaatgggtggcggtcatctggtatgacggatccaacaaatactatgctgattctgtgcgaggccgtttctcggtttcaacagacattagcaagaatactttgtacttacagatgaacagtctgagaccagccgatacggcactatatttttgtgccagggacctccggtactatgagtgcgaagagtgggcttccgattactacgacttcggtaaagaacaaccgtgtctggatccccgcggggtggtcggaatatttgacctttggggccagggcaccatggtgacagtatctagc

SEQ ID NO: 24809 - RNA, 432 nt, synthetic construct
  misc_feature 1..432: note = derived and/or modified sequence opt3 from anti-HIV_cap256-119-082288_VR-Chain
  source 1..432: mol_type = other RNA
caggtgtacctggtcgagagcggcgggggagttgtgcaacccggtagatccctcaggctttcttcagccgctagtcacttcagcctgtcctcttatggcatgcattgggtacggcaggcacctgggaagggattggaatgggtggccggcatctcgtttgcgggtaccaaaacatactatggggactcagtcaagggacgcttcactgtgagcacggatattagtaaaaacaccttatacctgcaggttaattccctacgaccagaggacacagctatgtattactgcgcccgtgatcagagatattacgaatgtgaggaatgggcatctgactactatgattttggcaaggagcaaccgtgcctcgaccccaggggcgtggtcgggatattcgatatctggggacagggtactatggtgaccgtaagctcc

SEQ ID NO: 24810 - RNA, 432 nt, synthetic construct
  misc_feature 1..432: note = derived and/or modified sequence opt3 from anti-HIV_cap256-119-080383_VR-Chain
  source 1..432: mol_type = other RNA
caggtgcaactggtcgagagcggcgggggagttgtgcagcccggtagatccctcaggatctcttgcgccgcttcacagttcacctttagtcggtacggcatgcactgggtacgccaggcacctgggaagggacttgaatgggtggccagcatttcctatgacggcacagataaataccatgcgcgactggtctggggtcgtttcactatatctagagacaactcgaagaatacgttgtatttacaaatgaactcactgagggctgaggataccgccctatactattgtgtgcgggacgaacgcgagagcgaatgcgagctctgggagagtgattactatgactttgggaaaaagctgccatgtgttaaaccgagaggagtgacaggctcccttgatatgtggggccaggggactcaggtcaccgtgtctagc

SEQ ID NO: 24811 - RNA, 438 nt, synthetic construct
  misc_feature 1..438: note = derived and/or modified sequence opt3 from anti-HIV_cap256-119-079333_VR-Chain
  source 1..438: mol_type = other RNA
gaggtgcagctggtcgaaagcggcgggagactcgttcaacccggatcccctcttaggctgtcttgcgccgcttcacagttcaactttgcaagttacggtatgcactgggtgcggcaggccccaggcaaggggttggagtgggtagcgagcatctccaatgacggaaccaaaaagtatcatgctgaatctgtgtgggatcgcttctcgatttcaaaagacaacagcaagaatacattatttctgcagatgaacagtctacgagtcgaggatactgccctctacttctgtgtgaaagaccaacgtgaagatgagtgcgaggaatggtggtccgactattacgattttggcagagagctgccgtgtaggaagtctcggggtcttgggctggcaggaatattcgacatgtggggccacggcacgatggttaccgtgagctcc

SEQ ID NO: 24812 - RNA, 441 nt, synthetic construct
  misc_feature 1..441: note = derived and/or modified sequence opt3 from anti-HIV_cap256-119-078618_VR-Chain
  source 1..441: mol_type = other RNA
cagatgcaactggtggagagcggcgggggagtcgttcagcccggtagatccctcaccctttcttgcgccgcttcacagttcaactttgcaagttacggcatgcactgggtgaggcaggcccctgggaagggactggaatgggtagcgagcatctccaatgacggcactaaaaagtatcatgctgagtctgtgtgggatcggttctcgatttcaaaagacaacagcaagaatacattgtttttacaaatgaacagtctgcgcgtcgaagatacgaccctatacttctgtgtgaaagaccagcgagaggatgaatgcgaggagtggtggtccgactattacgattttggtcgtgaactcccatgtagaaagtctagggggctgggacttgccggcaatttctgcatatgtggcgcagacgggacaatggttactgtgagctcc

SEQ ID NO: 24813 - RNA, 432 nt, synthetic construct
  misc_feature 1..432: note = derived and/or modified sequence opt3 from anti-HIV_cap256-119-077466_VR-Chain
  source 1..432: mol_type = other RNA
caggtgcaactggtcgagagcggcgggggagttgtgcagcccggttcccctctcagaatctcttgcgccgtatcacagttcacctttagtaggtacggcatgcactgggtgcggcaggctccagggaagggacttgaatgggtcgcaagcatttccttcgacggccgcgataaatatcattcttcgctggtgtggggtcgattgacaatatcacgtgacaatagcaagagtactttatttctgcaaatgaactccctaagagccgaggatacggcgctctactattgtgctagggacctgcgggaatctgagtgcgaagagtgggagagcgattactatgccttctaccgcaaacttccgtgtgttaagcccagaggggtggcaggaaccctggacatctggggccagggcacaatggtcactgtgtcctca

SEQ ID NO: 24814 - RNA, 423 nt, synthetic construct
  misc_feature 1..423: note = derived and/or modified sequence opt3 from anti-HIV_cap256-119-076284_VR-Chain
  source 1..423: mol_type = other RNA
caggtgcaactggtcgagagcggcgggggagttgtgcagcccggtagatccctcaggctttcttgcgccgcttcaaacacctacgcaatgcactgggtacggcaggcccctggcaaggggctggaatggatggcgttgatcagttatgagggaagcgacaaatactatgtggattccgtcaagggccgcttcacaatttctcgagacaattcgaaatcaactttatacctgcagatgaacagcctaagtgctgaagatacggccgtgtatttttgtgcaaaggacctcggtgggaataaagatgacgagtggaccacagattactattacgactggtccaaggcccgtccagttcaagatccgagagtggtcgctggaactttcgacatatggggccagggcaccatggtgacagtatctagc

SEQ ID NO: 24815 - RNA, 432 nt, synthetic construct
  misc_feature 1..432: note = derived and/or modified sequence opt3 from anti-HIV_cap256-119-074680_VR-Chain
  source 1..432: mol_type = other RNA
gaggtgcagctggtcgaaagcggcgggggactcgttcaacccggtagatcccttaggctgtcttgcgccggctcagggttcacctttgtggactacgctatgcactgggtacgccaggtgcctggaaagggcttggagtgggtcggtagtatcagctatgatgggtccgacaaataccatacaaactctgtgtggggacggttcattgtttcgcgagataattcaaagaacactttatatctgcagatgaatagcctacgtccagaagacacggcactctactattgtgtgagagataggcgggagagtgaatgcgaggagcgctggtccgactactatgattttggcaaacagctgccgtgtgtcaagcccagaggcgtggccgggatattcgacatctggggacaaggtaccatggtaacagtttctagc

SEQ ID NO: 24816 - RNA, 432 nt, synthetic construct
  misc_feature 1..432: note = derived and/or modified sequence opt3 from anti-HIV_cap256-119-074081_VR-Chain
  source 1..432: mol_type = other RNA
gaggtgcagctggtcgaaagcggcgggggactcgttcaacccggtggctcccttagactgtcttgcgtggtatcaggggtgaccgtcagtagcaactacatgtcctgggtgaggcaggcccctggaaagggcttggagtgggttgcttctatctcgtatgacggttcagataaataccacgcagaccgggtgtgggggcgcttcacaattagccgagataatagtaagaacactttatatctgcagatgaactccctacgtgccgaagacacggcgctctactattgtgtcagagatgctagggagtctgaatgcgagctgtgggagagcgactactataattttggacggaaacttccatgtgtgaagccgcgcggcgtagccggcaccctggatatatgggggcagggaacaatggttactgtgtcctca

SEQ ID NO: 24817 - RNA, 432 nt, synthetic construct
  misc_feature 1..432: note = derived and/or modified sequence opt3 from anti-HIV_cap256-119-071704_VR-Chain
  source 1..432: mol_type = other RNA
cagatgcaactggtggagagcggcgggggagtcgttcagcccggtggctccctcagactttcttgcgccgtgtcacagttcacctttacaagttacgggatgcactgggtaaggcaggctcctggaaagggcctggaatgggtggcaactatcagctccgacggttctaaaaagtatcatggggattcggtctggggacggttgacgatttcacgcgacaacagcaaaaataccttattcctgcaaatgaacaatctacgagccgaggatacagcgctctacttttgtgtgaaggaccagcgtgaagatgagtgcgaagagtggtggagtgactattacgatttcggcaaaaagctgccatgtagaaagtccccgggccttgctgggatatttgacgtttggggacacggtactatggtgaccgtctctccc

SEQ ID NO: 24818 - RNA, 432 nt, synthetic construct
  misc_feature 1..432: note = derived and/or modified sequence opt3 from anti-HIV_cap256-119-071266_VR-Chain
  source 1..432: mol_type = other RNA
caggtgcaactggtcgagagcggcgggggagttgtgcagcccggtgaatccctcagactttcttgcgccgcttcaggcttcacctttagtagcttcgggatgcactgggtaaggcaggcacctggaaagggcctggagtgggtgggttccatctcttacgacgggtcggataaatatcatacaaattcagtctggggacggtttattgtgagccgcgacaatagtaagaacactttgtacttacagatgaactccctgcgaccagaagatacggccctatattactgtgttcgtgacagaagggagtctgaatgcgaggagcggtggagcgattattacgacttcggcaaacaactcccgtgtgtgaagccccgcggcgtcgcggggatatttgatatctggggacagggtaccatggtgacagtatcctca

SEQ ID NO: 24819 - RNA, 432 nt, synthetic construct
  misc_feature 1..432: note = derived and/or modified sequence opt3 from anti-HIV_cap256-119-069667_VR-Chain
  source 1..432: mol_type = other RNA
gaggtgcagctggtcgaaagcggcgggggactcgttcaacccggtagatcccttaggctgtcttgcgccgcttcaggcttcagttttaacacctacgggatgcactgggtgcggcaggcacctggaaagggcttggagtgggtagccttcatccgctatgacggtagcaataaatactatgcggattccgtgaaggggcgatttacaatttctcgtgacaactcgaaaaatactttatacctgcagatggatggactaagaggcgaagacacggctctctattactgtgccaaggatctgagggagcttgaatgcgaggagtgggcatcagactattacgatttcggccggccacagccgtgtctggacccccgcggggtcagcggaataagtaacgtgtggggtcaaggcaccatggttacagtgtcctct

SEQ ID NO: 24820 - RNA, 432 nt, synthetic construct
  misc_feature 1..432: note = derived and/or modified sequence opt3 from anti-HIV_cap256-119-069591_VR-Chain
  source 1..432: mol_type = other RNA
caggtgcaactggtcgagagcggcgggggagttgtgcagcccggtagatccctcaggctttcttgcgccgcttcaggcttcacctttagtagctacgcaatgcactgggtacggcaggcccctgggaagggactggaatgggtggcgggcatctcctatgacggttctgataaataccatgctgacaaggtctgggggcgcttcacaatttcgcgagataacagcaaaaatactttgtatttacagatgaactcactgcgtgccgaggacacggcactatactattgtgccaaggatctcagagaagacgagtgcgaagagtggtggagtgattactatgactttggaaaaaggctgccatgtcggaagtcccgcggcgtggctggcgttttcgataagtgggggcaaggaaccatggtgacagtctctagc

SEQ ID NO: 24821 - RNA, 432 nt, synthetic construct
  misc_feature 1..432: note = derived and/or modified sequence opt3 from anti-HIV_cap256-119-068691_VR-Chain
  source 1..432: mol_type = other RNA
cagggccacctggtggccagcgggggaggtgtcgttccccctggcagatccctcaccctttcttgcctggcttcacaattcacatttagtgggtacggattccattgggtgaggcaggcaccaggcaagggtttggagtgggtagccagcatctcctttgcggggactaaaaagcactatggaaactctgtgaaaggccggttcacgatttcgcgcgacaattcaaagaacaccttatacctggaaatgaatagcctacgaccggaggatacagctctctattactgtgccaaagaccgtagagaatatgagtgcgaagagtggaccagtgattactatgactttggcaggccccagccttgtatagattcccgcggggtcgtgggaatcctggacatttggggtcggggcactatggttacagtgtctagc

SEQ ID NO: 24822 - RNA, 432 nt, synthetic construct
  misc_feature 1..432: note = derived and/or modified sequence opt3 from anti-HIV_cap256-119-068488_VR-Chain
  source 1..432: mol_type = other RNA
cagatgcaactggtggagagcggcgggggagtcgttcagcccggtatgtccctcaccctttcttgcgccgcttcacagttcacatttagtaactacggcatgcactgggtgagacaggcacctgggaagggactggaatgggtagccagcatctccaatgacggctctaaaaagtatcatggtgattcggtgaaagggaggttcactatttcacgggacaacagcaagaatacgttgtacttacaaatggatggactgcgcggcgaggacaccgcgctatattactgtgctaaagatctccgagaactggagtgcgaagagtgggccagtgactattacgattttggccgtccacagccgtgtcttgaccccagaggggtctccggaatatctaacgtgtggggtcagggcacaatggttactgtgagctcc

SEQ ID NO: 24823 - RNA, 432 nt, synthetic construct
  misc_feature 1..432: note = derived and/or modified sequence opt3 from anti-HIV_cap256-119-067536_VR-Chain
  source 1..432: mol_type = other RNA
caggtgcaactggtcgagagcggcgggggagttgtgcagcccggtagatccctcaggatctcttgcgcctcaagtcagttcacctttagccggtacggcatgcactgggtacgccaggctcctgggaagggacttgaatgggtggcatccatttcttatgacggccgagattaccatcacgccggtgcggtctgggggcgtttcataatctcgagagacaacagcaaaaattcactgcatttgcaaatgaacagtttaaggccagaggatacagctctgtatttttgtgcccgggacctacgcgaatccgagtgcgaagagtgggagtctgattactatgcattctacagaaagctcccgtgtgtgaaacccaggggagttgccggcactctggacatttggggccaggggacgatggtgaccgtcagctcc

SEQ ID NO: 24824 - RNA, 432 nt, synthetic construct
  misc_feature 1..432: note = derived and/or modified sequence opt3 from anti-HIV_cap256-119-065852_VR-Chain
  source 1..432: mol_type = other RNA
caggtgcacctggtcgagagcggcgggggagccgttccctccggtagatctctcaggctttcatgcgtggctagtggcttcacctttggggtatacgacatccattgggtgcggcaagcacctggaaagggcctggaatgggtcgccagcatttcctatgatggtcgcgacaaataccactcttcgttggtgtgggggcgattaacaatatcacgtgataatagcaagagtactctgttcctacagatgaactccctcagagcggaggacacggctctgtattactgtgccagggatcttcgggaatctgagtgcgaagagtggcagagcgactattacgcattttataaaaagctgccatgtgttaaaccgcgcggagtggccggcaccttggatatctggggccaggggacaatggtcactgtgtcctca

SEQ ID NO: 24825 - RNA, 432 nt, synthetic construct
  misc_feature 1..432: note = derived and/or modified sequence opt3 from anti-HIV_cap256-119-065457_VR-Chain
  source 1..432: mol_type = other RNA
ctgggcagactcgtggccagcgggggaggtgtcgttccccctggcaggtccccacggctttcttgcgtggcttcacagttcacctttagtgggtgtggactgcactgggtacgccaagcaccgggcaagggtttggagtgggtggccgcgatcagcttcgacgggacagataaataccattccgacgatgtctggggacgatttactatttctcgtgacaactcgaagaatacgttatatctgcagatgaactcactaagacccgaagataccgctctctactattgcgccaaagacctgcaggaggatgaatgtgaggaatggtggagcgactactatgatttcggcaagcagcttccttgcaggaaaagtcggggcgtggcagggatatttgacgattggggacaaggtacaatggttactgtgtcctct

SEQ ID NO: 24826 - RNA, 432 nt, synthetic construct
  misc_feature 1..432: note = derived and/or modified sequence opt3 from anti-HIV_cap256-119-064501_VR-Chain
  source 1..432: mol_type = other RNA
caggtgcaactggtcgagagcggcgggggagttgtgcagcccggtagatccctcaggctttcttgcgccgcttcaggcttcacctttagtagctacgcaatgcactgggtacggcaggcccctgggaagggactggaatgggtggcgggcatctcctatgacggtcgcgataaataccatgctcactctgtctgggggcgattgtcgatttcacgtgacaacagcaagaatacattatatctgcagatgaacagtctaagaactgaggatacggccctctaccattgtgtgagggacctgcgggaatccgagtgcgaactttgggagtctgattattacgacttcggcaaaaagctgccatgtgttaaaccgcgcggagtggcaggcacctttgatttgtgggggcaaggaacaatggtcactgtgagctcc

SEQ ID NO: 24827 - RNA, 432 nt, synthetic construct
  misc_feature 1..432: note = derived and/or modified sequence opt3 from anti-HIV_cap256-119-063568_VR-Chain
  source 1..432: mol_type = other RNA
caggtgcaacccgtcgagagcggcgggggagttgtgtggcctggtagatccctgaggctctcttgcaccacatcaggcttcacttttagtaactacgccatccactgggtacggcaggctccagggaagggacttcagtgggtggcagtcattagctatgacggctccaataaattctacgccgattctgtgaagggtcgctttacgatatcgcgagacaacagcaaaaataccctgtatttgcagatgaactcattacgtccggaagatacagcgctgtactattgtgctaaggacctaagagaggatgaatgcgaggaaaggtggagtgactactatgatttcgggaaacaactcccctgtcggaagtcccgcggagttgccggcgtgtttgacaattggggccaggggactatggtcaccgtgtctagc

SEQ ID NO: 24828 - RNA, 435 nt, synthetic construct
  misc_feature 1..435: note = derived and/or modified sequence opt3 from anti-HIV_cap256-119-063103_VR-Chain
  source 1..435: mol_type = other RNA
caggtgcaactggtcgagagcggcgggggactcgttcagcccggtaagtcccttagactgtcttgcgccgcttcaggcttcacctttagtacatacgggatgcactgggtgaggcaggcacctggaaaaggcttggaatgggtagccttaatcagctatgacggttcctacacttattacgcggattctgtgaaggggcggttcacgatttcgcgcgacaactcaaaaagcaccctggatctacagctcaatacactgcgaccagaggacactgctctttattactgtgcccgtgatctgagagaaatggagtgcgaagagtggaagttgtataactactacgactttaggacccggggaccgtgtgtcgatccccgcggcgtggttggcagtttcgacgtgtgggggcaaggaacagtcgtgaccgtatcctct

SEQ ID NO: 24829 - RNA, 432 nt, synthetic construct
  misc_feature 1..432: note = derived and/or modified sequence opt3 from anti-HIV_cap256-119-061027_VR-Chain
  source 1..432: mol_type = other RNA
caggtgcaactggtcgagagcggcgggggagttgtgcagcccggtagatccctcaggctttcttgctcagccagtggcttcaccctgagctcctacgggatccactgggtacggcaggctcctggaaagggcttggaatgggtggcagtcatgtctaatgacggttcgaatcagttttatggggattcagtgaaaggacgcttcacaattagccgagacataagtaagaacactttatacctgcaaatgaactccctacgtccagaggatacggccatgtattactgtgcgagagaccagaggtattacgaatgcgaggaatgggcttctgattattacgactttggccgggagcagccgtgtcaggatccccgcggcgttgtgggggtcttcgacatgtggggacaaggtaccatggtgacagtaagctcc

SEQ ID NO: 24830 - RNA, 432 nt, synthetic construct
  misc_feature 1..432: note = derived and/or modified sequence opt3 from anti-HIV_cap256-119-058232_VR-Chain
  source 1..432: mol_type = other RNA
caggtgcaactggtcgagagcggcgggggagttgtgcagcccggtaagtccctcagactttcttgcaaagcctcacagttcacctttaataggtacggcatgcactgggtacggcaggctcctgggaagggactggaatgggtggcagccatcagtttcgacggcacagataaatatcatgcggacaaggtctggggtcgctttactattagccgagatgactccaaatctacgttgtacttacaaatgaactcgctgcgtgctgaggataccgccctatattactgtgcaaaggacctcagagaagatgagtgcgaagagtggtggtcagactattacgatttcgggaagcagctgccatgtaggaaaagccggggagtggccggcatatttgacggctgggggcagggaacaatggttactgtgagttcc

SEQ ID NO: 24831 - RNA, 432 nt, synthetic construct
  misc_feature 1..432: note = derived and/or modified sequence opt3 from anti-HIV_cap256-119-057341_VR-Chain
  source 1..432: mol_type = other RNA
caggtgcaactggtcgagagcggcgggggagttgtgcagcccggtagatccctcaggctttcttgcgccgcttcacacttcagtctgagctcctacggcatgcattgggtacggcaggcacctgggaagggattggaatgggtggccggcgagtcttttgcggctaccaacaaatattacgccgactcggtcaagggtcgcttcatcgtgtcacgagatattagcaaaaatacattatatctggaagttaacagtctacgtgcagaggacactgccctctactattgtgctagagatcagaggtactatgaatgcgaggagtgggcatccgactactacgattttgggcgggaacaaccatgtcaggacccgcgcggagtggccggcatattcgatatctggggccaggggacgatggtcaccgtgtctagc

SEQ ID NO: 24832 - RNA, 438 nt, synthetic construct
  misc_feature 1..438: note = derived and/or modified sequence opt3 from anti-HIV_cap256-119-056895_VR-Chain
  source 1..438: mol_type = other RNA
cagatgcaactggtggagagcggcgggggagtcgttcagcccggtagatccctcaggctttcttgcgccgcttcacagttcacctttggcagttacgggatgcactgggtgcggcagatccctggaaagggcctggaatgggtagcaacaattagctatgacggtactaaaaagtaccatgccgattccgtgtgggaccgcttcataatctctcgagataactcgaaaaatacgttgtttttacaaatgaactcactgcgtccagaggacaccgcgctatatttctgtgtcaaggatcagagacaggacgaatgcgaggaatggtggagcgattactatgactttgggagggagctcccgtgtcggaaaagtcgcggactgggccttgctggcattttcgatatgtgggggcacggaacaatggtgactgtttcctct

SEQ ID NO: 24833 - RNA, 432 nt, synthetic construct
  misc_feature 1..432: note = derived and/or modified sequence opt3 from anti-HIV_cap256-119-056402_VR-Chain
  source 1..432: mol_type = other RNA
caggtgaagctggtcgagagcggcgggggagttgtgcaacccggtaaatccctcagactttcttgcaccgcctcacagttcacatttagtaacttcggcatgcactgggtaaggcaggctcctgggaagggactggaatgggtggcaagcatctcctttgtcggcattaaaaagcattacgccaattctgtgcggggtcgcttcactatatcgcgagaccagtcaaagaacacgttgtatttacaaatgaatagcgttcgtgtggaggataccgcgagatacttttgtgctagggacatgcgggaatatgagtgcgaactgtgggccagtgattactatgacttcgggaaaccacagccgtgtgaggatccccgcggagtcgtgggcacatttgacatgtggggcctagggactctcgtaaccgtttcctct

SEQ ID NO: 24834 - RNA, 432 nt, synthetic construct
  misc_feature 1..432: note = derived and/or modified sequence opt3 from anti-HIV_cap256-119-056034_VR-Chain
  source 1..432: mol_type = other RNA
caggtgcaactggtcgagagcggcgggggagttgtgcagcccggtagatccctcaggctttcttgcgccgcttcaggcttcacctttagtagctacgcaatgcactgggtacggcaggcccctgggaagggactggaatgggtggcggctatctccttcgccggcacaaaaactcattatgcagactctgtcaagggtcgctttacgatttcgcgagataacagcaaaaatgccttgtacttacagatgaacaatctgcgtgctgaggacaccgcactatattactgtgccaaggatctcagagaagacgagtgcgaagagaggtggtcagattattacgacttcgggaaacaactgccatgtcggaagagtcgcggagtggctggcgtttttgataactggggccaggggacaatggtgactgtctcctct

SEQ ID NO: 24835 - RNA, 432 nt, synthetic construct
  misc_feature 1..432: note = derived and/or modified sequence opt3 from anti-HIV_cap256-119-055042_VR-Chain
  source 1..432: mol_type = other RNA
caggtgcaactggtcgagagcggcgggggagttgcccagcccggtagatccctcaggctttcttgcgctgcatcaggcttcacctttcggagttacgggatgcactgggtgcgccaggcccctggaaagggcctggaatgggtagcggtgatcagcttggacggttccaacaaatattacgctgattctgtcaaggggcgattctcgatttcacgtgacaatagcaaaaacacattatatctgcagatgaatagtctaagaccagaggatactgccgtgtactattgtgcaaaggacctcagggaagatgagtgcgaggaacggtggtccgactactatgattttggaaaacaactgccgtgtcgcaagtctagaggcgttgccggcgtgttcgacaactgggggcagggaacgatggtcaccgtgagctcc

SEQ ID NO: 24836 - RNA, 438 nt, synthetic construct
  misc_feature 1..438: note = derived and/or modified sequence opt3 from anti-HIV_cap256-119-054776_VR-Chain
  source 1..438: mol_type = other RNA
caggtgcaactgatggagagcggcgggggagtcgttcagcccggtagatccctcaggctttcttgcaccgcctcaggcttcacatttagtagctactccatgcactgggtgcggcaggctcctgggaagggactggaatgggtagcaatcatttcttatgacgagtcgaacaaatactatgccgattcagtgcagggccgcttcactataagccgagacaatagtaagaacacgttgtttttacaaatgtcctctctgcgtgcggaagataccgctctatacttctgtgtcagagaccatagggaggatgaatgcgaggagtggtggagcgactattacgattttggtcgggaactcccatgtcgcaaattcagagggctgggacttgccggcatctttgacatttggggccacgggacaatggtgactgtttcctca

SEQ ID NO: 24837 - RNA, 432 nt, synthetic construct
  misc_feature 1..432: note = derived and/or modified sequence opt3 from anti-HIV_cap256-119-054539_VR-Chain
  source 1..432: mol_type = other RNA
cagatgcaactggtggagagcggcgggggagtcgttcagcccggtggctccctcagactttcttgcgccgcttcacagttcacctttgggagttacgcaatgcactgggtgaggcagcctccaggagaacggccggagtgggtagccacaatcagcttcgacggcactaagaaatatcatgcggattccgtgtggggtcgctttacgatttctcgagacaactcgaagaataccctgttcttgcaaatgaactcattacgtcccgaagatacagctctgtacttttgtgtcaaagaccagagagaggatgcctgcgaagagtggtggagcgactattacgatttcgggaagaattgtctagcagagagtcctggagcctggctcgaatttttctatgtgtggggccacggcactatggttaccgtgtcctct

SEQ ID NO: 24838 - RNA, 432 nt, synthetic construct
  misc_feature 1..432: note = derived and/or modified sequence opt3 from anti-HIV_cap256-119-054112_VR-Chain
  source 1..432: mol_type = other RNA
caggtgcaactggtcgagagcggcgggggagttgtgcaggccggtagatccctcaggctttcttgcgctgcatcaggcttcacctttagtacatacgccatgcactgggtacggcaggcgcccgggaagggactggaatgggtggctgtcatcagctatgacggctccaacaaatactatgccgattctgtgcgcggtcgattcactatttcgcgtgacaattcaaagaacacgttgtacttacagatgaatagcctgagagcagaggataccgccctatattactgtgctaaagacatgagggaatatgagtgcgaagagtggacaagtgattactacgactttgggcggcctcaaccatgtatagattcccgcggagttgtgggcactttccatgtctggggccaggggaccatggtgacagtatctagc

SEQ ID NO: 24839 - RNA, 432 nt, synthetic construct
  misc_feature 1..432: note = derived and/or modified sequence opt3 from anti-HIV_cap256-119-053339_VR-Chain
  source 1..432: mol_type = other RNA
caggtgcacctggtcgagagcggcgggggagttgtgcaacccggtagatccctcaggctttcttgcgccgcttcacatttcagtctgagctcctacggcatgcactgggtacggcaggcacctgggaagggattggaatgggtgaccggcatctcttttgccggtacaaaaacttattacggggactcggtccgcggacgattcacggtgtcacgtgatattagcaagaacaccttactgctacagatgaatagtctcagaccagacgatacagcgatatattactgtgctagggaccagcggtattacgagtgcgaagagtgggcctccgattattacgactttggcaaagaacaaccgtgtctggatccccgcggcgttgtggggatcttcgacctttggggacagggtactatggtcaccgtgtctagc

SEQ ID NO: 24840 - RNA, 432 nt, synthetic construct
  misc_feature 1..432: note = derived and/or modified sequence opt3 from anti-HIV_cap256-119-052404_VR-Chain
  source 1..432: mol_type = other RNA
cagatgcaactggtggagagcggcgggggagtcgttcagcccggtagatccctcaccctttcttgcatcgcctcacagttcaactttgctagttacggcatgcactgggtgaggcaggcacctgggaagggactggaatgggtagccagcatttcccatgacggcactaaaaagtatcacgcggagtctgtgtggggtcggttcacaatatcgaaagataattcaaagaacacgttgtttttacaaatgaatagcctgcgcgtcgaagacaccgctctatacttctgtgtgaaagatcagcgagaggacgaatgcgaggagtggtggagtgattattacgactttgggaagcagctcccatgtcgtaagtccagaggagttgccggcgtgttcgataactggggccaggggacaatggtcactgtgtctagc

SEQ ID NO: 24841 - RNA, 432 nt, synthetic construct
  misc_feature 1..432: note = derived and/or modified sequence opt3 from anti-HIV_cap256-119-051123_VR-Chain
  source 1..432: mol_type = other RNA
caggtgcaactggtcgagagcggcgggggagttgtgcagcccggtggctccctcagactttcttgcgtagggtcacagttcatcctgtacaggtatggaatgcactgggtgcggcaggcccctggcaagggtttggaatgggtcgctgcagtgagttttgacgggaccgataaataccatgccgacgatgtttggggacgcttcacaattagccgagacaactccaagaatatattatatctgcaaatgaactctctacgtgcggaggatactgctctctactattgtgccaaagacctgagagaagatgagtgcgaagagtggtggtcggactactatgatcttggcaagcagctgccatgtaggaaatcacggggcgtggcaggggtctttgacaagtggggattgggtacgatggtgaccgtaagcagt

SEQ ID NO: 24842 - RNA, 438 nt, synthetic construct
  misc_feature 1..438: note = derived and/or modified sequence opt3 from anti-HIV_cap256-119-051077_VR-Chain
  source 1..438: mol_type = other RNA
gaggtgcagctggtcgaaagcggcgggggagttgtgcaatccggtagatctctcaggctttcatgcgccgctagtcacttcacctttagccggtacggcatgcattgggtacgccaggcacccgggaagggactggagtgggtggcctccatctcttatgacggccgagatttctaccacgcgcgttcggtctggggtagatttacaatttcaagggacaacagcaaaaatactttgttcttacagatgaacagtctgcggatagaagatacggctctatatttttgtgtgaaggaccagcgcgaggatgaatgcgaggagtggtggtccgactactatgatttcgggagagaactcccttgtaggaaatctcggggactgggccttgccggcatctttgacatgtgggggcatggaaccatggttacagtgagctcc

SEQ ID NO: 24843 - RNA, 432 nt, synthetic construct
  misc_feature 1..432: note = derived and/or modified sequence opt3 from anti-HIV_cap256-119-050442_VR-Chain
  source 1..432: mol_type = other RNA
caggcccaaatggtggagagcggcgggggagtcgttcagcccggtagatccctgaggctctcttgcgctgcatcaggcttcagttttagctacttcgccatgcactgggtgcggcaggcgcctgggaaaggacttgaatgggtagctggcatctcctttgccgcaaccaaaacatattacggtgggtctgtgaagggacgcttcactgtctcgcgagacatttcaaagaacacgctgtatttgcagatgaatagcttacgtccagaggataccgccatgtactattgtgctagagaccaaaggtactatgaatgcgaggaatgggcaagtgattactacgactttggccgggagcagccgtgtcaggatccccgcggcgtggttggggtgttcgacatgtggggacagggtacaatggtcactgtgtcctct

SEQ ID NO: 24844 - RNA, 432 nt, synthetic construct
  misc_feature 1..432: note = derived and/or modified sequence opt3 from anti-HIV_cap256-119-049433_VR-Chain
  source 1..432: mol_type = other RNA
caggtgcaactggtcgagagcggcgggggagttgtgcagcccggtagatccctcagggtatcttgccgggcctcaggcttcgcttttagtagctacgcaatgcactgggtgcgccaggcccctgtcaaggggcttgaatgggtggcgctgacctcctctgacggagctgataaatatcatgccgacgatgtttggggccgattcacaatctcgcgtgacaactcaaagaatactttgtacttacagatgaacagcctgagaccagaggatacggcactatattactgtgccaaagacctcagggaagatgagtgcgaggaacggtggagtgactattacgattttggtaagcaactgccgtgtcgcaaatccagaggggtggctggagtcttcgacaattggggccagggcaccatggtgacagtatctagc

SEQ ID NO: 24845 - RNA, 432 nt, synthetic construct
  misc_feature 1..432: note = derived and/or modified sequence opt3 from anti-HIV_cap256-119-047532_VR-Chain
  source 1..432: mol_type = other RNA
ctgggccggctcgtggccagcgggggaggtgtcgttccccctggcaggtcccttaccctgtcttgcgtggcttcacagttcacatttagtgggtgtggattgcactgggtacggcaagcaccaggcaagggtttagagtgggtggccagcatctccttcgcggggactaaaaagcattacacgaactctgtccgcggacgatttaccatttcgcgtgacaattcaaagaacacagtgtatctgcagatgaatagcctaagagctgaagatactgccctctactattgcgcaaaagacatgggcgagtacgaatgtgaggaatggaccagtgattattacgacttcggcaggccgcagccctgcatagattccagaggggttgtgggaatcctggacatttggggtcagggcacaatggtcaccgtgtctagc

SEQ ID NO: 24846 - RNA, 432 nt, synthetic construct
  misc_feature 1..432: note = derived and/or modified sequence opt3 from anti-HIV_cap256-119-047489_VR-Chain
  source 1..432: mol_type = other RNA
caggtgcacctggtcgagagcggcgggggagttgtgcaacccggtaagtccctcagactttcttgcgccgcttcacagttcacctttaacaggttcggcatgcattgggtacggcaggcacctgggaaaggactggaatgggtggccggcatcagttacgacggtagcgataagtatcacgcggacaaagtctgggggcgctttacaatttcccgagataattctaagaacactttgtacttacagatgaatagcctgcgtgctgaggacacggccctatattactgtgcaaaagatctcagagaagacgagtgcgaagagtggtggtcagattattacgacttcggaaagaggctgccatgtcggaagtcgcgcggcgtggccggcgtttttgataaatgggggcaaggaaccatggtgacagtcagttcc

SEQ ID NO: 24847 - RNA, 438 nt, synthetic construct
  misc_feature 1..438: note = derived and/or modified sequence opt3 from anti-HIV_cap256-119-046020_VR-Chain
  source 1..438: mol_type = other RNA
gaggtgcagctgctccaaagcggcgggggacttgtccagcccggtggctccctgagattgtcttgcgccgcttcagggttcagttttagctcctacgcaatgtcttggatcaggcaggcccctggaaagggcttagaatgggttgcgtcgatttcacacgacggtaccaaaaagtatcatgctgagagcgtgtgggggcggttcacaataagtaaagataactccaagaatactctgtttctacagatgaactctctccgcgtagaagacacggccctgtacttctgtgtgaaagatcaacgagaggacgaatgcgaggagtggtggagcgattattacgactttggacgtgaacttccatgtagaaagtccaggggcctgggcttggcagggatcttcgatatgtggggacacggtaccatggtcacagtgtcaagt

SEQ ID NO: 24848 - RNA, 432 nt, synthetic construct
  misc_feature 1..432: note = derived and/or modified sequence opt3 from anti-HIV_cap256-119-044746_VR-Chain
  source 1..432: mol_type = other RNA
caggtgcaactggtcgagagcggcgggggagttgtgcagcccggtagatccctcaggctttcttgcgccgcttcaggcttcacctttagtagctacgcaatgcactgggtacggcaggcccctgggaagggactggaatgggtggcggtcatctcctatgacggctctaacaaatactatgctgattcggtgaagggtcgcttcacaatttcacgagacaatagcaaaaacactgtttacttggagatgaatagtttacgtgccgaagatacggcactgtattactgtgccaaggacctaagagagtatgaatgcgaggagtggacctccgattactacgactttgggaggccacagccgtgtatagattctcggggagtggtcggcatcctcgacatttggggccaagggacaatggtgactgtaagctcc

SEQ ID NO: 24849 - RNA, 432 nt, synthetic construct
  misc_feature 1..432: note = derived and/or modified sequence opt3 from anti-HIV_cap256-119-044740_VR-Chain
  source 1..432: mol_type = other RNA
cagatgcacctggtggagagcggcgggggagtcgttcaacccggtatgtccctcagactttcttgcgccgcttcacagttcaactttggcagtttcgggatgcattgggtgaggcaggcacctggaaagggcctggaatgggtagccaccatcagctacgacggtactaaaaagtatcactccgattctgtgtgggggcggttgtcgatttcacgcgacaatagcaaaaacacattatttctgcagatgaatagtctacgaacggaggataccgcgctctacttctgtgtccgtgaccaaagagaagatgactgcgaggaatggtggtccgattattacgactttggaaagaaactgccatgtaggaagtctcggggccttgctggcatattcgatatctgggggcatggaacaatggtgactgttagctcc

SEQ ID NO: 24850 - RNA, 432 nt, synthetic construct
  misc_feature 1..432: note = derived and/or modified sequence opt3 from anti-HIV_cap256-119-043790_VR-Chain
  source 1..432: mol_type = other RNA
ctgctccagcttgtggagagcggcgggggagtcgttcaacccggtaactccctgagattgtcttgcgccgctgcaggcttcaccttttcagactacagtttacactgggtgaggcaggcccctgggaagggactggaatgggtagcgatgatcagcgatgacggcaatctagatttctatgctgcctccgtgaaaggtcggtttacaatttctcgcgacaactcgataaatactgtctacctccagatgaactcactgcgagcagaggatacggccctttattactgtgctaaggacctgcgtgaatatgagtgcgaagagtggaccagcgattactatgacttcgggagaccacagccgtgtatcgatagtaggggagtggttggcattttggacatctggtcccaaggcacaatggtgactgtctctagc

SEQ ID NO: 24851 - RNA, 432 nt, synthetic construct
  misc_feature 1..432: note = derived and/or modified sequence opt3 from anti-HIV_cap256-119-042880_VR-Chain
  source 1..432: mol_type = other RNA
gaggtgagactggtcgaaagcggcgggggactcgttcagcccggtggctcccttaggctgtcttgcgccgcttcagggttcaccttgagtgactactatatgagctggatccggcaagcacctggaaagggcttagagtgggtggccgcgatttcctttgctggtactaaaaagcactacgggaactctgtaaaaggacgcttcacaatatcgcgagataattcaaagaacacgctgtatctagaaatgaatagcctccgtgtggaggacaccgccctgtactattgtgcaaaagatcttagagaatacgagtgcgaggaatggacaagtgactattacgattttggcaggccacagccgtgtatcgactcccggggcgtcgtggggattctggatatctggggacagggtactatggttaccgtgtctagc

SEQ ID NO: 24852 - RNA, 432 nt, synthetic construct
  misc_feature 1..432: note = derived and/or modified sequence opt3 from anti-HIV_cap256-119-042606_VR-Chain
  source 1..432: mol_type = other RNA
cagatgcaactggtggagagcggcgggggagtcgttcagcccggtagatccctcaggctttcttgcgccgcttcacagttcacctttggcagttacgggatgcactgggtgcggcagatccctggaaagggcctggaatgggtaacaggtattagcttcgcagccactaaaacgtattacggggactccgtgcgcggacgatttaccgtctctcgtgatatatcgaagaatacattgtatttacaaatgaactcactgagaccagaggacactgcgatgtactattgtgctagggatcagcggtactatgaatgcgaggaatgggccagcgactactacgatttcggccgcgagcagccgtgtcaggaccccagaggcgtggttgggatcctagatctctggggacaaggtaccatggtgacagtcagttcc

SEQ ID NO: 24853 - RNA, 432 nt, synthetic construct
  misc_feature 1..432: note = derived and/or modified sequence opt3 from anti-HIV_cap256-119-042444_VR-Chain
  source 1..432: mol_type = other RNA
caggtgcaactggtcgagagcggcggggacgttgtgcaccccggaggttccctcagactttcttgcgccgcttcaggcttcacctttagtagctacgggatccattgggtaaggcaggcacctggaaagggcctggaatgggtggccgcgatttcctatgatggttctgacaaataccacacaaactcggtctgggggcggttcactgtgtcacgcgataatagcaagaacacggtttatttgcagatgaatagtttacgagctgaggacaccgccctgtacttttgtgtgcgtgatagaagggaatccgagtgcgaactatgggagtctgactattacgatttcggaaaacggctcccatgtgtcaagccgcgcggcgtggcaggcgtatttgacatatgggggcagggaacaatggttactgtgagctcc

SEQ ID NO: 24854 - RNA, 432 nt, synthetic construct
  misc_feature 1..432: note = derived and/or modified sequence opt3 from anti-HIV_cap256-119-040328_VR-Chain
  source 1..432: mol_type = other RNA
caggtgcaactggtcgagagcggcgggggagttgtgcagcccggtggctccctcagactttcttgcgccgcttcagggttcacctttagtagctactccatgaactgggtaaggcaggcacctggaaagggcctggaatgggtggcctctatctcgttcgcgggtacaaaacagcactatggaaattcagtcaaggggcggtttactattagccgcgacaacagtaaaaatacggtgtacttgcaaatgaactccttacgactggaggataccgctctatattactgtgccaaggacctccgtgaatatgagtgcgaagagtggacatctgattactatgacttcggcagaccacagccgtgtatagatagcaggggcgttgtggggatcctggacatttggggacagggtactatggtcaccgtgtcctca

SEQ ID NO: 24855 - RNA, 432 nt, synthetic construct
  misc_feature 1..432: note = derived and/or modified sequence opt3 from anti-HIV_cap256-119-040164_VR-Chain
  source 1..432: mol_type = other RNA
cagatgcacctggtggagagcggcgggggagtcgttcaacccggtatgtccctcagactttcttgcgccgcttcacagttcaactttggcagtttcgggatgcattgggtgaggcaggcacctggaaagggcctggaatgggtagccaccatcagctacgacggtactaaaaagtatcactccgattctgtgtgggggcggttttcgatttcacgcgacaatagcaaaaacacattgtacttacagatgaatagtctgcgaacggaggataccgcgctatatttctgtgctaaggacctccgtgaatacgagtgcgaagagtggacatccgattattacgactttggaagaccacaaccgtgtatagattctaggggcgtcgtgggcatcctggacatttgggggcagggaactatggttaccgtgagctcc

SEQ ID NO: 24856 - RNA, 432 nt, synthetic construct
  misc_feature 1..432: note = derived and/or modified sequence opt3 from anti-HIV_cap256-119-039130_VR-Chain
  source 1..432: mol_type = other RNA
gaggaacagctggtggagagcggcgggggactcgtccaacccggtagatcccttaggctgtcttgcaccggctcagggttccggtttggagactacgccatgaactgggttcgccaggctcctggcaagggtttggaatgggtgacattcatcagttatgatgggagcaataaacactacgcagactccgtaaagggacgatttactgtgtctcgtgataactcgaaaaatacgttacatctgcagatgaactcactaagaccagaggacaccgccctctatttctgtgcgagggatctgcgggaaagcgagtgcgaggaatgggagagttactattacgactttggcaagaaaggcccgtgtgtcaagccccgcggggtggttggagtgcttgatatttggggtcagggcacactggtcactgtgtcctct

SEQ ID NO: 24857 - RNA, 432 nt, synthetic construct
  misc_feature 1..432: note = derived and/or modified sequence opt3 from anti-HIV_cap256-119-038138_VR-Chain
  source 1..432: mol_type = other RNA
caggtgcaactggtcgagagcggcgggggagttgtgcagaccggtaggtccctcaggctttcttgcacaggctcacagttcacttttgggcggtacggaatgtattgggtacgccaggcccccggcaagggtctggaatgggtggctagtatcagctacgacgggcgagatttctatcacgcacgttccgtctggggaagatttacgatttctagggacaactcgaaaaataccttgcatttacaaatgaactcactgcggcctgaggatacagccctatacttctgtgcgcgcgacctcagagaaagcgagtgcgaagagtgggagagttattactatgattttggcaagaaaggcccatgtgtgaagccgagaggggttgtgggagtcctggacatatggggtcagggcactcttgtgaccgtatcctct

SEQ ID NO: 24858 - RNA, 432 nt, synthetic construct
  misc_feature 1..432: note = derived and/or modified sequence opt3 from anti-HIV_cap256-119-037868_VR-Chain
  source 1..432: mol_type = other RNA
caggtgcaactggtcgagagcggcgggggagttgtgcagcccggtagatccctcaggctttcttgcgccgcttcacagttcacctttagtaagtacggcatgcactgggtacggcaggcacctgggaaaggactgcaatgggtggccggcatcagctatgacggttccgataagtaccatgcgcacttcgtctgggggcgcttttctatttcgcgagacaacagcaaaaatgctttgtatttacagatgaactcactgcgtacagaagatactgccctatacttctgtgtgagagacctcagggagagtgaatgcgaggaatggaagtccgattattacgactttggacggaaaggcccatgtctgaagccgcgcggcgttgcagggtctttcgatatatggggacagggtacggtggtcaccgtgagctcc

SEQ ID NO: 24859 - RNA, 432 nt, synthetic construct
  misc_feature 1..432: note = derived and/or modified sequence opt3 from anti-HIV_cap256-119-037102_VR-Chain
  source 1..432: mol_type = other RNA
caggtgaagctggtcgagagcggcgggggagttgtgcaacccggtaaatccctcagactttcttgcaccgcctcacagttcacatttagtaatttcggcatgcactgggtaaggcaggctcctgggaagggactggaatgggtggcaagcatctcctttgtcggcattaaaaagcattacgccaatttcgtgcggggtcgctttactatatctcgagaccagtcgaaaaacacgttgtatttacaaatgaactcagttcgtgtggaggataccgcgagatactattgtgctagggacatgcgggaatacgagtgcgaactgtgggccagcgattattacgacttcgggaagccacagccgtgtgaggatccccgcggagtcgtgggcacatttgacatgtggggcctagggactctcgtaaccgttagttcc

SEQ ID NO: 24860 - RNA, 438 nt, synthetic construct
  misc_feature 1..438: note = derived and/or modified sequence opt3 from anti-HIV_cap256-119-036683_VR-Chain
  source 1..438: mol_type = other RNA
ggcgtgcagctggtcgagagcgggggagccgttgtgagacccggtggctccctcaccctttcttgcgctgcatcacaattcatcctgagtagctacgggatgcactgggtaaggcaggcccctggaaagggcttggaatgggtggcgtccatttctaatgacggtactaaaaagtatcatgctgagtcggtctgggatcggttttcaataagcaaagacaatagtaagaacacattattcctgcagatgaactccctacgcgtggaagatacggccctctacttttgtgttaaagaccagcgagaggatgaatgcgaggagtggtggtctgactattacgatttcgggcgtgaactgccatgtagaaagagcaggggacttggcctggcaggcatctttgacatgtgggggcacggaaccatggtgacagtctcctca

SEQ ID NO: 24861 - RNA, 432 nt, synthetic construct
  misc_feature 1..432: note = derived and/or modified sequence opt3 from anti-HIV_cap256-119-036495_VR-Chain
  source 1..432: mol_type = other RNA
caggtgcaactggtcgagagcggcgggggagttgtgcagcccggtagatccctcaggctttcttgcgccgcttcaggcttcagttttagctcctacgggatgcactgggtacggcaggcacctggaaagggcctggaatgggtggcctctatctcgttcgtcggtattaaaacccattatgcgaactcagtgcgcgggcgatttacaataagccgtgaccagagtaagaatactttgtacttacaaatgaactccgttagaatcgaggatacggctaggtatttctgtgcccgggacatgcgcgaatacgagtgcgaactgtgggcatctgattattacgactttggaaaaccacagccgtgtgaggatcccagaggcgtggtcggcaccttcgacatgtgggggctaggaacactcgtgactgtaagctcc

SEQ ID NO: 24862 - RNA, 438 nt, synthetic construct
  misc_feature 1..438: note = derived and/or modified sequence opt3 from anti-HIV_cap256-119-035375_VR-Chain
  source 1..438: mol_type = other RNA
gaggtgcagctggtcgaaagcggcgggggactcgttcaacccggtagatcccttaggctgtcttgcgccgcttcaggcttcaccttggaggactacgggatgcactgggtgcggcaggcacctggaaagggcttagaatgggtagccagtatcagcaacgatggtactaaaaagtatcatgcggagtccgtgtgggaccgcttttctatttcgaaagataattcaaagaacacactgttcctacagatgaatagcctccgagtcgaagacacggctctgtacttttgtgtgaaagatcagcgtgaggacgagtgcgaagagtggtggagtgattattacgacttcgggagagaacttccatgtaggaagtcccggggactgggcttggccggcatatttgatatgtgggggcacggaaccatggttacagtgtctagc

SEQ ID NO: 24863 - RNA, 438 nt, synthetic construct
  misc_feature 1..438: note = derived and/or modified sequence opt3 from anti-HIV_cap256-119-035165_VR-Chain
  source 1..438: mol_type = other RNA
caggtgcacctggtcgagagcggcgggggagttggtcaacccgccagatccctcaggctttcttgcgctgcatcaggcttcatcctgagtagctacgggttgcattgggtgcggcaggcccctggaaagggcttagaatgggtagcgctgatttcctatgacggtaacaatgagtactatgctgaatctgtgtgggggcgctttaccatatcgaaagataactcaaagaatacactattcctccagatgaacagcctgcgagtcgaggacactgccctttacttttgtgtgaaagatcagcgtgaagacgagtgcgaggaatggtggagtgattattacgacttcggaagagagctgccatgtaggaagtcccggggcttgggcctcgcagggatctttgatatgtggggacacggtacgatggttaccgtgtctagc

SEQ ID NO: 24864 - RNA, 432 nt, synthetic construct
  misc_feature 1..432: note = derived and/or modified sequence opt3 from anti-HIV_cap256-119-035109_VR-Chain
  source 1..432: mol_type = other RNA
caggtgcaactggtcgagagcggcgggggagttgtgcagcccggtagatccctcaggctttcttgcgccaccgctggcttcacattttcaagttacgcaatgcactgggtacggcaggcccctgggaagggactggaatgggtggcgagcatctcctatgacggctctgataaataccatgctgacttggtctggggtcgcttcactatttcgcgagataactcaaagaatacgttatatctgcagatgaacagcctacgtgccgaggacaccgcactctactattgtgtgagagatgccagggaaagtgagtgcgaactgtgggagtccgactactataattttgggcggaaacttccatgtgttaagccgcgcggagtggctggcacactggatatatggggccaagggactatggtcaccgtgtctagc

SEQ ID NO: 24865 - RNA, 339 nt, synthetic construct
  misc_feature 1..339: note = derived and/or modified sequence opt3 from anti-HIV_cap256-119-033789_VR-Chain
  source 1..339: mol_type = other RNA
caggtgtacctggtcgagagcggcgggggagttgtgcaacccggtagatccctcaggctttcttgcgccgcttcacacttcagtctgagctcctatggcatgcattgggtacggcaggcacctgacatctctaagaacaccttgtacttacaggtcaattcgctgcgcccagaagatacagccatgtattactgtgcgcgagaccagcgttattacgagtgcgaagagtgggcttcagattattacgactttgggaaagaacaaccgtgtctagatcccagaggagtggtgggcattttcgacatatggggtcaggggactatggttacggtgagcagt

SEQ ID NO: 24866 - RNA, 432 nt, synthetic construct
  misc_feature 1..432: note = derived and/or modified sequence opt3 from anti-HIV_cap256-119-033641_VR-Chain
  source 1..432: mol_type = other RNA
caggtgcaactggtcgagagcggcgggggagttgtgcagaccggtagatccctcaggctttcttgcacaggctcacagttcacttttgggcggtacggaatgtattgggtacgccaggcccccggcaagggtctggaatgggtggctgcaatcagttacgacgggagcgataaatatcacacgaactccgtctggggacgattcaccgtgtctcgtgacaattcgaagaacacagtttacttgcaaatgaatagcttaagagccgaggatactgcgctgtatttttgtgtgagggaccggcgcgaatcagagtgcgaactatgggagagtgattactatgacttcggcaaaagactcccttgtgtcaagccaaggggcgtggctggggtatttgatatttggggacagggtaccatggttacagtgtcctct

SEQ ID NO: 24867 - RNA, 432 nt, synthetic construct
  misc_feature 1..432: note = derived and/or modified sequence opt3 from anti-HIV_cap256-119-032113_VR-Chain
  source 1..432: mol_type = other RNA
caggtgcaactggtcgagagcggcgggggagttgtgcagcccggtagacctctcaggctttcctgcgtaggctctgggttctcatttatcaccagtgccatgcactgggtgcggcaggctccagacaagggactggaatgggtcgcaattataagcgatggcggtaacaatcgccattacgccgactccgtgaaagggcgattcacaatctctcgtgataactcgaagaatactgtgtttttggaggttaacaatttaagaccggaagacacggcgatgtattactgtgctagggatcagcggtattacgagtgcgaagagtgggcctcagactattacgatttcggacgcgagcaaccctgtcaggaccctagaggcgtcgtgggcgtatttgatatgtgggggcagggaaccatggttacagtgagcagt

SEQ ID NO: 24868 - RNA, 432 nt, synthetic construct
  misc_feature 1..432: note = derived and/or modified sequence opt3 from anti-HIV_cap256-119-031739_VR-Chain
  source 1..432: mol_type = other RNA
caggtgcaactggtcgagagcggcgggggagttgtgcagcccggtagatccctcaggatctcttgcgccgcttcacagttcacctttaatcggtacggcatgcactgggtacgccaggcacctgggaagggacttgaatgggtggccagtattagctatgacggctccgataaataccatgcgggtctggtctgggggcgattcataatctctcgtgacaattcgaagaacacattgtatttacaaatgaactcactgagagctgaggatactgccctatactattgtgtgagggacgaacgggagagcgaatgcgagctctgggagagtgattactatgactttggcaaaaagctgccatgtgttaaaccgcgcggagtggcaggcacgcttgatatttgggggcagggaaccagagtcacagtgtcctct

SEQ ID NO: 24869 - RNA, 432 nt, synthetic construct
  misc_feature 1..432: note = derived and/or modified sequence opt3 from anti-HIV_cap256-119-030932_VR-Chain
  source 1..432: mol_type = other RNA
gaggtgcagctgctcgaaagcggcgggggagtcgttcaacccggtagatcccttaggctgtcttgcgccgcttcaggcttcgcatttagtcactacgggatcttctgggtgcggcaggcccctggaaagggcttggagtgggtaaccgtgattagcggtgacgggtccacacagtggtatgcggattctgtccagggacgctttactatatcgcgagactcaagcaaaaacacgttatacctgcaaatggatggcctacgtggcgaagacaccgctctctattactgtgccaaggatctgagagagcttgaatgcgaggagtgggcaagtgactattacgatttcgggaggccacagccgtgtctggacccccggggagtgtccggtatctctaatgtttggggccaggggacaatggtgactgtcagctcc

SEQ ID NO: 24870 - RNA, 438 nt, synthetic construct
  misc_feature 1..438: note = derived and/or modified sequence opt3 from anti-HIV_cap256-119-030740_VR-Chain
  source 1..438: mol_type = other RNA
caggtgcaactggtcgagttcggcgggggagttgtgcagaccggtagaagcctcaggctttcctgcgccgcttctggctttacattctcagactacgggatgcactgggtacggcaggcacccggaaagggcctggaatgggtggccagtatcagcaacgatggttccaaaaagtatcatggggactctgtctgggcgcgctttattatatcgcgagataatagcaaaaacactttgttcttacagatgtcaagtctgcgtgctgaggacacggccctatacttttgtgtgagagatcacagggaagacgagtgcgaagagtggtggtccgattattacgacttcggacgggagctcccttgtcgcaagtttagaggcctgggccttgcagggatcttcgatatttggggacatggtaccatggttacagtgtctagc

SEQ ID NO: 24871 - RNA, 438 nt, synthetic construct
  misc_feature 1..438: note = derived and/or modified sequence opt3 from anti-HIV_cap256-119-030197_VR-Chain
  source 1..438: mol_type = other RNA
caggtgcacctggtcgagagcggcgggggagttgtgcaacccggtaagtccctcagactttcttgcgccgcttcacagttcaccttttgtaggtacggcatgcattgggtacggcaggcacctgggaaaggactggaatgggtggccagtatcagcaacgacggcacagataagtatcacgcggacaatgtctggggtcgcttcactatttcccgagataactctaaaaatacgttgtacttagagatgaactcgctgcgtggggaagacaccgctctatattactgcgccaaggatatgagagaggacgaatgtgaggagtggtggtcagattattacgactttggaaaagaactcccatgcaggaagtggaagacacggggcgtggcaggcatactggataattgggggcagggaactatggttaccgtgagcagt

SEQ ID NO: 24872 - RNA, 438 nt, synthetic construct
  misc_feature 1..438: note = derived and/or modified sequence opt3 from anti-HIV_cap256-119-027047_VR-Chain
  source 1..438: mol_type = other RNA
cagatgcaactggtggagagcggcgggggagtcgttcagcccggtagatccctcaccctttcttgcgccgcttcacagttcacatttaggaactacggcatgcactgggtgcggcaggcacctgggaagggactggaatgggtagccagtatcagcaaagacggcactaagaaatatcatggtgattccgtgtgggggcgcttcattatatctcgagacaattcgaagaacacgttgtttttacaaatgtcaagcctgcgtgcggaggataccgctctatacttctgtgtcagagaccagagggaagccgagtgcgaagagtggtggagtgattattacgactttggacgggagctcccatgtcgcaaattcagaggcctgggccttgcagggatctttgatatttggggacacggtacaatggtgactgtttcctct

SEQ ID NO: 24873 - RNA, 432 nt, synthetic construct
  misc_feature 1..432: note = derived and/or modified sequence opt3 from anti-HIV_cap256-119-026950_VR-Chain
  source 1..432: mol_type = other RNA
caggtgcaactggtcgagagcggcgggggagttgtgcagcccggtaagtccctcagaatctcttgcgccgcttcaaggttcacctttggccggttcgggatgcactgggtacgccaggcacctggaaaaggccttgaatgggtggccagtattagctacgacggttccgataagtatcatgcggggctggtctggggacgatttataatctctcgtgacaactcgaaaaatacattgtacttacagatgaactcactgagagctgaggatactgccctatattactgtgtgagggacgaacgggagagcgaatgcgagctctgggagagtgattattacaatttcggcaagaactatccatgtgttaaaccgcgcggcgtggcagggacgctggacatttggggacaaggtaccacagtcatcgtgtcctct

SEQ ID NO: 24874 - RNA, 438 nt, synthetic construct
  misc_feature 1..438: note = derived and/or modified sequence opt3 from anti-HIV_cap256-119-026279_VR-Chain
  source 1..438: mol_type = other RNA
cagatgcaactggtggagagcggcgggggagtcgttcagcccggtacctccctcacactttcttgcgccgcttcacagttcagttttactagctacggcatgcactgggtgagacaggcacctgggaagggactggaatgggtagcctccatctctaacgacggcacgaaaaagtatcatgcggagtcggtgtggggtaggttcaccatttcaaaagataatagcaagaacacattgtttttacaaatgaatagtctgcgggtcgaagacactgctctatacttctgtgtgaaagatcagcgcgaggacgaatgcgaggagtggtggtccgattattacgactttgggcgagaactcccatgtcgtaagtctagaggactgggccttgccggcatattcgatatctgggggcacggaaccgttgtgattgtcagctcc

SEQ ID NO: 24875 - RNA, 432 nt, synthetic construct
  misc_feature 1..432: note = derived and/or modified sequence opt3 from anti-HIV_cap256-119-025355_VR-Chain
  source 1..432: mol_type = other RNA
gaggtgcagctggtcgaaagcggcgggggactcgttcaacccggtagatcccttaggctgtcttgcgccgcttcaggcttcagttttagcgactacgcaatgcactgggtgcggcaggcccctgggcagggattggagtgggtagcgttcatctcctatgatggcaccaagaaataccattctgactcggtgtggggtcgcttaacaatttcacgagataacagccgtaatactctgtttctacagatgaacagtctcagaacggaagacaccgctctgtatttctgtgtcagggatcaacgggaggacgattgcgaagagtggtggtccgactactatgattttgggaagaaacttccatgtcgcaagtctagaggactggccggcatattcgacatctggggccacgggacaatggtgactgttagctcc

SEQ ID NO: 24876 - RNA, 432 nt, synthetic construct
  misc_feature 1..432: note = derived and/or modified sequence opt3 from anti-HIV_cap256-119-025301_VR-Chain
  source 1..432: mol_type = other RNA
caggtgcacctggtcgccagcggcgggggagttgtgccccctggtagatccctcaggctttcttgcgtagcttcacaattcacctttagtggcttcgggctgtactgggtgcggcaggcaccaggaaagggcttggagtgggtcgccgcgatcagctttgctggtactaaaaagcattatgccaattccgtgaaagggcgcttcacaatttctcgagacaattcgaagaacacgttatacctgcagatgaactcactacgtccggatgacaccgcactctattactgtgccaaagatctgagagaatatgagtgcgaagagtggacaagcgactactatgattttggaaggccccagccttgtatagacagtcggggcgttgtgggcatccttgatatttggtcccaagggactatggtcaccgtgtctagc

SEQ ID NO: 24877 - RNA, 438 nt, synthetic construct
  misc_feature 1..438: note = derived and/or modified sequence opt3 from anti-HIV_cap256-119-025010_VR-Chain
  source 1..438: mol_type = other RNA
caggtgcaactggtcgagagcggcgggggagttgtgcagcccggtagatccctcaggctttcttgccctgcctcaggcttcagttttagcacctacgggatgcactgggtacggcaggctccaggaaagggcctggaatgggtggcatccatctctaacgacggtaataaaaagtatcatggggagtcggtctgggatcgcttcacaatttcacgagacaacagcaaaaatactttgtttttacagatgaaccgtctgagagtggaagatacggccctatacttctgtgttaaggaccaaagggaggatgaatgcgaggagtggtggagtgactattacgattttggacgggaactcccgtgtcgcaaattcagaggcctgggccttgcggggatatttgacgtgtggggacacggtaccatggtcacagtgtcctct

SEQ ID NO: 24878 - RNA, 432 nt, synthetic construct
  misc_feature 1..432: note = derived and/or modified sequence opt3 from anti-HIV_cap256-119-024631_VR-Chain
  source 1..432: mol_type = other RNA
caggtgcaactgatggagagcggcgggggagtcgttcagcccggtggctccctcagactttcttgcgccgcttcagggttcacctttagtagctacggaatgcactgggtgaggcaggcacctggcaagggtctggaatgggtagccgggatctcctatgacggatctgataaataccatgcgcacttcgtgtggggccggtttattatatcgcgcgacaactcaaagaatgctttgtatttacagatgaacagcctgcgaccagaggatacagccctatacttctgtgtccgtgacctcagagaaagtgagtgcgaagagtggcaatcctattactatgattttggcaggaaagggccgtgtctgaagccccggggagtggcaggttctttcgacatctggggccaggggactgttgtgacggtcagctcc

SEQ ID NO: 24879 - RNA, 432 nt, synthetic construct
  misc_feature 1..432: note = derived and/or modified sequence opt3 from anti-HIV_cap256-119-024467_VR-Chain
  source 1..432: mol_type = other RNA
gaggtgcagctggtcgaaagcggcgggggactcgttcaacccggtggctcccttaatgtgtcttgcgccgcttcagggttcacctttagaacatacgcaatgcactgggtaaggcaggcccctggaaagggcctggagtgggtggcggctatcagttatgacggtgataataaatacagcgccgactccgtcaaggggcggttcactatttctcgcgatcagtcgaaaaacacgttgtatttacagatgaactcagtgcgagttgaagacaccgcacgttactattgtgccagagatatgagggagtacgaatgcgagctgtgggctagcgactattacgattttggaaagccacaaccgtgtgaggacccccggggcgtggtcggcacattcgatatgtgggggctaggaactctcgtgaccgtaagttcc

SEQ ID NO: 24880 - RNA, 432 nt, synthetic construct
  misc_feature 1..432: note = derived and/or modified sequence opt3 from anti-HIV_cap256-119-023805_VR-Chain
  source 1..432: mol_type = other RNA
caggtgcaactggtcgagagcggcgggggagttgtgcagcccggtaagtccctcagactttcttgcgccgcttcacagttcggctttgggagttacggaatgcactgggtaaggcaggcacctggcaagggtctggaatgggtggccaccatcagcttcgacggggcggataagtatcatgctgacgatgtctggggacggttttccatttctcgcgacaactcgaaaaatacattgtacttacaaatgaacaatctgcgaccagaggatactgccctatattactgtgcaaaggacctccgtgaagatgagtgcgaagagagatggtcagactattacgatttcggcaaacagctgccgtgtaggaaaagccggggcgtggccggggtttttgacaactggggacagggtacgatggtgaccgtcagttcc

SEQ ID NO: 24881 - RNA, 432 nt, synthetic construct
  misc_feature 1..432: note = derived and/or modified sequence opt3 from anti-HIV_cap256-119-021736_VR-Chain
  source 1..432: mol_type = other RNA
caggtgcaactggtcgagagcggcgggggagttgtgcagcccggtagatccgtaaggctctcttgcgtggcctcacagttcagttttgaccggtacggcatgcactgggtccgccaggctcctgggaagggacttgaatgggtggcaagcatctcctatgatggcaccgacaaataccatgccgataaggtttggggtcgattcacaatttctcgtgacaattcgaaaaagactctgtatttgcaaatgaactcattaagaccagaggatgcggctctgtactattgtgccaaagacctaagggaagatgagtgcgaagagtggtggagcgactactatgattttgggaagcagctcccgtgtcggaagagtcgcggagtggcaggcatattcgactcctggggccaggggacgatggtcaccgtgtctagc

SEQ ID NO: 24882 - RNA, 438 nt, synthetic construct
  misc_feature 1..438: note = derived and/or modified sequence opt3 from anti-HIV_cap256-119-021203_VR-Chain
  source 1..438: mol_type = other RNA
cagatgcaactggtggagagcggcgggggagtcgttcagcccggtagatccctcaccctttcttgcgccgcttcacagttcacatttagtaactacggcatgcactgggtgaggcaggcacctgggaagggactggaatgggtagccagcgtgtccaatgacggcactaaaaagtatcatggtgattctgtctgggaccggttcacgatctcgcgcgataacagcaaaaataccttgtttttacaaatgtcaagtctgcgagcggaggacacagctgtgtacttctgtgttcgtgatgaaagagaggacgaatgcgaggagtggtggtccgattattacgactttgggagggaactaccatgtcggaagttccgcggactcggcctggccggcatttttgatatatgggggcacggaactcttgtgaccgtctctagc

SEQ ID NO: 24883 - RNA, 432 nt, synthetic construct
  misc_feature 1..432: note = derived and/or modified sequence opt3 from anti-HIV_cap256-119-020569_VR-Chain
  source 1..432: mol_type = other RNA
caggtgcaactggtcgagagcggcgggggagttgtgcagcccggtgaatccctcagaatctcttgcgccgcttcacagttcacctttagtaggtacggcatgcactgggtacggcaggcacctgggaagggacttgagtgggtggccagcatttccttcgacggccgcgataaatatcattcttcgctggtctggggtcgattgacaatatcacgtgacaatagcaagagtactttatttctgcaaatgaactccctaagaccagaagatacggcgctctactattgtgctagggacgtgcgggagtctgaatgcgaggagtggcagagcgattactatgccttctaccgcaaactgccgtgtgttaagcccagaggggtggcaggaacccttgacatctggggccagggcacaatggtcactgtgtcctca

SEQ ID NO: 24884 - RNA, 432 nt, synthetic construct
  misc_feature 1..432: note = derived and/or modified sequence opt3 from anti-HIV_cap256-119-019432_VR-Chain
  source 1..432: mol_type = other RNA
caggtgcaactggtccagagcggcgggggagttgtgcagcccggtagatccctcaggatctcttgcgccgctccttacttcacctttggccggtatgggttccactgggtacgccaggcaccaggaaagggccttgagtgggtggcctcaattagttttgacggtcgagattactatcatagcccgcacgtctgggggcgtctgacaatatccagagacaactctaaaaatactttgtacttacaaatgaactcgctgagggcggaagatacggctctatattactgtgcccgggacctccgcgagtcagaatgcgaggaatgggagagcgattattacgacttcggaaagaaaggcccctgtgtgaagcctagaggcgttgcagggagtctggatatgtggggacagggtaccatggtgacagtctcctct

SEQ ID NO: 24885 - RNA, 432 nt, synthetic construct
  misc_feature 1..432: note = derived and/or modified sequence opt3 from anti-HIV_cap256-119-018827_VR-Chain
  source 1..432: mol_type = other RNA
caggcccaactggtggagagcggcgggggagtcgttcagcccggtaggtccctcaggctttcttgcgctgcatcacacttcagttttaatcggtacggcatgcattgggtgcgccaggcccctgggaagggactggaatgggtagcgggcatcagctatgacggtcgagatttctaccacgctgacattgtgtgggggcgtttgaccatatccagagataattctaaaaacacagtctatttacagatgaactcgctgagggccgacgatactggactatactattgtgcacgggacgtgcgcgagtcagaatgcgaggaatgggagagctactattacgattttggcagaaagggcccatgtctcaaaccgagaggggttgccggaacgttcgacatgtggggtcaaggcaccatcgtgagtgtctccgct

SEQ ID NO: 24886 - RNA, 432 nt, synthetic construct
  misc_feature 1..432: note = derived and/or modified sequence opt3 from anti-HIV_cap256-119-018483_VR-Chain
  source 1..432: mol_type = other RNA
ctggtgcagctcgtcgagagcggcgggggagttgtgcaacccggtaagtcccttagactgtcttgcgtagcctcacagttcacctttaataggtacggcatgcactgggtgcggcaggctcctgggaaaggattggaatgggtcgcaggcatcagttatgacggtcgcgataagtaccatgcccacttcgtgtgggggcgaattacaataagccgtgacaattccaaaaacactttatatctgcagatgaactctctaagagcggaggatacggctctctaccattgtgttagggacctgcgggaatcggagtgcgaactttgggagtcagattattacgactttggaaagaaactgccatgtgtgaagccgcgcggcgtcgccggcatcttcgatttgtgggggcaaggaaccatggtgacagtaagcagt

SEQ ID NO: 24887 - RNA, 432 nt, synthetic construct
  misc_feature 1..432: note = derived and/or modified sequence opt3 from anti-HIV_cap256-119-018118_VR-Chain
  source 1..432: mol_type = other RNA
caggtgcacctggtcgccagcggcgggggagttgtgccccctggtagatccctcaccctttcttgcgtagcttcacaattcacatttagtggctgtgggctgcattgggtgaggcaggcaccaggaaagggcttggagtgggtcgccagcatctccttcgcgggtactaaaaagcactacgggaactctgtgaaaggacggtttacgatttcgcgcgacaattcaaagaacaccttatatctgcagatgaatagcctacgaccggaagatacagctctctactattgcgccaaagacctgcgtgagtacgaatgtgaggaatggaccagtgattattacgacttcggcagagatcagccctgcatagactccaggggcgttgtggggatccttgatatttggggacaaggtactatggtcacagtgtctagc

SEQ ID NO: 24888 - RNA, 432 nt, synthetic construct
  misc_feature 1..432: note = derived and/or modified sequence opt3 from anti-HIV_cap256-119-017782_VR-Chain
  source 1..432: mol_type = other RNA
caggtgcaactggtcgagagcggcgggggagttgtgcagcccggtaagtccctcagactttcttgcgccgcttcaggcttcccttttagtaactacgcaatgcactgggtaaggcagaccccagggcggggactggaatgggtggccggcatcagcttcgcggctactaaaaagtattaccgcccgtccgtccgaggtcgttttacagtgtctacggacatttcgaaaaataccttgtatttagagatgaactcactgagacccgaagatacagccctatacttctgtgcaagggaccagcggtattacgagtgcgaagagtgggccagcgattattacgactttgggcgcgagcaaccttgtctcgatccaagaggagttgtgggcatattcgacctgtggggccaggggactatggtcaccgtgagttcc

SEQ ID NO: 24889 - RNA, 432 nt, synthetic construct
  misc_feature 1..432: note = derived and/or modified sequence opt3 from anti-HIV_cap256-119-017669_VR-Chain
  source 1..432: mol_type = other RNA
caggtgcaactggtcgagagcggcgggggagttgtgcagcccggttcctctctcagactttcatgcgccgctagtcacttcgcatttaacaggtacggcatgcattgggtacggcaggcccctgggaagggactggaatgggtggcgggcatcagcttcgacggtgctgataaatttcacgccgacaaggtctgggggcgcttcaccatttcccgagataattctaaaaacacattgtcgttacagatgaactcactgcgtccagaggacactgcactatattactgtgccaaggatctcagagaagacgagtgcgaagagtggtggagcgattattacgactttggaaggcggctgccgtgtcgcaaaagtagaggcgtgtccggcatattcgataattgggggcaaggaacgatggttaccgtgtctagc

SEQ ID NO: 24890 - RNA, 432 nt, synthetic construct
  misc_feature 1..432: note = derived and/or modified sequence opt3 from anti-HIV_cap256-119-016976_VR-Chain
  source 1..432: mol_type = other RNA
caggtgcaactggtcgagagcggcgggggagttgtgcagcccggtagatccctcaggctttcttgcgccgcttcacagttcagttttggcgacttcgggatgcactgggtacggcaggcacctggaaagggcctggaatgggtggccgcgatcagctttgctggtaccaaaaagaactacgccgattccgtccgcgggcgattcacaatttctcgtgactcgagcaaaaatactttgtatttacaaatgaactcactgagaccagaggatacggcactatactattgtgtgaaggacatgaggggatacgaatgcgaggaatggaccagtgattattacgactttggccggccgcagccctgtatagattcccgcggcgttgtggggacattcgacgtctggggacagggtactatggtgaccgtatctagc

SEQ ID NO: 24891 - RNA, 432 nt, synthetic construct
  misc_feature 1..432: note = derived and/or modified sequence opt3 from anti-HIV_cap256-119-015432_VR-Chain
  source 1..432: mol_type = other RNA
gaggtgcagctgctcgaaagcggcgggggacttgtccaacccggtggctccctgagattgtcttgcgccgcttcagggttcacctttagtggatacagcttaaactgggttaggcaggcacctggcaagggtctggagtgggtggcctccatctcttatgacgggtcggataaataccacgcggaccgggtatggggacgcttcacaatttcacgagataatagcaagaacactctatatctccagatgaatagtctgcgtgctgaagacacggccctttactattgtgtgagagatgcaagggagtccgaatgcgagctgtgggagtctgactactataactttggccggaaattgccatgtgtcaagccgcgcggcgtggccgggaccctcgatatatggggacagggtacaatggttactgtgagctcc

SEQ ID NO: 24892 - RNA, 432 nt, synthetic construct
  misc_feature 1..432: note = derived and/or modified sequence opt3 from anti-HIV_cap256-119-015281_VR-Chain
  source 1..432: mol_type = other RNA
ctgggcagactcgtggccagcgggggaggtgtcgttccccctggcaggtcccttcggctgtcttgcgtggcttcacagttcacctttagtgggtgtggattgcactgggtacgccaagcaccaggcaagggtttagagtgggtggccagcatctccttcgcggggactaaaaagcattacggaaactctgtcaaaggccgatttacaatttcgcgtgacaattcaaagaacacggtgtatctggaaatgaatagcctaagagctgaggataccgccctctactattgcgcaaaagacctgagggaatacgagtgtgaagagtggacaagtgattattacgacttcggccggccgcagccctgcatagattcccgcggggttgtgggaatccttgacatttggggtcagggcactatggtcaccgtgtctagc

SEQ ID NO: 24893 - RNA, 432 nt, synthetic construct
  misc_feature 1..432: note = derived and/or modified sequence opt3 from anti-HIV_cap256-119-014957_VR-Chain
  source 1..432: mol_type = other RNA
caggtgcaagtcgttgagagcggcgggggagtggtacagcccggtacctccctgagactctcttgcacagtgtcaggcttcagttttagcaactacgaccttcactgggtcaggcagactcctgccaaggggctggaatgggtggctgttgtgtcctatgatggatctcgggagtactatacggactcggtcaaaggccgcttcatcatttcacgagatcagagcaagaataccttgtacttacaaatgaacagtgtgcgtctggaagacacagcaagatattactgtgccagggatatgcgggagtatgaatgcgagctatgggcgtccgactactacgattttggtaaaccacagccgtgtgaggacccccgcggggtagttggaactttcgatatgtggggcctcggcaccctggtgacagtctctagc

SEQ ID NO: 24894 - RNA, 432 nt, synthetic construct
  misc_feature 1..432: note = derived and/or modified sequence opt3 from anti-HIV_cap256-119-014777_VR-Chain
  source 1..432: mol_type = other RNA
caggtgcacctggtcgagagcggcgggggagttgtgcaacccggtagatccctcaggctttcttgcgccgcttcacatttcagtctgagctcctacggcatgcactgggtacggcaggcacctgggaagggattggaatgggtggccggcatctcttttgcggctaccaaaacatattacggtgggtcggtcaagggacgcttcactgtgtcacgagacattagcaaaaacacgttatatctgcagatgaatagtctacgtccagaggataccgccatgtactattgtgcaagagaccagaggtactatgaatgcgaggaatgggcctccgattactacgactttggccgggagcaaccgtgtcaggatccccgcggcgttgtgggggtcttcgacatgtggggacagggtacaatggtgactgtatctagc

SEQ ID NO: 24895 - RNA, 432 nt, synthetic construct
  misc_feature 1..432: note = derived and/or modified sequence opt3 from anti-HIV_cap256-119-014313_VR-Chain
  source 1..432: mol_type = other RNA
caggtgcaactggtcgagagcggcgggggagttgtgcagcccggtagatccctcaggatctcttgcgccgcttcacagttcacctttagtcggtacggcatgcactgggtacgccaggcacctgggaagggacttgaatgggtggccagcatttcctatgacggccgagattaccatcacgcgggtgctgtctgggggcgtttcataatctctagagacaactcgaaaaattcactgcatttgcaaatgaacagcttaaggccagaggatacagccctgtatttttgtgcacgggacctacgcgaaagtgagtgcgaagagtgggagtccgattactataatttctggaagaaactcccgtgtgtgaagcccagaggagttgtgggcattctggacatctggggccaggggactgtcgtgacggtatctagc

SEQ ID NO: 24896 - RNA, 438 nt, synthetic construct
  misc_feature 1..438: note = derived and/or modified sequence opt3 from anti-HIV_cap256-119-014219_VR-Chain
  source 1..438: mol_type = other RNA
cagatgcaactggtggagagcggcgggggagtcgttcagcccggttcctctctcaccctttcatgcgccgctagtcagttcacatttagcaactacggcatgcactgggtgagacaggcacctgggaagggactggaatgggtagcctccatctctaatgacggcactaaaaagtatcatggtgattcggtgtgggacaggttcacgatttcacgggataacagcaaaaataccttgtttttacaaatgaacagtctgcgcgcggaggacacagctctatacttctgtgtcaaggatcagcgagaagacgagtgcgaagagtggtggtccgattattacgactttgggcgtgagctcccatgtagaaaattcaggggactgggccttgccggcacttttgatatatgggggcacggaaccatgctgatcgtgtctagc

SEQ ID NO: 24897 - RNA, 432 nt, synthetic construct
  misc_feature 1..432: note = derived and/or modified sequence opt3 from anti-HIV_cap256-119-013631_VR-Chain
  source 1..432: mol_type = other RNA
caggtgcaactggtcgagagcggcgggggagttgtgcagcccggtagatccctcaggctttcttgcgccgcttcacagttcacctttggcagttacgggatgcactgggtacggcagatccctggaaagggcctggaatgggtggcaacaattagctatgacggtactaaaaagtaccatgccgattccgtctgggaccgcttcataatctctcgagataactcgaaaaatacgttgtttttacaaatgaactcactgcgtccagaggacaccgcgctatatttctgtgtgaaggatcagagacaggacgaatgcgaggaatggtggagcgattactatgactttgggaggcggctcccgtgtcgcaaaagtagaggactggctggcattttcgatgtttggggccacgggacaatggtgactgtctcctct

SEQ ID NO: 24898 - RNA, 432 nt, synthetic construct
  misc_feature 1..432: note = derived and/or modified sequence opt3 from anti-HIV_cap256-119-012924_VR-Chain
  source 1..432: mol_type = other RNA
caggtgaccctggtcgagagcggcgggggattcgttcaacccggtggctccctcagactttcttgcgccacatcagggtttactttcagtagctacgctatgcactgggtgaggcaggcacctggaaagggcctggaatgggtagccgcgatctcctttgacggtgctgataaatatcatgccgacaacgtgtgggggcggttgtctatttcgcgcgataattcaaagagcacgttatacctgcagatgaacagtctacgaccagaggacaccgcagtctatttctgtgccaaagatctccgtgaagacgagtgcgaagagagatggtccgattactatgactttggaaagcagctgccgtgtaggaaatctcggggcgtggctggcatattcgataattgggggcaaggaacaatggttactgtgagcgca

SEQ ID NO: 24899 - RNA, 432 nt, synthetic construct
  misc_feature 1..432: note = derived and/or modified sequence opt3 from anti-HIV_cap256-119-011793_VR-Chain
  source 1..432: mol_type = other RNA
caggtgcaactggtcgagagcggcgggggagttgtgcagcccggtggctccctcagactttcttgcgtagcctcacagttcacctttagtaggtacgggatgcactgggtgcggcaggctcctggaaagggcctggaatgggtcgcaagcatctcctatgacggtcgcgataaataccatgccgacttcgtgtgggggcgattgacaatttctcgtgatgactcgaagaaaactttatatctgcaaatggattcactaagagttgacgatacggcgctctactattgtgtgagggacatgcgggagagcgaatgcgagctgtgggaaagtgattactatgactttggaaagcgccttccatgtgtcaaaccgagaggcgtggctggcatattcgatatctgggggcagggaaccatggtaacagtttcctct

SEQ ID NO: 24900 - RNA, 432 nt, synthetic construct
  misc_feature 1..432: note = derived and/or modified sequence opt3 from anti-HIV_cap256-119-011413_VR-Chain
  source 1..432: mol_type = other RNA
caggtgcaactggtcgagagcggcggggacgttgtgcagcccggaagatccctcaggctttcttgcgccgcttcaggtttcacctttagtacatacggcatgcactgggtacggcaggcacctgggaagggactggaatgggtggccgcgatcagcttcgctggcactaaaaagaactatgccgattccgtccgcggtcgatttacgatttctcgtgactcgagtaaaaataccttgtacttagagatgaacagcctgagaccagaagatacagcactatattactgtgccaaggacatgagggggtatgagtgcgaagagtggacttcagattactatgacttcggacggccgcagccctgtatagattcccgcggcgtggttggcacctttgacgtgtgggggcaaggaacaatggtcaccgtgtctagc

SEQ ID NO: 24901 - RNA, 432 nt, synthetic construct
  misc_feature 1..432: note = derived and/or modified sequence opt3 from anti-HIV_cap256-119-011323_VR-Chain
  source 1..432: mol_type = other RNA
caggtgaagctggtcgagagcggcgggggagttgtgccccctggtaaatccctcagactttcttgcaccgcctcacaattcacatttagtaacttcggcatgcactgggtaaggcaggctccagggaagggactggaatgggtggcaagcatctcctttgtcggcattaaaactcattacgccaattctgtgcggggtcgcttcacgatatcgcgagaccagtcaaagaacaccttgtatttacagatgaatagcgttcgtgtggaggatacagggagatactattgtgcgagggacatgcgggaatacgagtgcgaactgtgggctagtgattattacgactttggaaaaccgcaaccctgtgaggatcctcgcggcgtcgtgggcactttcgacatgtgggggctaggaaccctcgtaacagtttcctct

SEQ ID NO: 24902 - RNA, 432 nt, synthetic construct
  misc_feature 1..432: note = derived and/or modified sequence opt3 from anti-HIV_cap256-119-011233_VR-Chain
  source 1..432: mol_type = other RNA
caggtgcacctggtcgagagcggcgggggagttgtgcaacccggtagatccgtaaggctctcttgcgccgcttcacatttcagtcttagctcctacggcatgcactgggtgcggcaggcacctgggaagggactggaatgggtcaccggcatctcttttgccggtacaaaaacttattacggggactcggtgcgcggacgattcacggtttcacgtgatattagcaagaacaccttgtttttacagatgaatagtctgagaccagacgatacagcgatgtattactgtgctagggaccagcggtattacgagtgcgaagagtgggcctccgattattacgacttcggccgcgaacaaccgtgtctagatcccagaggcgtggtcgggatatttgacctctggggacagggtactatggtgaccgtatctagc

SEQ ID NO: 24903 - RNA, 432 nt, synthetic construct
  misc_feature 1..432: note = derived and/or modified sequence opt3 from anti-HIV_cap256-119-009038_VR-Chain
  source 1..432: mol_type = other RNA
caggagcaactggtggaaagcggcgggggagtcgttcagcccggtagatccctcaggctttcttgcgtggcctcacggttcacctttagtgctttcggcatgcactgggtacgccaggcacctgggaagggactggagtgggtggccagcatctcctttgcgggcattaaaaagtactatggtgactctgtcaaagggcgattcacaatatcgcgtgataactcaaagaatactttgtacttacagatggacggactgagaggcgaagatacggctctatattactgtgccaaagacctcagggagctggaatgcgaggagtgggcaagcgattattacgactttggccggccacaaccgtgtcttgatccccgcggggtgagtggaatctccaacgtttggggtcagggcaccatggtgacagtctctagc

SEQ ID NO: 24904 - RNA, 432 nt, synthetic construct
  misc_feature 1..432: note = derived and/or modified sequence opt3 from anti-HIV_cap256-119-008756_VR-Chain
  source 1..432: mol_type = other RNA
caggtgcaactggtcgagagcggcgggggagttgtgcagcccggtaagtccctcagactttcttgcgtagtgtcacagttcacctttggcaggtacgggatgcactgggtccggcaggcccctggaaaaggcctggaatgggtggctagtatcagctatgacggttccgataagtaccatacatcttcgttgtgggggcgcttcattgtttcacgagacaacagcaaaaatactttatatctgcaaatgaacagtctacgtccagaggatacggcactctactattgtgtgagagacaggcgggaatccgagtgcgaggaacgctggtctgattactatgactttggaaagcagctgccgtgtgtcaaacccagaggcgtggccggcatattcgatatctgggggcagggaaccatggtaacagttagctcc

SEQ ID NO: 24905 - RNA, 438 nt, synthetic construct
  misc_feature 1..438: note = derived and/or modified sequence opt3 from anti-HIV_cap256-119-008055_VR-Chain
  source 1..438: mol_type = other RNA
cagatgcaactggtggagagcggcgggggagtcgttcagcccggtagatccctcaccctttcttgcgccgcttcacagttcagttttgcaaactacggcatgcactgggtgaggcaggcccctgggaagggactggaatgggtagcgagcatctccaatgacggcactaaaaagtatcatgaggaatctgtgtggggtcggttcacaatttcgaaagataactcaaagaatacgttgtttttacaaatgaacagcctgcgcatagaggacaccgctctatacttctgtgtcaaagatcagcgagaagacgagtgcgaggaatggtggagtgattattacgactttgggcgtgagctcccatgtagaaagtccaggggactgggccttgccggcatcttcgatatgtgggggcacggaacaatggtgactgtttctagc

SEQ ID NO: 24906 - RNA, 435 nt, synthetic construct
  misc_feature 1..435: note = derived and/or modified sequence opt3 from anti-HIV_cap256-119-006949_VR-Chain
  source 1..435: mol_type = other RNA
caggtgcacctggtcgagagcggcgggggagttgtgcaacccggtagatccctcaggctttcttgcgccgcttcaggcttcagtgtaagcaacaattacatgaactgggtgcggcaggcacctggggaaggactggagtgggtcgccttgatctcctttgacggccgccagaaggatttagcggactctgtgaaaggtcgattcgctatttcgcgtgataattcaaagaacaccctgtatctacagatgaatagcctcagactggaagacacagccctttactattgtgcaagggatctgcgggagttggactgcgaagagtggactctctacaactattacgattttgggagtcgcggaccatgtgttgacccgagaggcgtgggcgggtccttcgatgtctggggacaaggtacgatggtgaccgtatctagc

SEQ ID NO: 24907 - RNA, 432 nt, synthetic construct
  misc_feature 1..432: note = derived and/or modified sequence opt3 from anti-HIV_cap256-119-006685_VR-Chain
  source 1..432: mol_type = other RNA
caggtgcaactggtcgagagcggcgggggagttgtgcagcccggtagatccctcagggtatcttgcgccgcttcacacttcacctttagtcggtacggcatgcattgggtgcgccaggcacctgggaagggacttgaatgggtcgccagcatctcctatgacggccgagatttctaccacgcgcgttctgtgtggggtagatttacaatttcgagggacaacagcaaaaatactctgcatttgcagatgaactcattacggccagaggatacggctctgtatttctgtgcccgcgacctaagagaaagtgagtgcgaagagtgggagtcctactattacgattttgggaagaaaggaccgtgtgttaagcccaggggcgtggtcggcgtgctcgacatatgggggcaaggaaccctggtaacagtttctagc

SEQ ID NO: 24908 - RNA, 432 nt, synthetic construct
  misc_feature 1..432: note = derived and/or modified sequence opt3 from anti-HIV_cap256-119-006015_VR-Chain
  source 1..432: mol_type = other RNA
caggtgcaactggtcgagagcggcgggggagttgtgcagcccggtaagtccctcagactttcttgcgccgcttcaaggttcacctttaaccggtacggcatgcactgggtacgccaggcacctgggaaaggactggaatgggtggccgcgatcagtttcgacggcacagataagtatcatagcgacgatgtctggggtcgatttactatttcccgtgacaattctaaaaacacgttgtacttacagatgaatagcctgagaccagaggataccgctctatattactgtgccaaggacctccaagaagatgagtgcgaagagtggtggtcagactattacgatttcgggaaacagctgccgtgtaggaagtcgcggggagtggcaggcatatttgacgattggggccaggggacaatggttactgtgagttcc

SEQ ID NO: 24909 - RNA, 432 nt, synthetic construct
  misc_feature 1..432: note = derived and/or modified sequence opt3 from anti-HIV_cap256-119-005841_VR-Chain
  source 1..432: mol_type = other RNA
caggtgcaactggtcgagagcggcgggggagttgtgcagcccggtagatccctcaggctttcttgcgccgcttcacagttcagttttggcaatttcgggatgcactgggtacggcaggcacctggaaagggcctggaatgggtggccgcgatcagctttgctggtaccaaagagaattacgccaactccgtccgcgggcgattcacaatttctcgtgacaattcgaagaacactttgtatttacaaatgaactcactgagagcagaagatacggccctatactattgtaccaaagacatgagggagtacgaatgcgaggagtggacaagcgattattacgactttggacggccacagccgtgtatagatagtcgcggcgtggttggcactttcgacgtgtgggggcagggaaccatggtcacagtgtcctct

SEQ ID NO: 24910 - RNA, 432 nt, synthetic construct
  misc_feature 1..432: note = derived and/or modified sequence opt3 from anti-HIV_cap256-119-005824_VR-Chain
  source 1..432: mol_type = other RNA
caggtgcaactggtcgagagcggcgggggagttgtgcagcccggtggctccctcagactttcttgcgccgcttcagggttcacctttaggcggtacgcaatgcactgggtacgccaggcccctggaaagggcctggaatgggtggcgagtatcagctatgacggttccgataaataccatacatcttcgttgtgggggcgattcattgtctcacgtgacaacagcaagaatactttatatctgcagatgaacagtctaagaccagaggatacggctctctactattgtgtgagggaccggcgcgaatccgagtgcgaagagagatggtctgattactatgactttggaaaacaactgccgtgtgttaagcccaggggcgtggccggcatattcgatatctgggggcagggaaccatggtcacagtgagctcc

SEQ ID NO: 24911 - RNA, 432 nt, synthetic construct
  misc_feature 1..432: note = derived and/or modified sequence opt3 from anti-HIV_cap256-119-005494_VR-Chain
  source 1..432: mol_type = other RNA
caggtgagactggtcgagagcggcgggggagttgtgcaacccggtaggtccctccggatctcttgcgccgcttcacagttcatgtttaacaagtacggcatgcactgggtacgccaggcacctgggaaaggacttgaatgggtggccagtattagctatgacggctccgataagtaccatgcggacctggtctggggtcgattcaccatatctcgtgataattcgaaaaacacattgtatttacagatgaactcactgagagctgaggacactgccctatactattgtgtgagggatgcacgggaaagcgagtgcgaactctgggagagtgactactataattttgggcgcaagctgccatgtgttaaaccgagaggagtggccggcacgcttgatatctggggccaagggaccatggtcacagtgtcctct

SEQ ID NO: 24912 - RNA, 432 nt, synthetic construct
  misc_feature 1..432: note = derived and/or modified sequence opt3 from anti-HIV_cap256-119-004949_VR-Chain
  source 1..432: mol_type = other RNA
caggtgcaactggtcgagagcggcgggggagttgtgcagcccggtagatccctcaggctttcttgcgccgcttcaaagttcagtctgagctcctacggcatgcactgggtacggcaggcacctgggcgcggattggaatgggtggccggcatctcttttgcggctaccaaaaagtattaccgaccatcggtccgtggtagattcacagtgtcaactgacattagcaaaaacacgttatatctggagatgaatagtctaaggccggaagataccgccctctacttttgtgcacgggaccagcgctattacgagtgcgaagagtgggcctccgattattacgacttcgggagagagcaaccctgtctggatcctaggggagttgtgggcatatttgacctttggggccaggggacaatggtcactgtgtctagc

SEQ ID NO: 24913 - RNA, 432 nt, synthetic construct
  misc_feature 1..432: note = derived and/or modified sequence opt3 from anti-HIV_cap256-119-004422_VR-Chain
  source 1..432: mol_type = other RNA
cacgtgcagctggtcgagagcggcgggggagttgtgcaacccggtagatccctcaggctttcttgcgccgcttcaggcctgagtttcagctcctacgcaatgcattgggtacggcaggcccctgggaagggattggaatgggtggcggtcgtgtcttatgacggcaccacaaaattttacgctgattcggttaagggtcgcttcactatctcacgagacaacagcaaaaatacgttatatctgcagatgaacagtctacgtggggaggataccgccctctactattgtgcaaaggacctgagagaatacgagtgcgaagagtggacatccgattattacgactttggaaggccacagccgtgtattgattctcggggcgtggtcggcatacttgacatctggagccaagggactatggtgaccgtatcctca

SEQ ID NO: 24914 - RNA, 432 nt, synthetic construct
  misc_feature 1..432: note = derived and/or modified sequence opt3 from anti-HIV_cap256-119-003932_VR-Chain
  source 1..432: mol_type = other RNA
caggtgcaactgctcgagagcggcgggggagtcgttcagcccggtggctcccttagactgtcttgcaaggcctcacacttcagttttgacaggtacgggatgcattgggtgcggcaggctcctggaaaaggcttggaatgggtagcagccatcagcttcgatggtgcggacaagtatcacgctgataacgtgtgggggcgcttatccatttctcgagacaattcgaaatcaaccctgtacctacagatgaacagcctccgtccagaggatacagccgtctatttttgtgcaaaggacctgagagaagatgagtgcgaagagaggtggagtgactactatgatttcggaaaacaacttccgtgtcggaagtcccgcggcgtggccggcatatttgacaattgggggcagggaactatggttacggtgtctgct

SEQ ID NO: 24915 - RNA, 438 nt, synthetic construct
  misc_feature 1..438: note = derived and/or modified sequence opt3 from anti-HIV_cap256-119-003577_VR-Chain
  source 1..438: mol_type = other RNA
caggtgcaactggtcgagagcggcgggggaggtgttcagcccggcagatccctcaggctttcttgcgccgcttcagggttcacctttcggagttacgcaatgcactgggtgcgccaggcccctggaaagggcctggaatgggtagcggtgatcagcaacgacggtactaaaaagtatcatgctgagtccgtctgggatcgattctctatttcgaaagacaattcaaagaacacattgtttttacagatgaatagcctgcgtgtggaagatacggccctatacttctgtgttaaagaccaaagagaggatgaatgcgaggagtggtggagtgactattacgattttgggagggaactcccatgtcggaagtcccgcggactgggccttgcaggcatattcgacatgtgggggcacggaaccatggtgacagtctctagc

SEQ ID NO: 24916 - RNA, 432 nt, synthetic construct
  misc_feature 1..432: note = derived and/or modified sequence opt3 from anti-HIV_cap256-119-002155_VR-Chain
  source 1..432: mol_type = other RNA
ctgggcagactcgtggccagcgggggaggtgtcgttccccctggcaggtcccttcggctgtcttgcgtggcttcacagttcacctttagtgggtgtggattgcactgggtacgccaagtgccaggcaagggtttagagtgggtcgcaagcatctccttcgccgggacaaaaactcattacggaaactctgtgaagggccgattttcgatttcacgtgacaatagcataaacacggtttatctgcagatgaatagtctaagagcggaagataccgctctctactattgcgccaaagacctgagggagtacgaatgtgaggaatggacatccgattattacgacttcggccggccgcagccctgcatcgattctcgcggggtggtcggtattcttgacatctggagccagggaactatggtgaccgtatcctca

SEQ ID NO: 24917 - RNA, 432 nt, synthetic construct
  misc_feature 1..432: note = derived and/or modified sequence opt3 from anti-HIV_cap256-119-002017_VR-Chain
  source 1..432: mol_type = other RNA
caggtgcaactggtcgagagcggcgggggagttgtgcagcccggtagatccctcaggctttcttgcgccgcttcaggcttcacctttagttactatgggatccactgggtacggcaggcacctggaaagggcctggaatgggtggccagcatttcctacgacgagcgcgatttctatcatgcgcgatctgtctggggtcgttttgctatatcgagagacaacagcaaaaatacattgcacttacagatgaactcactgaggccagaagatactgccctatacttctgtgcacgggacctccgcgagagtgaatgcgaggagtgggaatcctattactatgattttgggaagaaaggaccgtgtgtgaagcccagaggcgttgtgggcgtcctggacatctgggggcaaggaacgcttgtgaccgtatctagc

SEQ ID NO: 24918 - RNA, 432 nt, synthetic construct
  misc_feature 1..432: note = derived and/or modified sequence opt3 from anti-HIV_cap256-119-001312_VR-Chain
  source 1..432: mol_type = other RNA
caggtgcaactgatggagagcggcgggggagtcgttcagcccggtagatccctcaggcttgcctgcgctgcatctggcttcaccttttcaagttacgccatccactgggtgcggcaggcgcctgggaagggactggaatgggtagctgccattagcttcgcaggcactaaaaagaactatgccgactccgtgcgcggtcgatttacaatatctcgtgattcgagcaaaaatacgttgtacttagagatgaactcactgagaccagaagacaccgctctatattactgtgcaaaggatatgagggggtatgagtgcgaagagtggacaagtgactactatgatttcggacggccgcagccctgtatcgactcccgcggcgtcgtgggcacttttgatgtttgggggcaaggaaccatggtgacagtctctagc

SEQ ID NO: 24919 - RNA, 438 nt, synthetic construct
  misc_feature 1..438: note = derived and/or modified sequence opt3 from anti-HIV_cap256-119-001017_VR-Chain
  source 1..438: mol_type = other RNA
cagatgcaactggtggagagcggcgggggagtcgttcagcccggtagatccctcaccctttcttgcgccgcttcacagttcagttttacaaactacggcatgcactgggtgaggcaggcacctgggaagggactggaatgggtagccagcatctccaatgacggcaacaaaaagtatcatggtgagtctgtgtgggatcggttcactatttcgcgcgacaatagcaaaaacacgttgtttttacaaatgaatcgactgcgtgtcgaagataccgcgctatacttctgtgtgaaggaccagagagaggatgaatgcgaggagtggtggtcagactattacgattttgggagggaactcccatgtcggaaattccgcggactgggccttgctggcatatttgacgtttgggggcacggaacaatggtgactgtcagttcc

SEQ ID NO: 24920 - RNA, 432 nt, synthetic construct
  misc_feature 1..432: note = derived and/or modified sequence opt3 from anti-HIV_cap256-119-000594_VR-Chain
  source 1..432: mol_type = other RNA
caggtgcaactggtcgagagcggcgggggactcgttcagcccggtacctcccttcggctgtcttgcgccgcttcagcattcacatttaagaactacggcatgcactgggtgaggcaggcccctgggaaaggattggactgggtagcgagtatcagctatgatggccgggacaagtaccattcctctttagtgtggggtcgcctgactatttcgcgagataattcaaaaagcacgctattcctccagatgaacagtctgcgtgctgaagacaccgccctttattactgtgcaagagatctgagggagtccgaatgcgaggaatggcaatctgactattacgccttttataagaaattgccatgtgtcaagccgagaggggtggctggaacactcgatatatggggccagggcactatggttaccgtgagctcc

SEQ ID NO: 24921 - RNA, 432 nt, synthetic construct
  misc_feature 1..432: note = derived and/or modified sequence opt3 from anti-HIV_cap256-059-241099_VR-Chain
  source 1..432: mol_type = other RNA
caggtgcaactggtcgagagcggcgggggagttgtgcagcccggtagatccctcaggctttcttgcgccgcttcaggcttcacctttagtagctacgggatgcactgggtacggcaggcacctggaaagggcctggaatgggtggccgtcatctcctatgacggttctaacaaatactatgtggattcggttcaggggcgcttcacaatttcacgagacaatagcaagaacactatgtttttgcaaatgaatagtttacgtacggaggataccgcggtgtactattgtgctagagacctgggagaatccgaggtcgaagagtgggccacagattactatgacttctctatagcatacccagtggagggcccgaggggcgtagttgggatctttgatatttggggacagggtactatggtgaccgtcagctcc

SEQ ID NO: 24922 - RNA, 432 nt, synthetic construct
  misc_feature 1..432: note = derived and/or modified sequence opt3 from anti-HIV_cap256-059-207529_VR-Chain
  source 1..432: mol_type = other RNA
caggtgcaactggtcgagagcggcgggggagttgtgcagcccggtagatccctcaggctttcttgcgccgcttcaggcttcacctttagtagctacgggatgcactgggtacggcaggcacctggaaagggcctggaatgggtggccggtatctccttcgcggggattaacaaatattacggaaattctgtcaagggccgctttacaatatcgcgagacaactcacgtaatactttgtatttacagatgaacagcctgagagctgaggatacggccctatactattgtgcaagggacctccgggaaatggagtgcgaagagtgggccagtgattactatgacttcggccgcgggggaccatgtcaagatccgagaggtgtggttggcacctttgacatctgggggcagggaacaatggtgactgtctcctct

SEQ ID NO: 24923 - RNA, 435 nt, synthetic construct
  misc_feature 1..435: note = derived and/or modified sequence opt3 from anti-HIV_cap256-059-205541_VR-Chain
  source 1..435: mol_type = other RNA
cagatgcaactggtggagagcggcgggggagtcgttcagcccggtggctccctcagactttcttgcgccgcttcagggttcagttttagctactatgcaatggactgggtgaggcaggcccctggaaagggcctggaatgggtagcgttcatctcctctgatggttcggacaaaaactacgctgattcagtgaaggggcggtttaccattagccgcgacaatagtaaaaacacattgtatttacagatgaactccctgcgagccgaggatactgcagtctactattgtgccaaggacgtgggaggccacaaaaatgatgaatgggctacgaattactattacgacatatctatcgcatacccaattcaagatccgcgtgccgttgctggcgccttcgacgtgtgggggcagggaaccatggtcacagtgagctcc

SEQ ID NO: 24924 - RNA, 432 nt, synthetic construct
  misc_feature 1..432: note = derived and/or modified sequence opt3 from anti-HIV_cap256-059-188439_VR-Chain
  source 1..432: mol_type = other RNA
caggtgcaactggtcgagagcggcgggggagttgtgcagcccggtagatccctcaggctttcttgcgccgcttcacagttcacctttagtaactacggcatgcactgggtacggcaggcacctgggaagggactggaatgggtggccgcgatcagcttcgctggcattaataaatattacacagactccgtcaagggtcgctttactatatctcgagataactcgaaaaatacgttgtatttacaaatgaactcactgcgtgccgaggacaccgcactatactattgtgccaaggatctcagagggttcgaatgcgaggaatgggctagcgactactatgattttggaagggacctgccatgtcaggatccgcggggcgtggttggcacattcgacgtgtgggggcagggaactaaagtcaccgtgagttcc

SEQ ID NO: 24925 - RNA, 432 nt, synthetic construct
  misc_feature 1..432: note = derived and/or modified sequence opt3 from anti-HIV_cap256-059-187234_VR-Chain
  source 1..432: mol_type = other RNA
caggtgcaactggtcgagagcggcgggggagttgtgcaggccggtagatccctcaggctttcttgcgctgcatcacagttcacctttggcagttacgggatgcactgggtacggcaggcccccggaaagggcctggaatgggtggcggctatcagcttcgccggtacaaaaattcattatgcagactccgtcaaggggcgctttactatatctcgagataactcgaaaaatgccttgtacttacaaatgcactcactgcgtgctgaggacacggcactatattactgtgccaaggatctcagagaatatgagtgcgaagagtgggctagcgactactatgatttcggaagggaccagccttgtcaggatccacggggcgtggttggcatctttgacatttgggggcagggaaccatggtgacagtcagttcc

SEQ ID NO: 24926 - RNA, 432 nt, synthetic construct
  misc_feature 1..432: note = derived and/or modified sequence opt3 from anti-HIV_cap256-059-187047_VR-Chain
  source 1..432: mol_type = other RNA
caggtgcaactggtcgagagcggcgggggagttgtgcagcccggtagatccctcaggctttcttgcgccgtatcacagctgaccttcagtagctacggcatgcactgggtgcggcaggctcctgggaagggattggaatgggtcgcagccatctcctttgtgggcattaaaaagtattacgcggactctgttaaaggtcgcttcacaatatcgcgagataactcaaagaatactttatatctgcaaatgaacagcctacgtgtggaggacacggctctctactattgtgccaaagatctgagagaatacgagtgcgaagagtgggcaagtgactattacgattttgggagggaccagccatgtcaggatgcccggggagtcgtgggcacctccgacatctggggccaggggacaatggtaactgtttctagc

SEQ ID NO: 24927 - RNA, 432 nt, synthetic construct
  misc_feature 1..432: note = derived and/or modified sequence opt3 from anti-HIV_cap256-059-186068_VR-Chain
  source 1..432: mol_type = other RNA
caggtgcaactggtcgagagcggcgggggagttgtgcagcccggtagatccctcaggctttcttgcgccgcttcacagttcagttttagcaactacggcatgcactgggtacggcaggcacctgggaagggactggaatgggtggccggcatctccttcgcggctaccaaaaagtattacgccgactctgtcaaaggtcgcttttcggtgtcacgagataatagcaagaacgcattgtatttacaaatgaatagtctgcgtgccgaggacacagctctatactattgtgcaagagatctcagggactacgaatgcgaggaatgggcctccgattattacgacttcgggcgggagtacccatgtcaggatccgcgcggagttgtgggcacttttgacatttggggccaggggacgatggtcaccgtgtctaca

SEQ ID NO: 24928 - RNA, 435 nt, synthetic construct
  misc_feature 1..435: note = derived and/or modified sequence opt3 from anti-HIV_cap256-059-182835_VR-Chain
  source 1..435: mol_type = other RNA
caggtgcaactggtcgagagcggcgggggactcgttcagcccggtagatcccttaggctgtcttgcgccgcttcaggcttcagttttaacaatttcgcaatggactgggtgcggcaggcccctgggaagggattggaatgggtagcgtttgtgagctccgatggctctaacaaaaattacgctgactcggtcaagggtcgcttcatcatttcacgagataacagcaaaaataccgtgtatttacagatgaacagtctgcgtgttgaggacacagccgtgtactattgtgcaaaggatctaggggccaataaagacgatgaatgggctactgactactattacgatctctccgtcgcaagaccagtgccggaccccagggccgtagttggagcttttgatgtgtggggccaaggcacgatggtcaccgtgtctagc

SEQ ID NO: 24929 - RNA, 432 nt, synthetic construct
  misc_feature 1..432: note = derived and/or modified sequence opt3 from anti-HIV_cap256-059-176659_VR-Chain
  source 1..432: mol_type = other RNA
agagtgcagctggtcgagagcggcgggggagttgtgcaacccggtaggtccctccggctttcttgcgccgcttcacagttcagttttagcaactacggcatgcactgggtacgccaggcacctgggaagggactggaatgggtggccggcatctccttcgcggctattaaaaagtattacgccgactctgtcaaaggtcgatttaccatatcgcgtgataattcaaagaacgcattgtatttacagatgaatagcctgagagccgaggacacagctctatactattgtgcaagggatctccgggaatacgagtgcgaagagtgggccagtgactattacgatttcgggcgcgagctgccatgtcaagacccgagaggagtggttggcacttttgatacgtggggccaggggaccatggtgacagtctccact

SEQ ID NO: 24930 - RNA, 432 nt, synthetic construct
  misc_feature 1..432: note = derived and/or modified sequence opt3 from anti-HIV_cap256-059-172956_VR-Chain
  source 1..432: mol_type = other RNA
caggtgcaactggtcgagagcggcgggggagttgtgcagcccggtagatccctcaggctttcttgcgccgcttcacagttcagttttagctcctacggcatgcactgggtacggcaggcacctgggaagggactggaatgggtggccgcgatgtctttcgctggcaccaaccaatattacgccgcatcggtcaaaggtcgctttacaatctcacgagacaatagcaagaacactttgtatttacatatgaatagtctgcgtccagaggatacggccctatactattgtgctagagacctcagggaatacgagtgcgaagagtgggcagccgattattacgacttcgggcgggagtacccgtgtcaggatccccgcggagtggttggcatttttgacgtgtggggccaggggaccctggtcacagtgtcctct

SEQ ID NO: 24931 - RNA, 432 nt, synthetic construct
  misc_feature 1..432: note = derived and/or modified sequence opt3 from anti-HIV_cap256-059-171272_VR-Chain
  source 1..432: mol_type = other RNA
caggtgctgctcgtcgagagcggcgggggagttgtgcaacccggtagatcccttaggctgtcttgcgccgcttcacagttcacctttagtaattacggcatgcactgggtacggcaggcacctgggaagggattggaatgggtggccgcgatcagcttcgctggcatgaaaaagtattacgccgactccgtcaaaggtcgctttacaatttctcgagataattcgaagaacactttatatctgcagatgaactcactacgtgcagaggacacggccctctactattgtgctaaagatctgagagagttcgaatgcgaagagtgggcaagcgactactatgattttgggagggcccaaccatgtcaggacccgcggggagtggttggcaccttcgatctttggggccaggggacaatggtgactgtcagttcc

SEQ ID NO: 24932 - RNA, 432 nt, synthetic construct
  misc_feature 1..432: note = derived and/or modified sequence opt3 from anti-HIV_cap256-059-168734_VR-Chain
  source 1..432: mol_type = other RNA
caggtgcaactggtcgagagcggcgggggagttgtgcagcccggtagatccctcaggctttcttgcaccgcctcacagttcagttttagctcctacggcatgcactgggtacggcaggctcctgggaagggactggaatgggtggcagccatctctttcgcgggcactaaaaagtattacgtcggtacagtgaaagggcgctttacgatttcgcgagacaactcaaagaataccttgtatttacaaatgaacagcctgcgtgctgaggatacagccctatactattgtgcaaaagacatgagagaatacgagtgcgaagagtgggccagtgattattacgacttcggaagggagtacccatgtcaggatccgcggggcgttgtgggcacttttgacatatgggggcagggaaccatggtcacagtgtcctct

SEQ ID NO: 24933 - RNA, 432 nt, synthetic construct
  misc_feature 1..432: note = derived and/or modified sequence opt3 from anti-HIV_cap256-059-155838_VR-Chain
  source 1..432: mol_type = other RNA
caggtgcaactggtcgagagcggcgggggagttgtgcagcccggtagatccctcaggctttcttgcgccgtatcacagttcacctttagtaactacggcatgcactgggtgcggcaggctcctgggaagggactggaatgggtcgcagccatcagcttcgcgggcactaaaaagtcctatgctgcctctgtgaaaggtcgctttacaatttcgcgagacaattcaaagaacacgttgtacttacaaatgaatagcctgcgtccagaggataccgcactatattactgtgccaaagacatgagagggttcgaatgcgaggaatgggctagtgattattacgactttggaagggagcagccgtgtcaggatccccggggcgttgtgggcatattcgacctctgggggcagggaacaatggtctccgtgtctagc

SEQ ID NO: 24934 - RNA, 432 nt, synthetic construct
  misc_feature 1..432: note = derived and/or modified sequence opt3 from anti-HIV_cap256-059-149799_VR-Chain
  source 1..432: mol_type = other RNA
caggtgcacctggtcgagagcggcgggggagttgtgcaacccggtagatccctcaggctttcttgcgccgcttcacagttcacctttagtaactacggcttccattgggtacggcaggcacctgggaagggactggaatgggtggccgcgatcagctttgctggcgtcaaaaagcactatgccgactccgtgaaaggtcgcttcacaatttctcgagataattcgaagaacactttgtacttacagctaaattcactgcgtgcagaggacacggccctctattactgtgctaaagatctgagagaatatgagtgcgaagagtgggcaagcgactactatgattttgggagggacttcccatgtcaagatccgcggggagttgtgggcacctttgacatatggggccaggggacaatggtcactgtgagttcc

SEQ ID NO: 24935 - RNA, 432 nt, synthetic construct
  misc_feature 1..432: note = derived and/or modified sequence opt3 from anti-HIV_cap256-059-148168_VR-Chain
  source 1..432: mol_type = other RNA
caggtgcaactggtcgagagcggcgggggagttgtgcagcccggtagatccctcaggctttcttgcaccgcctcacagttcacatttagtaactacggcatgcactgggtacggcaggctcctgggaagggactggaatgggtggcaggcatcagcttcgccgcgactaaaaagtattactccgactctgtcaaaggtcgctttacgatttcgcgagataattcaaagaacgctttgtatttacaaatgaatagcctgcgtgccgaggacaccgcactataccattgtgccaaagatctcagagaatatgagtgcgaagagtgggctagtgactactatgatttcgggagggagcagccatgtcaggacccgcggggagtggttggcacatttgatatatggggccaggggactatggtgaccgtctccaca

SEQ ID NO: 24936 - RNA, 435 nt, synthetic construct
  misc_feature 1..435: note = derived and/or modified sequence opt3 from anti-HIV_cap256-059-144685_VR-Chain
  source 1..435: mol_type = other RNA
caggtgcacctggtcgagagcggcgggggagttgtgcaacccggtagatccctcaggctttcttgcgccgcttcaggcttcacctttagtaacttcgcaatggactgggtacggcaggcccctgggaagggactggaatgggtggcgtttgtcagctccgatggcaataacaaaaattacggtgactctgtgaaggggcgcttcacaatctcgcgagataacagcaaaaatactttgtttttacagatgaactcactgcgtgctgaggacacggccctatattactgtgttaaggatgtgggagactataaaagtgatgaatgggcaacccattactattacgacctctccattgccgatccaatacaggacccgagagctgtcgtgggcgcattcgatatctggggcagggggacaatggtagccgtttctagc

SEQ ID NO: 24937 - RNA, 432 nt, synthetic construct
  misc_feature 1..432: note = derived and/or modified sequence opt3 from anti-HIV_cap256-059-140017_VR-Chain
  source 1..432: mol_type = other RNA
caggtgcaactggtcgagagcggcgggggagttgtgcagcccggtagatccctcaggctttcttgcgccgcttcacagttcagttttggcaacttcgggatgcactgggtacggcaggcacctggaaagggcctggaatgggtggccggtatcagctttgcggggaccaaaaagtactatgctgactccgtcaaaggacgcttcacaatttctcgagataattcgaagtcagccttgtttttacaaatgaacagcctgcgtgcagaggacactgccctatactattgtgctaaagatctcagatactatgaatgcgaggaatgggcaagtgactactatgatttcggcagggaccagccatgtcaggatccgcggggcgtggttgggacgtttgacatgtggggacagggtaccatggtgacagtctcctct

SEQ ID NO: 24938 - RNA, 432 nt, synthetic construct
  misc_feature 1..432: note = derived and/or modified sequence opt3 from anti-HIV_cap256-059-137547_VR-Chain
  source 1..432: mol_type = other RNA
caggtgcaactggtcgagagcggcgggggagttgtgcagcccggtagatccctcaggctttcttgcgccgcttcacagttcacctttagtcggtacggcatgcactgggtacgccaggcacctgggaagggactggaatgggtggccgcgatcagcttcgctggcattaaaaagaattatgccgactccgtcaaaggtcgatttacaatatctcgtgataattcgaagaacactttgtacttacaaatgaactcactgagagcagaggacacggccctatattactgtgctagggatctccgggagttcgaatgcgaagagtgggcaagcgactattacgattttgggcgcgacttcccatgtcaggatccgagaggagtggttggcatctttgacatttggggccaggggaccatggtgacagtcagttcc

SEQ ID NO: 24939 - RNA, 435 nt, synthetic construct
  misc_feature 1..435: note = derived and/or modified sequence opt3 from anti-HIV_cap256-059-131908_VR-Chain
  source 1..435: mol_type = other RNA
caggtgcaactggtcgagagcggcgggggagttgtgcagcccggtagatccctcaggctttcttgcaccgcctcaggcttcacatttagtaactacgggatccactgggtacggcaggctcctggaaagggcctggaatgggtggcagccattagctatgagggttccataaaatactatgtcgactctgtgaaggggcgcttcactatctcgcgagatgacagcaaaaatacgttgtttttacagatgaactcactgcgtaccgaagatacagcggtttactattgtactagagacgtgagggagtgggaaaccgaggagtgggctacaaattactattacgatctaagtattgcctacccaatccggcatccgcgcggagtcgtgggcattttcgacgtatggggcctcgggaccagagttactgtgtcctct

SEQ ID NO: 24940 - RNA, 432 nt, synthetic construct
  misc_feature 1..432: note = derived and/or modified sequence opt3 from anti-HIV_cap256-059-116006_VR-Chain
  source 1..432: mol_type = other RNA
caggcccaactggtggaaagcggcgggggagtcgttcagcccggtagatccctcaggctttcttgcgctgcatcacagttcagttttagctcctacggcatgcactgggtgcggcaggcccctgggaagggactggaatgggtagcgtctatctcgttcgctggcgtgaaaaagaccaacgccgactcagtcaaaggtcgctttacaattagccgagataatagtaagaacactttgcatttacaaatgaatgggctgcgtaacgacgatacggcactatattactgtgccagagacctcagggatttcgagtgcgaagagtgggcttccgactattacgattttggacgggagttcccatgtcaggacccgcgcggcgtggttggcacctttgatatatgggggcagggaacaaaagtgactgtctctagc

SEQ ID NO: 24941 - RNA, 411 nt, synthetic construct
  misc_feature 1..411: note = derived and/or modified sequence opt3 from anti-HIV_cap256-059-115783_VR-Chain
  source 1..411: mol_type = other RNA
caggtgcaactggtcgagagcggcgggggagttgtgcagcccggtcggtccctcaggctttcttgcgccgcttcacagttcacctttagtagctacggcatgcactgggtacggcaggcacctgggaagggactggaatgggtggccgcgatctcctatgctgactctgtcaaaggccgcttcacaatttcgcgagataactcaaagaatactttgtacttacaaatgaacagcctgcgtgccgaggacacggcactatattactgtgccaaagatctcagagaaatggagtgcgaagagtgggctagtgactattacgattttggtagggacctgccatgtcaggatccgagaggggtggttggaacccttgacatatggggccagggcacaatggtgactgtctcctct

SEQ ID NO: 24942 - RNA, 432 nt, synthetic construct
  misc_feature 1..432: note = derived and/or modified sequence opt3 from anti-HIV_cap256-059-114609_VR-Chain
  source 1..432: mol_type = other RNA
caggtgcaactggtcgagagcggcgggggagttgtgcagcccggtagatccctcaggctttcttgcgccgcttcacagctgaccttcagtaactttggcatgcactgggtacggcaggcacctgggaagggattggaatgggtggccggcatcagcttcgcgggtactaaaaagtactatgctgactccgtcaaagggcgctttacaatttctcgagataattcgaagaacgccttatacctgcaaatgaatacgctacgtgcagaggacaccgccctctatttctgtgctaaagatctgagagaatacgagtgcgaagagtgggcatcagactattacgattttggaagggaccagccatgtcaggatccgcggggcgtggttggcatattcgacatctgggggcagggaacaatggtgactgtcagcagt

SEQ ID NO: 24943 - RNA, 432 nt, synthetic construct
  misc_feature 1..432: note = derived and/or modified sequence opt3 from anti-HIV_cap256-059-113952_VR-Chain
  source 1..432: mol_type = other RNA
caggcccaactggtggagagcggcgggggagtcgttcagcccggtagatccctcaggctttcttgcgctgcatcacacttcacctttagtagctacggcttccattgggtgcggcaggcccctgggaagggactggaatgggtagcgggcatctcctttgctgccactaaaaagtattacgcagactctgtgaaaggtcgcttcacaatttcgcgagataactcaaaggacgccttgtatttacagatgaatagcctgcgtgctgaggatacggcactatactattgtgccagagacctcagggggtacgaatgcgaggaatgggctagtgattattacgactttggacgggatcaaccatgtcaggacccgcgcggcgtcgtgggcatattcgatctgtgggggcagggaaccatggttacagtgtcctct

SEQ ID NO: 24944 - RNA, 432 nt, synthetic construct
  misc_feature 1..432: note = derived and/or modified sequence opt3 from anti-HIV_cap256-059-113878_VR-Chain
  source 1..432: mol_type = other RNA
caggtgcaactggtcgagagcggcgggggagttgtgcagcccggtagatccctcaggctttcttgcgccgcttcaggcttcacctttagtacatacgcaatgcactgggtacggcaggcccctgggaagggactggaatgggtggcgttgatcagctatgacgctactaacaaatactatgtcgattccgtgaagggccgcttcacgatttctcgagacaattcgaaaaacaccttatacctgcagatgtcaagcctaacagccgaggatactgcagtttattactgtgccaaggacctcggtgggataaaaatcgatgaatggggaaccgactattacgatattagtgtgtcctacccagtccaagacccgcgtgctgtggcaggcatctttgatgtatggggccatgggacaatggtttctgtgagctcc

SEQ ID NO: 24945 - RNA, 432 nt, synthetic construct
  misc_feature 1..432: note = derived and/or modified sequence opt3 from anti-HIV_cap256-059-113622_VR-Chain
  source 1..432: mol_type = other RNA
caggtgcaactggtcgagagcggcgggggagttgtgcagcccggtagatccctcaggctttcttgcgccgcttcacagttcacctttacaagttacggcatgcactgggtacggcaggcacctgggaagggactggaatgggtggccggcatcagcttcgcgggtactaaaaagcattatgctgactccgtcaaagggcgctttacgatttctcgagataactcgaagtcaaccttgtacttacaaatgaatagcctgcgtgccgaggacacagcactatattactgtgccaaagatatgagagaatatgagtgcgaagagtgggctagtgactactatgatttcggaagggaccagccatgtcaggatccgcggggcgtggttggcatatttgacctctgggggcagggaactatggtgaccgtctcctct

SEQ ID NO: 24946 - RNA, 432 nt, synthetic construct
  misc_feature 1..432: note = derived and/or modified sequence opt3 from anti-HIV_cap256-059-109427_VR-Chain
  source 1..432: mol_type = other RNA
caggtgcaactggtcgagagcggcgggggagttgtgcagcccggtagatccctcaggctttcttgcgccgcttcacagttcacctttagtaactacggcatgcactgggtacggcaggcacctgggaagggactggaatgggtggccagcatctccttcgcgggcattaaaaagcattatacagactctgtcaaaggtcgctttactatatcgcgagataattcaaagaacacgttgttcttacaaatgaatagcctgcgtgctgaggacaccgccctatactattgtgcaagagatctcagggaatacgagtgcgaagagtgggccagtgactattacgattttgggcgggaccagccatgtcaggatccgcgcggagtggttggcacatccgacatctggggccaggggactaaagtgaccgtctctagc

SEQ ID NO: 24947 - RNA, 432 nt, synthetic construct
  misc_feature 1..432: note = derived and/or modified sequence opt3 from anti-HIV_cap256-059-109081_VR-Chain
  source 1..432: mol_type = other RNA
caggagcaactggtggaaagcggcgggggagtcgttcagcccggtagatccctcaggctttcttgcgccgcttcacagttcagttttagcgcatacggcatgcactgggtgcggcaggcccctgggaagggactggagtgggtagcgggcatctccttcgctgccaccaaaaagtattacgaagactctgtgaaaggtcgctttacaatttcgcgagataactcaaagaatactttgtatttacaaatgaacagcctgcgtggggaggacacggcactatactattgtgccaaagatatgagagaaatggagtgcgaggaatgggctagtgactactatgatttcggaaggccacagccgtgtcaggacccccggggcgtcgtgggcatatttgatatgtgggggcagggaaccatggttacagtgtcctct

SEQ ID NO: 24948 - RNA, 432 nt, synthetic construct
  misc_feature 1..432: note = derived and/or modified sequence opt3 from anti-HIV_cap256-059-107590_VR-Chain
  source 1..432: mol_type = other RNA
caggagcaactggtggaaagcggcgggggagtcgttcagcccggtagatccctcaggctttcttgcgccgcttcacagttcagtatcagcgcatacggcatgcactgggtgcggcaggcccctgggaagggactggagtgggtagcgggcatttcctttgctggtaccaaaaagtattacgccgactctgtgaaagggcgcttcacaatatcgcgagataactcaaagaatactttgtatttacaaatgaacagcctgcgtggagaagacacggcactatactattgtgccaaagatatgagagagatggaatgcgaggagtgggctagtgactactatgattttggcagggaccagccatgtcaggatccgcggggcgtcgtggggatcttcgacatgtggggacagggtaccatggttacagtgtcctct

SEQ ID NO: 24949 - RNA, 435 nt, synthetic construct
  misc_feature 1..435: note = derived and/or modified sequence opt3 from anti-HIV_cap256-059-107504_VR-Chain
  source 1..435: mol_type = other RNA
caggtgctgctcgtcgagagcggcgggggagttgtgcaacccggtaagtcccttcggctgtcttgctcagccagtaggttcacctttagcaactacggcatgcactgggtacggcaggctcctgggaaaggattggaatgggtggcagccgtctccttcgcgggcatcaagaaaacaaatgctgactctgtgaagggtcgctttactatttcgcgagataacagcaaaaatacgttatatctgcagatgaactcactacgtgccgaggacaccgcactctactattgtgccagagatctgagggacttcgaatgcgaggaatgggctagtgattactatgacttttggggagatccacagccgtgtcaagaccccagaggggttgtgggcacattcgatctttggggccaggggactatggtcaccgtgtcctct

SEQ ID NO: 24950 - RNA, 432 nt, synthetic construct
  misc_feature 1..432: note = derived and/or modified sequence opt3 from anti-HIV_cap256-059-099614_VR-Chain
  source 1..432: mol_type = other RNA
gaggtgctgctccttgaaagcggcgggggactggtccagcccggtagatccttgaggttatcttgcgccgcttcacaattcacctttagtagctacggcatgcactgggttcggcaggcacctgggaagggactggagtgggtggccggcatctccttcgtaggtattaaaaagtattacgcggactctgtgaaagggcgctttacaatatcgcgagataactcaaagaatactctatatctccagatgaacagcctgcgtgctgaagacacggccctttactattgtgcaagagatctgagggagtacgaatgcgaggagtgggccagtgactattacgatttcggacgggaccagccatgtcaagatccgcgcggcgtcgtgggcacctttgacatctgggggcagggaacaatggttactgtgtcctct

SEQ ID NO: 24951 - RNA, 432 nt, synthetic construct
  misc_feature 1..432: note = derived and/or modified sequence opt3 from anti-HIV_cap256-059-098972_VR-Chain
  source 1..432: mol_type = other RNA
caggtgcaactggtcgagagcggcgggggagttgtgcagcccggtagatccctcaggctttcttgcgccgcttcacagttcacctttagtagctacggcatgcactgggtacggcaggcacctgggaagggactggaatgggtggcctccatctctttcgcgggcattaaaaagaactatcgcgactcggtcaaaggtcgatttacaatatcacgtgataatagcaagaacactttgtacttacaaatgacgagtctgagaccagaggacaccgctctatattactgtgccaaagatctcagggggttcgaatgcgaggaatgggcatccgactattacgattttggacgggagctgccgtgtcaggacccccgcggcgtggttggcacattcgatatgtgggggcagggaactatggtgaccgtctctagc

SEQ ID NO: 24952 - RNA, 432 nt, synthetic construct
  misc_feature 1..432: note = derived and/or modified sequence opt3 from anti-HIV_cap256-059-097236_VR-Chain
  source 1..432: mol_type = other RNA
caggtgcaactggtcgagagcggcgggggagttgtgcagcccggtagatccctcaggctttcttgcgccgcttcaggcttcagttttagcaacttcgggtttcactgggtacggcaggcacctggaaagggcctggaatgggtggccgcgatctccttcgtcggtaataaaaagtactatgctgagtctgtgaaagggcgctttaccatttcgcgagaaaactcaaagaatatgttgttcttacagatgaacagcctgcgtggagaggacacagccgtttactattgtgcaaaagatctaagagaatttgagtgcgaggaatgggccagtgactactatgatttcggcagggagcaaccatgtcaggacccgcggggcgtggtcgggtccatagatgtgtggggacatggttctctcgtaactgttagctcc

SEQ ID NO: 24953 - RNA, 432 nt, synthetic construct
  misc_feature 1..432: note = derived and/or modified sequence opt3 from anti-HIV_cap256-059-091487_VR-Chain
  source 1..432: mol_type = other RNA
caggtgcaactggtcgagagcggcgggggagttgtgcagcccggtagatccctcaggctttcttgcgccgcttcacagttcacctttaaccggtacggcatgcactgggtacgccaggcacctgggaagggactggaatgggtggccgtcatcagttatgacggcacaaataaatactatggtgagagcgtgaaggggcgattcactatttcccgtgataactctaaaaatacgttgtacttacaaatgaactcgctgagagcggaagacaccgctctatattactgtgccaaggatctcagggaggacgaatgcgaggagtggtggtcagattattacgactttggacgggaactgccatgtcgcaaaagcagaggcgttgcaggcatattcgatatctgggggcagggaacaatggtgactgtcagttcc

SEQ ID NO: 24954 - RNA, 432 nt, synthetic construct
  misc_feature 1..432: note = derived and/or modified sequence opt3 from anti-HIV_cap256-059-089812_VR-Chain
  source 1..432: mol_type = other RNA
caggtgcaactggtcgagagcggcgggggagttgtgcagcccggtagatccctcaggctttcttgcgccgcttcacagctgaccttcagtagctacggcatgcactgggtacggcaggcacctgggaagggattggaatgggtggccggcatctcctttgcgggtactaaaaagcattattctgactcggtcaaagggcgcttcacaatttcacgagataacagcaagaatgctttatacctgcaaatgaacagtctacgtgccgaggacacggcactctattactgtgccaaagatctgagagaatatgagtgcgaagagtgggcttccgactactatgattttggaagggagcagccatgtcaggacccgcggggcgtggttggcatattcgatatgtgggggcagggaaccatggtgacagtctctagc

SEQ ID NO: 24955 - RNA, 432 nt, synthetic construct
  misc_feature 1..432: note = derived and/or modified sequence opt3 from anti-HIV_cap256-059-088468_VR-Chain
  source 1..432: mol_type = other RNA
caggtgcaactggtcgagagcggcgggggagttgtgcagcccggtagatccctcaggctttcttgcgccgcttcacagttcacctttagtagctacggcatgcactgggtacggcaggcacctgggaagggactggaatgggtggccgcgatctccttcgtcggcattaaaaagtattacgctaactctgtgaaaggtcgctttacaatatcgcgagacaattcaaagaacactttgtatttacaaatgaatagcctgcgtgccgaggatacggcactatactattgtgccagagacctcagggaatacgagtgcgaagagtgggctagtgattattacgacttcgggcggggaggcccatgtcaggatccgcgcggcgttgtggggtcctttgacatctggggacagggtaccatggtcacagtgtctagc

SEQ ID NO: 24956 - RNA, 432 nt, synthetic construct
  misc_feature 1..432: note = derived and/or modified sequence opt3 from anti-HIV_cap256-059-088341_VR-Chain
  source 1..432: mol_type = other RNA
caggtgcaactggtcgagagcggcgggggagttgtgcagcccggtagatccctcaggctttcttgcgccgcttcacagttcacctttagtagctacggcatgcactgggtacggcaggcacctgggaagggactggaatgggtggccgcgatctccttcgctggcattaaaaagcattatgccgactctgtcaaaggtcgctttacaatatcgcgagataactcaaagaatatggtgttcttgcaaatgaacagcttacgtgcagaggacactgccctgtactattgtgctagagatctaagggaatacgagtgcgaagagtgggcaagtgactattacgattttgggcgggaccagccatgtcaggatccgcgcggagttgtgggcacgtccgacatctggggccaggggaccatggtcacagtgtctagc

SEQ ID NO: 24957 - RNA, 432 nt, synthetic construct
  misc_feature 1..432: note = derived and/or modified sequence opt3 from anti-HIV_cap256-059-086533_VR-Chain
  source 1..432: mol_type = other RNA
caggtgctgctcgtcgagagcggcgggggagttgtgcaacccggtagatcccttaggctgtcttgcgccgcttcacagttcacctttagtaatttcggcatgcactgggtacggcaggcacctgggaagggattggaatgggtggccggcatcagctttgtcggtattaaaaagtactatgcggggtccgtgaaaggacgcttcacaatatctcgagacaattcgaagaacactttatacctgcagatgaactcactacgtgctgaggatacggccctctattactgtgcaaaagacctgagagaatttgagtgcgaagagtgggccagcgattattacgacttcggcaggccacaaccgtgtcaggatccccggggcgttgtggggacctttgacctttggggactgggtacattggtcactgtgagttcc

SEQ ID NO: 24958 - RNA, 432 nt, synthetic construct
  misc_feature 1..432: note = derived and/or modified sequence opt3 from anti-HIV_cap256-059-086043_VR-Chain
  source 1..432: mol_type = other RNA
gaggtgcacctggtcgaaagcggcgggggactcgttaagcccggtggctcccttagactgtcttgcgccgcttcagggttcacctttagtacatacagcatgaactgggtgaggcaggcacctggaaaaggcttggagtgggtagccttcgtggcgtttgacgaatccgataagtattacgctgactctgtcaaaggtcggttcactatctcgcgcgataattcaaagaacacgttaagcctgcaaatgaatagtctacgagtggaggacaccgccatttattactgtgcaaaagaagttggggataacaaggacgatgagtgggcctccgactattacgatctctctatagcttatccaatccaggacccgcgtgcagtgggaagaggctacgatatttggggccaggggacaatggtcactgtgagctcc

SEQ ID NO: 24959 - RNA, 432 nt, synthetic construct
  misc_feature 1..432: note = derived and/or modified sequence opt3 from anti-HIV_cap256-059-084191_VR-Chain
  source 1..432: mol_type = other RNA
caggtgcaactggtcgagagcggcgggggagttgtgcagcccggtagatccctcaggctttcttgcgccgcttcacagttcacctttagtagctacggcatgcactgggtacggcaggcacctgggaagggactggaatgggtggccgcgatctccttcgtcggcattaaaaagtattacgctgactctgtgaaaggtcgctttacagtttcgcgagataactcaaagagcactttgtatttacaaatgaatagtctgcgtgccgaggacacggcactatactattgtgccagagatctcagggaatacgagtgcgaagagtgggcttccgactattacgatttcgggcgggaccagccatgtcaggatccgcgcggagtggtcggcatatttgacatctggggccaggggaccgcagtgacagtatctagc

SEQ ID NO: 24960 - RNA, 417 nt, synthetic construct
  misc_feature 1..417: note = derived and/or modified sequence opt3 from anti-HIV_cap256-059-082135_VR-Chain
  source 1..417: mol_type = other RNA
caggtgcaactggtcgagagcggcgggggagttgtgcagcccggtagatccctcaggctttcttgcaccgcctcaggcttcacatttcggagttacgctatccactgggtacgccaggcacctgggaagggactggaatgggtggccttgattagctatgacggctccaacaaatactatgcggattctgtcaagggtcgattcactatatcgcgtgacaattcaaagaacacgttatacctgcagatgaatagcctaaccagtgaggatacagctgtgtattactgtgccaaagacctcgggggatccaaaactgatgaatggggcaccgactattgctacccagttcaagatccgagagtggtcgtgggcgcatttgacatctgggggcatggaacaatggtaaccgtttctagc

SEQ ID NO: 24961 - RNA, 432 nt, synthetic construct
  misc_feature 1..432: note = derived and/or modified sequence opt3 from anti-HIV_cap256-059-079417_VR-Chain
  source 1..432: mol_type = other RNA
caggtgcaactggtcgagagcggcgggggagttgtgcagcccggtagatccctcaggctttcttgcgccgcttcaggcttcagttttagcaactacgcaatggactgggtacggcaggcccctgggaagggactggaatgggtggcgttcgtctcctctgatggcaataacaaaaagtatgctgactcggtgaaaggtcgctttaccttgtcacgagataattacaagaacacagtttatttacagatgaatagcctgactgtggaggacacggccgtctactattgtgcaaaagatctaggggccaacaaggacgatgaatggggaaccgactactatgatatgagtgtgtcctacccaatcccggacccccgtgctgtagttggcgcattcgatgtgtggggccaagggacactcgtcactgtgtctagc

SEQ ID NO: 24962 - RNA, 435 nt, synthetic construct
  misc_feature 1..435: note = derived and/or modified sequence opt3 from anti-HIV_cap256-059-076027_VR-Chain
  source 1..435: mol_type = other RNA
caggtgcaactggtcgagagcggcgggggagttgtgcagcccggtagatccctcaggctttcttgcgccgcttcaggcttcagttttagcaagtacgggatgcactgggtacggcaggcacctggaaaaggcctggaatgggtggccttcgtcgcgtttgacgagtccgaaaagtattacgctgcctctgtgaaaggtcgcttcaccatctcgcgagataactcaaagaatacattgagcttacagatgaacagtctgcgtactgaggacacggcaatttattactgtgccaaagaagttggggataataaggacgatgagtggacctccccatattactatgacatatctatcgcttacccggtgcatgatcccagagcagtcgtgggagtaagcgacgtttggggccaaggcacaatggtgactgtctcctca

SEQ ID NO: 24963 - RNA, 432 nt, synthetic construct
  misc_feature 1..432: note = derived and/or modified sequence opt3 from anti-HIV_cap256-059-075082_VR-Chain
  source 1..432: mol_type = other RNA
caggtgcaactggtcgagagcggcgggggagttgtgcagcccggtagatccctcaggctttcttgcgccgcttcacagttcacctttagtagctacggcatgcactgggtacggcaggcacctgggaagggactggaatgggtggccgcgatctccttcgtcggcattaaaaagtattacgctgactctgtgaaaggtcgctttacaatatcgcgagataactcaaagaatactttgtatttacaaatgaacagcctgcgtgccgaggacacggcactatactattgtgccaaagatctcagagaaatggagtgcgaagagtgggctagtgactactatgatttcgggagggacctgccatgtcaggatccgcggggagttgtgggcacccttgacatctggggccaggggacaatggtcactgtgtcctct

SEQ ID NO: 24964 - RNA, 432 nt, synthetic construct
  misc_feature 1..432: note = derived and/or modified sequence opt3 from anti-HIV_cap256-059-072575_VR-Chain
  source 1..432: mol_type = other RNA
cagggccaactggtggagagcgggggaggtgtcgttcagcccggcagatccctcaggctttcttgcgccgcttcacagttcacctttagtaatttcgggatgcactgggtgcggcaggcacctggaaagggcctggaatgggtagccgtgatcagctacgacggtactaaaaagtattacgcggattccgtcaaagggcgctttacaatttctcgagacaattcgaagaacacgttgtatttacaaatgaactcactgcgtgctgaggataccgccctatactattgtgcaaaagacatgagagaagatgagtgcgaagagtggggagccgactactatgatttcggcaaggactacccatgtcaggctagcaggggcgtggttgggatatttgatatctggggacagggtacaatggtgactgtcagtgca

SEQ ID NO: 24965 - RNA, 432 nt, synthetic construct
  misc_feature 1..432: note = derived and/or modified sequence opt3 from anti-HIV_cap256-059-071926_VR-Chain
  source 1..432: mol_type = other RNA
caggtgcaactggtcgagagcggcgggggagttgtgcagcccggtagatccctcaggctttcttgcgccgcttcacagctgagtttcagcaactacggcatgcactgggtacggcaggcacctgggaagggattggaatgggtggccggcatctcctttgtcggtattaaaaagtattaccgcgactctgtgaaagggcgattcaccatatcgcgtgataattcaaagaacacattatatctgcaaatgaatagcctaagaactgaggacacggcgctctactattgtgttaaagatctgagggaatttgagtgcgaagagtgggctagtgactactatgatttcggacgggaccagccatgtcttgatccgcgcggcgtggtcggcacctttgacatctgggggcagggaacaatggtgactgtatcctct

SEQ ID NO: 24966 - RNA, 432 nt, synthetic construct
  misc_feature 1..432: note = derived and/or modified sequence opt3 from anti-HIV_cap256-059-069638_VR-Chain
  source 1..432: mol_type = other RNA
caggtgcaactggtcgagagcggcgggggagttgtgcagcccggtagatccctcaggctttcttgcgccgcttcaggcttcacctttagtaagaacgcaatgcactgggtacggcaggcccctgggcgcggactggaatgggtggcgagcgtcgctttcgacggctccgataaatactatgccgactctgtgaagggtcgatttacaatctcgcgtgataatagcaaaaacactttgtcattacagatgaatagtctgagagcagaggacacggccgtttactattgtgctaaggaagtggatctatacaaagacgatgagtgggggtccgactattacgatctctctattgcatatccaatacaagacccgagggccgtcgtgggaggcttcggcatctgggggcagggaaccatggtaacagttagctcc

SEQ ID NO: 24967 - RNA, 432 nt, synthetic construct
  misc_feature 1..432: note = derived and/or modified sequence opt3 from anti-HIV_cap256-059-069165_VR-Chain
  source 1..432: mol_type = other RNA
ctggtgcagctcgtcgagagcggcgggggagttgtgcaacccggtagatcccttaggctgtcttgcgccgcttcacggttcacctttagtaattacggcatgcactgggtacgccaggcacctgggaagggattggaatgggtggccggcatcagcttcgcgggtacaactaaatattacgctgactccgtccgagggcgttttacgatttctagagataattcgaagaacaccttatatctgcagatgaactcactaagggccgaggacacagcactctactattgtgccaaagatatgcgggaaatggagtgcgaagagtgggctagcgactactatgatttcggacgcccacagccgtgtcaagaccccagaggcgtggttggcatatttgatatctgggggcagggaactatggtgaccgtcagttcc

SEQ ID NO: 24968 - RNA, 432 nt, synthetic construct
  misc_feature 1..432: note = derived and/or modified sequence opt3 from anti-HIV_cap256-059-068956_VR-Chain
  source 1..432: mol_type = other RNA
caggtgcaactggtcgagagcggcgggggagttgtgcagcccggtagatccctcaggctttcttgcgccgcttcaggcttcacctttagtacatacgcaatgcactgggtacggcaggcccctgggcgcggactggaatgggtggcgttgatcagctatgacggctccaacaagtactatgtcgattctgtgaaaggtcgattcactatttcgcgtgacaattcaaagaacacgttatacctgcagatgaatagcctaaccgctgaggatacagccgtttattactgtgcaaaagacctcgggggaagtaaggatgacgaatgggccactgattattacgacctgtccatagcttacccaatccaagatccgagagcagtggccggcatttttgacgtctggggcagggggaccgtggtaacagtttctagc

SEQ ID NO: 24969 - RNA, 432 nt, synthetic construct
  misc_feature 1..432: note = derived and/or modified sequence opt3 from anti-HIV_cap256-059-068876_VR-Chain
  source 1..432: mol_type = other RNA
caggtgcaactggtcgagagcggcgggggagttgtgcagcccggtagatccctcaggctttcttgcgccgcttcacagttcacctttagtagctacggcatgcactgggtacggcaggcacctgggaagggactggaatgggtggccgcgatctccttcgctggcactaaaaagtattacgccaactctgtcaaaggtcgctttacaatttcgcgagacaattcaaagaacacgttgagcttacaaatgaatagtctgcgtggggaggataccgcaagatattactgtgccagggacccacgggaatatgagtgcgaagagtgggcttccgattactatgacttcggacgcgatcagccgtgtcaggaccccagaggcgtgataggcatctttgatatttgggggcagggaacaatggttactgtgtctagc

SEQ ID NO: 24970 - RNA, 432 nt, synthetic construct
  misc_feature 1..432: note = derived and/or modified sequence opt3 from anti-HIV_cap256-059-067733_VR-Chain
  source 1..432: mol_type = other RNA
caggtgcaactggtcgagagcggcgggggagttgtgcagcccggtagatccctcaggctttcttgcaccgcctcacagttcagttttagctcctacggcatgcactgggtacggcaggctcctgggaagggactggaatgggtggcagccatctctttcgcgggcactaaaaagaactatgtcgactcggtgaaaggtcgctttacaatttcacgagataatagcaagaacacgttgtacttacaaatgaatagtctgcgtgctgacgataccgccctatattactgtgcaaaagacatgagagagtatgaatgcgaggaatgggcctccgattactatgacttcgggagggagtacccatgtacagatccgcggggagttgtgggcacttttgacgtctggggccaggggaccatggtgacagtatctagc

SEQ ID NO: 24971 - RNA, 432 nt, synthetic construct
  misc_feature 1..432: note = derived and/or modified sequence opt3 from anti-HIV_cap256-059-067450_VR-Chain
  source 1..432: mol_type = other RNA
caggtgcaactggtcgagagcggcgggggagttgtgcagcccggtagatccctcaggctttcttgcgccgcttcacagttcacctttagtaattacggcatgcactgggtacggcaggcacctgggaagggactggaatgggtggccggcatcagcttcgcgggtattaaaaagtattacgctgactccgtcaaagggcgctttacaatatctcgagataatgccaagaacactttgtatttacaaatgaactcgctgcgtgcagaggacacggccctatactattgtgctaaagatctcagagaatacgagtgcgaagagtgggcatcagactattacgatttcggaagggagctgccatgtcaggacccgcggggcgtggttggcacctttgatatctgggggcagggaacaatggtgactgtcagcagt

SEQ ID NO: 24972 - RNA, 432 nt, synthetic construct
  misc_feature 1..432: note = derived and/or modified sequence opt3 from anti-HIV_cap256-059-065694_VR-Chain
  source 1..432: mol_type = other RNA
caggtgcaactggtcgagagcggcgggggagttgtgcagcccggtagatccctcaggctttcttgcgccgcttcacagctgaccttcaacaattacggcatgcactgggtacggcagacacctgggaagggattggaatgggtggcaggcatcagttttgccggtattaacaaatattacgcggacagcgtcaaggggcgcttcactatatcccgagataattctaaaaacgctttatatctgcaaatgacgtcgctacgtgccgaggacaccgcactctactattgtgtgaaggatctgagagaaatggagtgcgaagagtgggcctcagactactatgattttggaagggaccagccatgtcaggatccgcggggcgttgtgggcacattcgacatctgggggcagggaactatggtcaccgtgagcagt

SEQ ID NO: 24973 - RNA, 432 nt, synthetic construct
  misc_feature 1..432: note = derived and/or modified sequence opt3 from anti-HIV_cap256-059-065109_VR-Chain
  source 1..432: mol_type = other RNA
caggtgcaactggtcgagagcggcgggggagttgtgcagcccggtaagtccctcagactttcttgcgccgcttcaggcttcacctttacaaacaatgcaatgaactgggtaaggcaggcccctgggaaaggactggaatgggtggcgttcgtcagtagcgacggccggaataagaactacgctgattccgtgaaaggtcgctttactatctctcgagacaattcgaagaacacggtttatttgcagatgaactcattacgtgtggaggataccgccctgtactattgtgcaaaagacctaggggccaataaggatgacgaatgggctacagattactatgacctcagcgtcgcatacccaattccggatcccagagccgtggtaggagctttcgacgtttggggccaaggcactatggtgaccgtcagttcc

SEQ ID NO: 24974 - RNA, 432 nt, synthetic construct
  misc_feature 1..432: note = derived and/or modified sequence opt3 from anti-HIV_cap256-059-065060_VR-Chain
  source 1..432: mol_type = other RNA
caggtgcaactggtcgagagcggcgggggagttgtgcagcccggtacctccctcagactttcttgcgccgcttcaggcttcacatttagtaactacgcaatggggtgggtaaggcaggcccctggaaagggcctggaatgggtggcggtcgtgagctatgacggttccaaaaagtcttacgctgattcggttaaagggcggttcactatctcacgcgacaatagccgaaacacgttgtatttacagctgaatagtctacgtgccgaggataccgcaatgttttactgtgccaaggacctcggaaaaggcgaaattgaggaatgggctacagattattacgactggtccaaggcatatccaatagagggcccgagagatgtggtcggggccttcgacacttggggacaaggtaccctggtgacagtatctagc

SEQ ID NO: 24975 - RNA, 432 nt, synthetic construct
  misc_feature 1..432: note = derived and/or modified sequence opt3 from anti-HIV_cap256-059-064001_VR-Chain
  source 1..432: mol_type = other RNA
caggtgcaactggtcgagagcggcgggggagttgtgcagcccggtagatccctcaggctttcttgcgccgcttcacagttcacctttagtaactacggcatgcactgggtacggcaggcacctgggaagggactggaatgggtggccggcatcagcttcgcgggtactaaaaattattacgctaagtccgtcaaagggcgctttacaatttctcgagacaactcgaagaatgccttgtatttacaaatgaactcactgcgtgcagaggatacggccctatactattgtgctaaagacatgagagaatacgagtgcgaagagtgggcaagcgattattacgacttcggaagggatcagccatgtcaggacccgcggggcgtggttggcacctttgatatatgggggcagggaacaatggtggccgtcagttcc

SEQ ID NO: 24976 - RNA, 432 nt, synthetic construct
  misc_feature 1..432: note = derived and/or modified sequence opt3 from anti-HIV_cap256-059-063270_VR-Chain
  source 1..432: mol_type = other RNA
caggtgcaactggtcgagagcggcgggggagttgtgcagcccggtagatccctcaggctttcttgcgccgcttcacagttcacctttagtaattacggcatgcactgggtacggcaggcacctgggaagggactggaatgggtggccgcgatcagcttcgctggcactaaaaagcattatgccgactccgtcaaaggtcgctttacaatttctcgagataattcgaagaacgcattgtacttacaaatgaactcactgcgtgccgaggacacggctctatattactgtgcaaaagatctcagagaatatgagtgcgaagagtgggccagcgactactatgatttcgggagggaccagccatgtctggatccgcggggagtggttggcatatttgacatctggggccaggggacccttgtgacagtcagttcc

SEQ ID NO: 24977 - RNA, 432 nt, synthetic construct
  misc_feature 1..432: note = derived and/or modified sequence opt3 from anti-HIV_cap256-059-061357_VR-Chain
  source 1..432: mol_type = other RNA
caggtgcaactggtcgagagcggcgggggagttgtgcagcccggtcggtccctcaggctttcttgcgccgcttcaggcttcacctttagtaatttcgggtttcactgggtacggcaggcacctggaaagggcctggaatgggtggccggtatcagcttcgcggggacaaaaatttactatgctgactccgtcaagggacgctttactatatctcgagaaaattcgaaaaacatgttgtacttacagatgaactcactgcgtggcgaggatacggccgtgtatttctgtgcaaaggacctaagagagtttgaatgcgaggagtgggccagcgattactatgacttcggcagggaatttccatgtcaagatccgagaggggttgtgggaaccttcgacgtctggggtcatggcgctgtggtaacagttagttcc

SEQ ID NO: 24978 - RNA, 435 nt, synthetic construct
  misc_feature 1..435: note = derived and/or modified sequence opt3 from anti-HIV_cap256-059-059834_VR-Chain
  source 1..435: mol_type = other RNA
caggtgcaactggtcgagagcggcgggggagttgtgcagcccggtagatccctcaggctttcttgcgccgcttcaggcttcacctttagtaacttcgggatgcactgggtacggcaggcacctggaaagggcctggaatgggtggcctttgtcgcgttcgacgagagcgataaatactatgctgcctccgtgaagggtcgctttacagtttctcgagacaattcgaaaaacactgtgtcattgcagatgaatagcttacgtacggaagataccgcagtctactattgtgccaaggaggtgggggacaacaaagatgacgaatggacaagtccatactattacgatttctccatcgcttatccggtacatgaccccagagcagttgtgggaggctacgatgtctggggccaagggactatggtgaccgtgtctagc

SEQ ID NO: 24979 - RNA, 432 nt, synthetic construct
  misc_feature 1..432: note = derived and/or modified sequence opt3 from anti-HIV_cap256-059-059313_VR-Chain
  source 1..432: mol_type = other RNA
caggtgcacctggtcgagagcggcgggggagttgtgcaacccggtaagtccctcagactttcttgcgccgcttcacagttcacctttagtaatttcggcatgcattgggtaaggcaggcacctgggaaaggactggaatgggtggccggcatcagctttgcgggtacaaagaaatactatgctgactccgtcaaggggcggttcactatttctcgcgataattcgaaaaacacgttgtacttacagatgaactcagtgcgagccgaggacaccgcactgtattactgtgccaaggatatgcgtgaatatgagtgcgaagagtgggctagcgactactatgattttggaaagccacaaccgtgtcaggaccccagaggcgttgtgggcacattcgatatgtgggggctaggaactctcgtcaccgtgagttcc

SEQ ID NO: 24980 - RNA, 432 nt, synthetic construct
  misc_feature 1..432: note = derived and/or modified sequence opt3 from anti-HIV_cap256-059-057130_VR-Chain
  source 1..432: mol_type = other RNA
caggtgcaactggtcgagagcggcgggggagttgtgcagcccggtagatccctcaggctttcttgcgccgcttcacagttcagttttagctcctacggcatgcactgggtacggcaggcacctgggaagggactggaatgggtggccgcgatctctttcgctggcattaaaaagcattatgccgactcggtcaaaggtcgctttaccatatcacgagataacagcaagaatacattgtacttacaaatgaacagtctgcgtgtggaggacactgcactatattactgtgccaaagatctcagagaatatgagtgcgaagagtgggcttccgactactatgatttcgggaggccacagccgtgtcaggacccccggggagttgtgggcacgtctgatatctggggccaggggaccatggtcacagtgagctcc

SEQ ID NO: 24981 - RNA, 411 nt, synthetic construct
  misc_feature 1..411: note = derived and/or modified sequence opt3 from anti-HIV_cap256-059-050520_VR-Chain
  source 1..411: mol_type = other RNA
caggtgcaactggtcgagagcggcgggggagttgtgcagcccggtagatccctcaggctttcttgcgccgcttcacagttcacctttaatcggtacggcatgcactgggtacgccaggcacctgggaagggactggaatgggtggccgtcatcagttatgcggacagcgtgaaaggccgattcacaatttcccgtgataattctaagaacactttgtacttacaaatgaactcgctgagagctgaggacacggccctatattactgtgcaaaagatctcagggaagacgagtgcgaagagtggtggtcagattattacgactttggtcgggagctgccatgtcgcaagagcagaggggttgccggaatattcgatatctggggccagggcaccatggtgacagtcagttcc

SEQ ID NO: 24982 - RNA, 432 nt, synthetic construct
  misc_feature 1..432: note = derived and/or modified sequence opt3 from anti-HIV_cap256-059-049839_VR-Chain
  source 1..432: mol_type = other RNA
caggtgcaactggtcgagagcggcgggggagttgtgcagcccggtagatccctcaggctttcttgcgccgcttcaggcttcagttttagcaactacgcaatggactgggtacggcaggcccctgggaagggactggaatgggtggcggtcgtgtcctctgatggcaaaaccaagaattatgctgactcggttaaaggtcgcttcacaatctcacgagataacagcaagaatactgtgtacttgcagatgaacagtttacgtccagaggacacggccgtctattactgtgcaaaagatctgggggccaataaggacgatgaatggaccacagactattacgattggtccgtggcttatccggtacccgaccctagagcagttgtgggagcctttgatgtctggggccaaggcactatggtgaccgtgtctagc

SEQ ID NO: 24983 - RNA, 432 nt, synthetic construct
  misc_feature 1..432: note = derived and/or modified sequence opt3 from anti-HIV_cap256-059-048503_VR-Chain
  source 1..432: mol_type = other RNA
caggtgcaactggtcgagagcggcgggggagttgtgcagcccggtagatccctcaggctttcttgcgccgcttcacagctgagtttcagcaactacggcatgcactgggtacggcaggcacctgggaagggattggaatgggtggccggcacctcctttgcgggtactaaaaagtattacgctgactctgtcaaagggcgcttcacaatctcgcgagataattcaaagaacgccttatatctgcaaatgaatagcctacgtgcagaggacacggccctctactattgtgctaaagatctgagagaatacgagtgcgaagagtgggcaagtgactattacgattttggaagggaccagccatgtcaggatccgcggggcgtggttggcaccttcgacatttgggggcagggaacaatggtgactgtctccgcc

SEQ ID NO: 24984 - RNA, 432 nt, synthetic construct
  misc_feature 1..432: note = derived and/or modified sequence opt3 from anti-HIV_cap256-059-045516_VR-Chain
  source 1..432: mol_type = other RNA
caggtgcaactggtcgagagcggcgggggagttgtgcagcccggtagatccctcaggctttcttgcgccgcttcacagttcacctttagtggctacgggatgcactgggtacggcaggcacctggaaagggcctggaatgggtggccgcgatcagcttcgctggtaataaacgctattttgccgactccgtcaaggggcgattcacaatttctcgtgataattcgaaaaacactttgtttttacaaatgaactcactgagagcagaggacacggccctatactattgtgctagggatatgcgggaatacgagtgcgaagagtgggcaagcgactattacgatttcggacgcccacagccgtgtcaggaccccagaggcgtggttggcgtgtttgatatatgggggcagggaaccatggtcacagtgagttcc

SEQ ID NO: 24985 - RNA, 432 nt, synthetic construct
  misc_feature 1..432: note = derived and/or modified sequence opt3 from anti-HIV_cap256-059-044188_VR-Chain
  source 1..432: mol_type = other RNA
caggtgcacctggtcgagagcggcgggggagttgtgcaacccggtagatccctcaggctttcttgcgccgcttcacagttcacctttagtagctacggcatgcattgggtacggcaggcacctgggaaaggactggaatgggtggccggcatctccttcgcgggtacaaacaaatattacgctgactctgtcaaggggcgctttactgtgtcgcgagataattcaaagaacacgttgtatgttcagatgaatagcttacgtgccgaggacaccgcactgtactattgtgccagagatctaagggaatacgagtgcgaagagtgggctagtgactattacgatttcggacgggagcaaccatgtcaggacccgcgcggcgtggtcggcatttttgatatatgggggcccggaacaatggtgactgtatcctct

SEQ ID NO: 24986 - RNA, 435 nt, synthetic construct
  misc_feature 1..435: note = derived and/or modified sequence opt3 from anti-HIV_cap256-059-044105_VR-Chain
  source 1..435: mol_type = other RNA
cagggccaactggtggagagcgggggaggtgtcgttcagcccggcagatccctctctctttcatgcgccgctagtgggttcagctttaacaattacgcaatggactgggtgaggcaggcccctggaaagggcctggaatgggtagcggtggtctcctctgatggtaacaataaaaactatgctgactcggtgaaggggcggttcaccatctcacgcgataatagcaaaaacacagtttacttgcagatgaatagtttacgagccgaggacactgcaatttattactgtgccaaggatgtgggagctaacaaagacgatgaatgggcaacgaattattactatgactggtccgtcgcctacccagtgccggatccccgtgctgtaataggcgcctttgacgtttggggccaagggaccatggtgacagtctctagc

SEQ ID NO: 24987 - RNA, 432 nt, synthetic construct
  misc_feature 1..432: note = derived and/or modified sequence opt3 from anti-HIV_cap256-059-042100_VR-Chain
  source 1..432: mol_type = other RNA
caggtgcaactggtcgagagcggcgggggagttgtgcagcccggtagatcccagaggctctcttgcgccgcttcacagttcacctttagtagctacggcatgcactgggtacggcaagcacctgggaaaggacttgaatgggtggccgcgatctccttcgctggcacaaacaaatattacggtgactctgtcaaggggcgctttactatttcgcgagataattcaaagaacacgctgtatttgcagatgaatagcttacgtgccgaggacaccgcactgtaccattgtgccagagatatgagggaatatgagtgcgaagagtgggctagtgactactatgatttcggacgggaccagccatgtcaggatccgcgcggcgtggttggcatatttgacctatgggggcaaggaacaatggtgactgtctcctct

SEQ ID NO: 24988 - RNA, 432 nt, synthetic construct
  misc_feature 1..432: note = derived and/or modified sequence opt3 from anti-HIV_cap256-059-040742_VR-Chain
  source 1..432: mol_type = other RNA
caggtgcaactggtcgagaccggcgggggagttggtcagcccggcaagagcctcagactttcctgcgccgcttctgggttcacattttcaaacttcgcaatggactgggtgaggcaggcccctggaaaaggcctggaatgggtagcgtttatcagtagcgatggtattaataagaaatacggggacttcgtgaagggacggtttactatatcccgcgataactctaaaaatacgttgttcttacagatgaactcgctgcgagctgaggacaccgccctatattactgtgcaaaggatgtcggcgactataagtcagatgaatggggcacagactactatgatctcagcatcgagtacccaattcaagacccgcgtgccgtggttggggcttttgataattggggacagggtactatggtgatcgtcagttcc

SEQ ID NO: 24989 - RNA, 432 nt, synthetic construct
  misc_feature 1..432: note = derived and/or modified sequence opt3 from anti-HIV_cap256-059-040554_VR-Chain
  source 1..432: mol_type = other RNA
caggtgcaactggtcgagagcggcgggggagttgtgcagcccggtagatccctcaggctttcttgcgccgcttcacagttcacctttagtagctacggcatgcactgggtacggcaggcacctgggaagggactggaatgggtggccggcatctccttcgcggctacaaacaaatattacggtgggtctgtcaagggacgctttactatttcgcgagacaattcaaagaacacgttgtatttacaaatgaatagcctgcgtgccgaggataccgcactatactattgtacaagagacatgagggaatacgagtgcgaagagtgggccagtgattattacgacttcggcaaagatcagccatgtcaggacccgcggggcgtggttgggactctcgatatatggggacagggtaccatggtgacagtctcctct

SEQ ID NO: 24990 - RNA, 432 nt, synthetic construct
  misc_feature 1..432: note = derived and/or modified sequence opt3 from anti-HIV_cap256-059-039660_VR-Chain
  source 1..432: mol_type = other RNA
caggtgcaactggtcgagagcggcgggggagttgtgcagcccggtagatccctcaggctttcttgcgccgcttcacagttcagttttagcaactacggcatgcactgggtacggcaggcacctgggaagggactggaatgggtggcctccatctctttcgcgggcaccaaaaagaaatatgctgactcggtcaagggtcgctttacaatttcacgagataatagcaaaaacactttgttcttacaaatgaatagtctgcgtacggaggacgccgcactatactattgtgccaaggatatgagagaatttgagtgcgaagagtgggcttccgactactatgatttcgggagggagcagccatgtcaggacacccgggatgtggttggaatatttgacatctggggccagggcacaatggtgactgtctctagc

SEQ ID NO: 24991 - RNA, 435 nt, synthetic construct
  misc_feature 1..435: note = derived and/or modified sequence opt3 from anti-HIV_cap256-059-039298_VR-Chain
  source 1..435: mol_type = other RNA
caggtgcaactggtcgagagcggcgggggagttgtgcagcccggtagatccctcaggctttcttgcgccgcttcaggcttcacctttagtaagtacgggatgcactgggtacggcaggcacctggaaaaggcctggaatgggtggccttcgtcgcgtttgacgagagcgataagtattacgctgcctccgcaaaaggtcgcttcatcatttctcgagacaactcgaagaatacattgtcattacagatgaacagcctgcgtactgaagatacggccgtgtattactgtgctaaagaggttggggacaataaggatgacgaatggaccagtccatattactatgatatatccatcgcatacccggtgcaagaccccagagccgtcgtgggaggctacgatgtatggggccaggggacaatggttactgtgtctagc

SEQ ID NO: 24992 - RNA, 432 nt, synthetic construct
  misc_feature 1..432: note = derived and/or modified sequence opt3 from anti-HIV_cap256-059-037873_VR-Chain
  source 1..432: mol_type = other RNA
caggtgcaactggtcgagagcggcgggggagttgtgcagcccggtagatccctcaggctttcttgcgccgcttcacagttcacctttagtaactacggcatgcactgggtacggcaggcacctgggaagggactggaatgggtggccgcgatcagcttcgctggcattaataaatattacgccgactccgtcaagggtcgctttacattgtctcgagataacactaaaaatacgttatatctgcaaatgaactcgctacgtgcagaggacaccgccctctactattgtgctagagatctgagggaatacgagtgcgaagagtgggcatcagactattacgatttcgggcggccacagccgtgtcaggacccccgcggagtggttggcacaagcgatatatggggccaggggactatggtgaccgtcagttcc

SEQ ID NO: 24993 - RNA, 432 nt, synthetic construct
  misc_feature 1..432: note = derived and/or modified sequence opt3 from anti-HIV_cap256-059-037633_VR-Chain
  source 1..432: mol_type = other RNA
caggtgcaactggtcgagagcggcgggggagttgtgcagcccggtagatccctcaggctttcttgcgccgcttcacagttcacctttagtaacttcggcatgcactgggtacggcaggcacctgggaagggactggaatgggtggccgcgatcagctttgctggcattaataaaaactacgccgactccgtcaagggtcgcttcacaatatctcgagataattcgaaaaacactttgcatttacaactaaattcactgcgtgcagaggacacggccctctattactgtgctaaggatctgagagaatatgagtgcgaagagtgggcaagcgactactatgattttgggagggaccagccatgtcaggatccgcggggagtggttggcaccttcgacatctggggccaggggacaatggtgactgtcagttcc

SEQ ID NO: 24994 - RNA, 432 nt, synthetic construct
  misc_feature 1..432: note = derived and/or modified sequence opt3 from anti-HIV_cap256-059-036817_VR-Chain
  source 1..432: mol_type = other RNA
caggtgcaactgctcgagagcggcgggggagtcgttcagcccggtagatcccttaggctgtcttgcgaagcctcacagttcacctttagtaacttcggcatgcactgggtgcggcaggctcctgggaagggattggagtgggtagcagccatcagctttgcgggcattaaaaagaattacgctgactccgtgaaaggtcgcttcacaatatctcgagataactcgaagaatactttatatctgcaaatgaactcactacgtgtcgaagacacggccctctactattgtgcaaaagatctgagagagtacgaatgcgaggagtgggccagcgactattacgattttgggagggaacagccatgtcaggacccgcggggagtgatcggcaccttcgatatttggggccaggggacaatggttactgtgagttcc

SEQ ID NO: 24995 - RNA, 432 nt, synthetic construct
  misc_feature 1..432: note = derived and/or modified sequence opt3 from anti-HIV_cap256-059-032787_VR-Chain
  source 1..432: mol_type = other RNA
caggtgcaactggtcgagagcggcgggggagttgtgcagcccggtagatccctcaggctttcttgcgccgcttcaggcttcacctttagtaagtacgcaatgcactgggtacggcaggcccctgggaaaggactggaatgggtggcgttcgtcgcttttgacgagagcgataagtattacgtggactccgttaaaggccgcttcacaatctctcgagataactcgaagaatactttgtcattacagatgaacagcctgcgtgccgaagacacggcagtgtattactgtgccaaagaggtccatgtgaataaggatgacgaatgggctagtgattattacgacctatccattgcatatccaatacaagatccgagagccgtagttggtgggctcgacatctggggacagggcaccatggtgacagtctctagc

SEQ ID NO: 24996 - RNA, 432 nt, synthetic construct
  misc_feature 1..432: note = derived and/or modified sequence opt3 from anti-HIV_cap256-059-032427_VR-Chain
  source 1..432: mol_type = other RNA
caggtgcaactggtcgagagcggcgggggagttgtgcagcccggtagatccctcaggctttcttgcgccgcttcacagttcacctttagtaatttcggcatgcactgggtacggcaggcacctgggaagggactggaatgggtggccggcatcagctttccaggtactaaaaagtactatgcggactccgtcaaagggcgcttcacaatttctcgagataattcgaagaacgctttgtacttacaaatgaactcactgcgtgccgaggacacggcactatattactgtgccagagatctcagggaatatgagtgcgaagagtgggctagcgactactatgattttggaaaaccgcagccctgtctggaccctcggggcgtggttggcaccttcgatatatgggggcagggaacaatggtgactgtcagttcc

SEQ ID NO: 24997 - RNA, 435 nt, synthetic construct
  misc_feature 1..435: note = derived and/or modified sequence opt3 from anti-HIV_cap256-059-029390_VR-Chain
  source 1..435: mol_type = other RNA
caggtgcaactggtcgagagcggcgggggagttgtgcagcccggtagatccctcaggctttcttgcgccgcttcaggcttcacctttaaccagcacgggatgcattgggtacggcaggcacctgacaagggactggaatgggtggccttcgtcggctttgatgagagtgaaaaatactatgcggacagcgtgaagggtcgcttcacaatctcccgagataattctaaaaacactttgtcgttacaaatgaactcactgcgtccagaggacacggctgtttactattgtgccaaggaagtgggggataataaagaggacgagtgggcaagcgattactattacgacctaagtaatgcctatccgattcacgatcccagagctgtcgtgggaggctacgacatatggggccaggggaccatggtaacagtttgctcc

SEQ ID NO: 24998 - RNA, 435 nt, synthetic construct
  misc_feature 1..435: note = derived and/or modified sequence opt3 from anti-HIV_cap256-059-027877_VR-Chain
  source 1..435: mol_type = other RNA
caggtgcaactggtcgagagcggcgggggagttgtgcagcccggtagatccctcaggctttcttgctcagccagtgctttcagcttttcctacttcgcaatggactgggtacggcaggcccctggcaaggggctggaatgggtggcgtttgtctcttcggatggaaacaataaaaactatgctgactcagtgaagggccgcttcaccatcagccgagataatagtaaaaacacagtgtttttgcagatggactccttacgtccagaggatactgccgtttactattgtgcaaaggacctgggtgggaataaagatgacgaatggtctacgaactactattacgatattagcatagccgacccggtccccgatcctagagctgtggcaggagccttcgacgtatggggccaaggcaccatggttacagtgtcctca

SEQ ID NO: 24999 - RNA, 435 nt, synthetic construct
  misc_feature 1..435: note = derived and/or modified sequence opt3 from anti-HIV_cap256-059-026640_VR-Chain
  source 1..435: mol_type = other RNA
caggtgcaactggtcgagagcggcgggggagttgtgcagcccggtagatccctcaggctttcttgcgccgcttcaggcttcagttttagcaagtacgggatgcactgggtacggcaggcacctggaaaaggcctggaatgggtggccttcgtcgcgtttgacgagtccgatcgctattacgctgcctctgtgaagggtcgattcaccatctcgcgtgacaacagcaaaaatacattgtcattacagatgaacagtctgagaactgaagatacggcaatttattactgtgccaaggaggttggggacaataaagatgacgaatggacctccccatattactatgatatgtctatagcttacccggtgcaagaccccagggcagtcgtgggaggctacgatatctggggccaggggacaatggtaactgttagctcc

SEQ ID NO: 25000 - RNA, 432 nt, synthetic construct
  misc_feature 1..432: note = derived and/or modified sequence opt3 from anti-HIV_cap256-059-026017_VR-Chain
  source 1..432: mol_type = other RNA
caggtgcaactggtcgagagcggcgggggagttgtgcagcccggtagatccctcaggctttcttgcgccgcttcaggcttcacctttagtacatacgcaatgcactgggtacggcaggcccctgggaagggactggaatgggtggcgttgatcagctatgacggcactaataaatactatgtcgattccgctaagggtcgcttcacgatttctcgagacaattcgaaaaacaccttatacctgcagatgaactcactaacaccagaggatactgccgtgttttattgtgcaaaggacctcgggggatacaaagatgacgaatggggcaccgagtattacgatataagcgttagttacccggtgcaagacccccgtgccgtcgctggcgtgttcgatgtatgggggcatggaacaatggttaccgtgtcctct

SEQ ID NO: 25001 - RNA, 432 nt, synthetic construct
  misc_feature 1..432: note = derived and/or modified sequence opt3 from anti-HIV_cap256-059-024100_VR-Chain
  source 1..432: mol_type = other RNA
tgccaggtgctggtcgagagcggcgggggagttgtgcaacccggtagatccctcaggctttcttgtgccgcttcacagttcacctttagtagctacggcatgcactgggtacggcaggcacctgggaagggactggaatgggtggccgcgatctccttcgctggcactaaaaagtattacgccgactctgtcaaaggtcgctttgcaatttcgcgagatacatcaaagaacgccttgtatttacagatgaatacgctgcgtgctgaggacaccgcactatactattgcgccagagatctcagggagttcgaatgtgaagagtgggctagcgactactatgattttgggcggccacaaccgtgccaggacccccgcggagtggttggcagtttcgatatatggggccaggggacaatggtgactgtctccctg

SEQ ID NO: 25002 - RNA, 432 nt, synthetic construct
  misc_feature 1..432: note = derived and/or modified sequence opt3 from anti-HIV_cap256-059-023966_VR-Chain
  source 1..432: mol_type = other RNA
caggtgcaactggtcgagagcggcgggggagttgtgcagcccggtagatccctcaggctttcttgcgccgcttcacagttcagttttagctcctacggcatgcactgggtacggcaggcacctgggaagggactggaatgggtggccgcgatctctttcgctggcattaaaaagcattataccgactcggtcaaaggtcgctttacaatatcacgagataacagcaagaatactttgtacttacaaatgaacagtctgcgtgccgaggacacggcactatattactgtgccaaagatctcagagggttcgaatgcgaggaatgggcttccgactattacgattttggaagggaccagccatgtcaggatccgcggggcgtggttggcaccttcgacatctgggggcagggaacactggtgactgtctctagc

SEQ ID NO: 25003 - RNA, 432 nt, synthetic construct
  misc_feature 1..432: note = derived and/or modified sequence opt3 from anti-HIV_cap256-059-020534_VR-Chain
  source 1..432: mol_type = other RNA
caggtgcaactggtcgagagcggcgggggagttgtgcagcccggtagatccctcaggctttcttgcgccgcttcacagttcacctttagtaactacggcatgcactgggtacggcaggcacctgggaagggactggaatgggtggccggcatgagcttcgcgggtacaaatacttattacgctgactccgtcaaagggcgctttacgatctctcgagataactcgaagaataccttgtatttacaaatgaactcactgcgtgccgtggacacagcactatactattgtgccagagatatgagggagtacgaatgcgaggaatgggctagcgactattacgatttcggacgggagtacccatgtcaggacccgcgcggcgttgtgggcatttttgatctctgggggcagggaactatggtcaccgtgagttcc

SEQ ID NO: 25004 - RNA, 435 nt, synthetic construct
  misc_feature 1..435: note = derived and/or modified sequence opt3 from anti-HIV_cap256-059-019513_VR-Chain
  source 1..435: mol_type = other RNA
caggtgcaactggtcgagagcggcgggggagttgtgcagcccggtagatccctcaggctttcttgcgccgcttcaggcttcacctttagtaacttcgcaatggggtgggtacggcaggcccctggaaagggcctggaatgggtggcggtcatcagctccgacggtacaaataaaaactacggggattctgtgaagggacgctttactatttcgcgagacaattcaaagaacacgttgttcttacagatgaatagcctgcgtgctgaggataccagtctatattactgtgccaaagacctcggcggctataaaacagatgaatgggcaactaactactattacgacatatccatcgcctctccaattcaagatccgagagctgttgtgggggcatttgacatctggggacagggtaccatggtcacagtgaccagc

SEQ ID NO: 25005 - RNA, 432 nt, synthetic construct
  misc_feature 1..432: note = derived and/or modified sequence opt3 from anti-HIV_cap256-059-012963_VR-Chain
  source 1..432: mol_type = other RNA
caggtgcaactggtcgagagcggcgggggagttgtgcagcccggtcggtccctcaggctttcttgcgtagcctcaggcttcagttttagctcctacgggatggcttgggtgcggcaggcacctggaaagggcctggaatgggtcaccgtgatctctttcgccggtgttaaaacatattacgcggactcggtgaaggggcgctttactatttcacgagataacagcaaaggaacgttgtatttacagatggacggcctgcgtccagaggataccgctctatactattgtgccaaggacctcgcagaaagagagtgcgaagagtgggccagtgattactatgacttcggcagggagctgccgtgtcaagatcccagaggggtcgtgggaacatttgacgtatggggtcagggcactatggttaccgtgtcctct

SEQ ID NO: 25006 - RNA, 435 nt, synthetic construct
  misc_feature 1..435: note = derived and/or modified sequence opt3 from anti-HIV_cap256-059-010396_VR-Chain
  source 1..435: mol_type = other RNA
caggtgcaactggtcgagagcggcgggggagttgtgcagcccggtagatccctcaggctttcttgcgccgcttcaggcttcagttttaacaattacgcaatgaactgggtacggcaggcccctgggaagggactggaatgggtggcgttcgtcagctccgacggctctaataaaaactatgctgattcggtgaccggtcgctttacattgtcacgagacaatagcaagaacactgttttcttacagatgaatagtctgcgtgtggaggatacggccgtctactattgtgcaaaagacgtgggggccaacaaggatgacgaatggaccacaaattactattacgatatctccattgctgacccagtaccggatcccagagcagttataggagcctttgacgtgtggggccaaggcactatggtcaccgtgtctagc

SEQ ID NO: 25007 - RNA, 432 nt, synthetic construct
  misc_feature 1..432: note = derived and/or modified sequence opt3 from anti-HIV_cap256-059-008136_VR-Chain
  source 1..432: mol_type = other RNA
caggtgcaactggtcgagagcggcgggggagttgtgcagcccggtagatccctcaggctttcttgcgccgcttcaggcttcacctttaatacatacgcaatgcactgggtacggcaggcccctgggaagggactggaatgggtggcgttgatcagttatgacggcactgagaaatactatgctgatagcgtcaagggtcgcttcacgatttcccgagacaattctcgtaacaccttatacctgcagatgaactcgctaagactcgaagatgccgcactgtatcaatgtgccaaagaccttgggggatcaaagagcgatgagtggggcacagactactatgatatgagtatatcctacccaatccaggacccgagggctgtggcaggcgtttttgatatttgggggcagggaactctggtgaccgtctctagc

SEQ ID NO: 25008 - RNA, 432 nt, synthetic construct
  misc_feature 1..432: note = derived and/or modified sequence opt3 from anti-HIV_cap256-059-006147_VR-Chain
  source 1..432: mol_type = other RNA
caggtgcaagtcgttgagagcggcgggggagtggtacagcccggtagatccctgaggctctcttgcaccgcctcaggcttcacatttagtaacttcgctatggggtgggtgcggcaggcacctggaaagggccttgaatgggtcgcctttatcagctccgacggttctaataaaaactacggggattcggtgaagggacgcttcactatttcacgagacaatagcaaaaacacggtttttctgcagatgaatagtttgcgtgtggaggataccgcgttatattactgtgctaaggacgtcggcgattataaatccgacgaatggggcacagagtactatgatatatctatcagctacccaattcaagacccgagagccatggtgggggcattcgatctgtggggacagggtactatggtaaccgtttccccc

SEQ ID NO: 25009 - RNA, 432 nt, synthetic construct
  misc_feature 1..432: note = derived and/or modified sequence opt3 from anti-HIV_cap256-059-005081_VR-Chain
  source 1..432: mol_type = other RNA
caggtgcaactggtcgagagcggcgggggagttgtgcagcccggtagatccctcaggctttcttgcgccgcttcacagttcacctttagtagctacggcatgcactgggtacggcaggcacctgggaagggactggaatgggtggccggcatctccttcgcggctactaaaaagtattactctgagtcggtcaaaggtcgctttacaatttcacgagacaacagcaagaatgccttgcatttacacatgaacagtctgcgtgcagaagatacggccctatattactgtgctaaagacctcagagagttcgaatgcgaggagtgggcatccgattattacgactttgggagggatcaaccatgtcaggacccgcggggagtggttggcatattcgatatgtggggccaggggaccatggtgacagtctctagc

SEQ ID NO: 25010 - RNA, 432 nt, synthetic construct
  misc_feature 1..432: note = derived and/or modified sequence opt3 from anti-HIV_cap256-059-005006_VR-Chain
  source 1..432: mol_type = other RNA
caggcccaactggtggagagcggcgggggagtcgttcagcccgctaagtccctcagactttcttgcgcagcctcaggtttcacctttaacaaatacgcgatgcactgggtgaggcaggctcctggcaaggggctggaatgggtagccttcgtggcatttgacgagagtgataaatattacgccgacagcgtcaagggacggttcacaatctcccgcgataattctaaaaacactttgtcgttacagatgaataacctgcgagctgaagacacggcagtgtattactgtgccaaggaggttggcgataataaggacgatgaatgggcttcagactattacgatctaagcattgcctatccaatacaagacccgcgtgcggtgggtagagggtacgatatctggggacagggcaccatggtcacagtgagttcc

SEQ ID NO: 25011 - RNA, 432 nt, synthetic construct
  misc_feature 1..432: note = derived and/or modified sequence opt3 from anti-HIV_cap256-059-004451_VR-Chain
  source 1..432: mol_type = other RNA
caggtgcacctggtcgagagcggcgggggagttgtgcaacccggtaagtccctcagactttcttgcaccgcctcaggcttcacatttactaacttcgctatggactgggtaaggcaggcacctgggaaaggactggaatgggtggcctttatcagtagcgatggctccaataagtactattctgagtcggtcaaaggtcggttcacgatttcacgcgacaacagcaagaataccttgtacgtgcagatgaacagtttacgaacagaagatactgcggtttattactgtgctaaagacctagggggatataaggatgacgagtggtccaccgattactatgactggtctacagcctacccagtgcaggatccgcgtgcagtcgccggcgcttttgacctgtggggccaagggaccatggtgagcgtatcctca

SEQ ID NO: 25012 - RNA, 432 nt, synthetic construct
  misc_feature 1..432: note = derived and/or modified sequence opt3 from anti-HIV_cap256-059-003571_VR-Chain
  source 1..432: mol_type = other RNA
caggagcaactggtggaaagcggcgggggagtcgttcagcccggtagatccctcaggctttcttgcgccgcttcacagttcacctttggcgcatacgggatgcactgggtgcggcaggcccctggaaagggcctggagtgggtagcgggtgtgagtttcgtcgggaacaataaatattacgctgacagcgtgaagggacgctttacaatctcccgagataactctaaaaatactttgtatttacaaatgaactcgctgcgtggcgaagacacggccctatactattgtgcaagagatatgagggagatggaatgcgaggagtgggcctcagactactatgatttcggccggccacagccgtgtcaggacccccgcggggttgtgggaatttttgatatgtggggtcagggcaccatggtcacagtgagcagt

SEQ ID NO: 25013 - RNA, 432 nt, synthetic construct
  misc_feature 1..432: note = derived and/or modified sequence opt3 from anti-HIV_cap256-059-003449_VR-Chain
  source 1..432: mol_type = other RNA
caggtgcaactggtcgagagcggcgggggagttgtgcagcccggtaagtccctcagactttcttgcgccgcttcacaggtaaccttcagtagctacggcatgcactgggtgaggcaggcacctgggaaaggactggaatgggtcgccggcatctcctttgcgggtacaaagaaatattacgctgactctgtgaaggggcggttcactatttcgcgcgataacagcaaaaatgccttgtatttacaaatgaaccgactgcgtgcaggagacacggccctatactattgtgctaaggatctcagagagtacgaatgcgaggaatgggcatcagactattacgattttggcagggagcagccatgtcaggacccgcggggcgttgtggggatattcgatatctggggactgggtaccatggtcacagtgagttcc

SEQ ID NO: 25014 - RNA, 432 nt, synthetic construct
  misc_feature 1..432: note = derived and/or modified sequence opt3 from anti-HIV_cap256-059-002712_VR-Chain
  source 1..432: mol_type = other RNA
caggtgcaactggccgagagcggcgggggagtcgttcagcccggtagatccctcaggctttcttgcgctgcatcacagttcacctttagtagctacggcatgcactgggtgcggcaggcccctgggaagggactggaatgggtagcggctatctccttcgccggcactaaaaagcattatgcagactctgtgaaaggtcgctttacaatttcgcgagataactcaaagaatacgttgaacttacaaatgaatagcctgcgtgccgaggacaccgctctatactattgtgcaagagatatgagggaatacgagtgcgaagtctgggccagtgactattacgatttcgggcgggagcagccatgtcaggacccgcgcggagtggttggcacatttgatatatggggccaggggactatggtgaccgtctccccc

SEQ ID NO: 25015 - RNA, 432 nt, synthetic construct
  misc_feature 1..432: note = derived and/or modified sequence opt3 from anti-HIV_cap256-059-001573_VR-Chain
  source 1..432: mol_type = other RNA
caggtgcaactggtcgagagcggcgggggagttgtgcagcccggtagatccctcaggctttcttgcgccgcttcacagttcacctttagtagctacggcatgcactgggtacggcaggcacctgggaagggactggaatgggtggccggcatctcctatgacggtacatctaaatactatgcggattcggtcaaggggcgcttcactatttcacgagacaacagcaaaaatacgttgtacttacaaatgaacagtctgcgtgctgaggataccgccctatattactgtgcaaaggacctcagagaagatgagtgcgaagagtggtggtccgactattacgattttggaagggagctgccatgtcggaaatctcgcggcgtggccggcacattcgacatatgggggcatggaactatggttaccgtgagctcc

SEQ ID NO: 25016 - RNA, 432 nt, synthetic construct
  misc_feature 1..432: note = derived and/or modified sequence opt3 from anti-HIV_cap256-059-001379_VR-Chain
  source 1..432: mol_type = other RNA
caggtgagactggtcgagagcggcgggggagttgtgcaacccggtaggtccctccggctttcttgcgccgcttcaggcttcacctttaacagttaccctatgcactgggtacgccaggcaccagggaagggactggactgggtggccttgatcagctatgatggcacaaataaattctacgtcgactccgtgaagggtcgatttactatttctcgtgataactcgaaaaatacgttatatctgcagatgaactcactaaccgcggaagacacagctatgtactattgtgccaaggatctcgggggaaataaagacgatgagtggggcactgactactatgatataagcgttgcatacccgatccatgaccccagagccgtggctggcattttcgatgtctgggggcacggaaccatggtgacagtaagttcc

SEQ ID NO: 25017 - RNA, 432 nt, synthetic construct
  misc_feature 1..432: note = derived and/or modified sequence opt3 from anti-HIV_cap256-059-001029_VR-Chain
  source 1..432: mol_type = other RNA
caggagcaactggtgcagagcggcgggggagtcgttcagcccggtagatccctcaggctttcttgcgccccttcacagttcacctttagtgctcacggcatgcattgggtgcggcaagcaccagggaagggactggaatgggtagccggcatcagcttcgcgggtactaaaaattactatgctgactccgtgaaggggcgctttacaatttctcgagataattcgaaaaacacgttgtacttacagatgaactcactgcgtgtcgaggacaccgccctatattactgtgcaaaggatatgagagaaatggagtgcgaagagtgggccagcgactattacgatttcggaaggcaccagccgtgtcaggacccccggggcgtggttggcatatttgatatctgggggcaaggaacaatggtgactgtcagttcc

SEQ ID NO: 25018 - RNA, 432 nt, synthetic construct
  misc_feature 1..432: note = derived and/or modified sequence opt3 from anti-HIV_cap256-048-165087_VR-Chain
  source 1..432: mol_type = other RNA
gaggtgaagctgctcgaaagcggcgggggacttgtccagcccggtggctacagaaggctgtcctgcgccgcttctgggttcaccttttcacggtatgcaatgcactgggcccgccaagcgcctggaaaaggcttggagtgggttgctgtggtaagtgacgatggtgtgaagaaatactatccagacagcgtccgagggcgtttcacaatctccagagataactctaggaatactgtgtcgttacagatgaactcactgcggccggaagacacggccgtttactattgtgcaaaggatgtgggagccaataaagacgatgagtgggctaccgactactatgatctaagcattgcataccccgtccctgacccacgcgccgtggtaggcgcttttgatatatggggccaggggacaatggttactgtgagttcc

SEQ ID NO: 25019 - RNA, 432 nt, synthetic construct
  misc_feature 1..432: note = derived and/or modified sequence opt3 from anti-HIV_cap256-048-158861_VR-Chain
  source 1..432: mol_type = other RNA
gaggtgcagctggtcgaaagcggcgggggactcgttcaacccggtggctcccttagactgtcttgcgtggacttcgggtttaggttctcagagtactggatgagttgggtacggcaggcccctggaaagggcttggaatgggtggctgtcatcagctatgatggtaccaataaatactatgcagactccgtgaaggggcgctttacaatttctcgagataattcgaaaaacactttatacctgcagatgaactcactacgtgccgaggacacggcgctctattactgtgctaaggatatgagagaaagcgagtgcgaggaatgggccagtgactattacgatttcggaaaagactacccatgtcaggatccgaggggcgttgtgggcacctttgacatatgggggcaaggaacaatggtcactgtgtcctct

SEQ ID NO: 25020 - RNA, 435 nt, synthetic construct
  misc_feature 1..435: note = derived and/or modified sequence opt3 from anti-HIV_cap256-048-158280_VR-Chain
  source 1..435: mol_type = other RNA
caggtgcacctggtcgagagcggcgggggagttgtgcaacccggtagatccctcaggatctactgcgccgtatctgagttcacctttcggaactatgctatgcattgggtgcgccttgcacctggcaaggggctgcagtgggtcgccgtgatttcacacgacggaataaatgattactatgcggacagtgttaaaggccgattcacaatcagccgtgataactccaagaatactgtgtctttgcagatgaactcgttaagaccagaagacacggctgtctactattgtgccaaagatctgggtgcaaataaggacgatgaatgggccaccgactactatgatctatcaattgcttacccggtgcccgaccctacagggccatggtttggagcattcgatatctggggccagggcactatggtaaccgttagcagt

SEQ ID NO: 25021 - RNA, 432 nt, synthetic construct
  misc_feature 1..432: note = derived and/or modified sequence opt3 from anti-HIV_cap256-048-157928_VR-Chain
  source 1..432: mol_type = other RNA
caggtgcaactgatggagagcggcgggggagtcgttcagcccggtagatccctcaggctttcttgcgccatctcaggcttcacctttagtaactactggatgagctgggtgcggcaggctcctgggaagggactggaatgggtagcagtgatttcctctgacggctcgagcaaaaattatgccgattcagtcaagggtcgcttcacaataagtcgagacaactccaaaaatactgtgtctttgcagatgaacagcttacgtccagaggatacggcggtttactattgtgctaaggacgtgggggccaataaagatgacgaatgggcaaccgattactatgacctgtccatcgcctacccggtccccgatcctagagctgtggtaggagcatttgacatttggggccaaggcacaatggttactgtgtcaagt

SEQ ID NO: 25022 - RNA, 432 nt, synthetic construct
  misc_feature 1..432: note = derived and/or modified sequence opt3 from anti-HIV_cap256-048-157056_VR-Chain
  source 1..432: mol_type = other RNA
caggtgcaactggtcgagagcggcgggggagttgtgcagcccggtagatccctcaggctttcttgcgccgcttcaggcttcaccctgagtagctacgcaatgcactgggtacggcaggcccctgggaagggattggaatgggtggcgtttatctccaacgacggctctaataaatatttcgctgattcggtcaagggtcgctttacaatttcacgagacaacagcaaaaatactttatacctgcagatgaacagtctacgtgccgaggatacggcagtgtattactgtgccaaggacctcgggggaaataaagatgacgaatgggctaccgattattacgacctgtccatagcatatccagttcaagatccgagagtggtcgtgggcatcttcgacatttggggccaggggacaatggtaactgtttctagc

SEQ ID NO: 25023 - RNA, 432 nt, synthetic construct
  misc_feature 1..432: note = derived and/or modified sequence opt3 from anti-HIV_cap256-048-156422_VR-Chain
  source 1..432: mol_type = other RNA
caggtgcaactggtcgagagcggcgggaccgttgtgcagcccggaagatccctcaggctttcttgcgtaggttcaggcttcagtctgagctactatgccatccactgggtgcggcaggctcctgggaagggattggaatgggtcgcagtgatttcctacgacggctctaactattactatgccgattcggttaaaggtcgctttacaatatcacgagacaatagcaagaacactgtgtacttacagatgaatagtctgcgtggggtcgatacggcggtgtattactgtgctaaagacctaggaggcggcgaggtagaagagtgggccaccgattactatgactggtccatcgcatacccagttgaacatccgagagccgtggtcggggtgttcgatatttggggacaaggtacaaaggtgactgtctctagc

SEQ ID NO: 25024 - RNA, 432 nt, synthetic construct
  misc_feature 1..432: note = derived and/or modified sequence opt3 from anti-HIV_cap256-048-152863_VR-Chain
  source 1..432: mol_type = other RNA
gaggtgcagctgctcgaaagcggcgggggacttgtccaacccggtggctccctgagattgtcttgcgccgggtcaggattcacctttagtaagcacggcatgcattgggttaggcaggctcctggtaaagggttagagtgggtggcattcgtagcctttgacgaaagcgataagtactatgcggactccgtgaaaggacggttcacaatctctcgcgataactcgaagaatactctgtcactacagatgaacagcctccgagctgaggacacggccatgtactattgtgcaaaagaagtcggcgataataaggacgatgagtgggccagtgactactatgatctgtccattgcttacccagtgcacgacccgcgtgcagttgtgggcgggtatgatatatggggacagggtaccatggtcacagtgtctagc

SEQ ID NO: 25025 - RNA, 432 nt, synthetic construct
  misc_feature 1..432: note = derived and/or modified sequence opt3 from anti-HIV_cap256-048-152770_VR-Chain
  source 1..432: mol_type = other RNA
caggtgcaactggtcgagagcggcgggggagttgtgcagcccggtagatccctcaggctttcttgcgccgcttcaggcttcacctttcggagtaacgcaatgcactgggtacgccaggcccctgggaagggactggaatgggtggcggtcatcagctacgacggctccaaaacatattacgctgattctgtgaagggtcgattcactatttcgcgtgacaattcaaagaacacgttgtatttacagatgaatagcctgagagccgaggataccgcagtttactattgtgccaaagacctaggggaatacaaaagtgatgagtgggctacagactattacgatctctccatagcatacccagtgcaagacccgaggggagtcgccggcgcttttgatatctggggccaggggactatggtgaccgtatctagc

SEQ ID NO: 25026 - RNA, 432 nt, synthetic construct
  misc_feature 1..432: note = derived and/or modified sequence opt3 from anti-HIV_cap256-048-150027_VR-Chain
  source 1..432: mol_type = other RNA
gaggtgcagctggtcgaaagcggcgggggactcgttcaacccggtggctcccttagactgtcttgcgccgtgtcagggttcacctttagtagctacatcatgcactgggtaaggcaggctcctggaaagggcttggagtgggtggcagtcatttcctatgacggttctaacaaagattacgccgactcggtgaaggggcggttcacaatatcacgcgataatagcaaaaacactttatatctgcagatgaatagtctacgagcggaagacacggctctctactattgtgccaaggatctgcgtgagtacgaatgcgaggagtgggcatccgactattacgattttggaagagactacccatgtcaggatccgaggggcgttgtgggcaccttcgacatctgggggcaaggaacaatggtcactgtgtctagc

SEQ ID NO: 25027 - RNA, 432 nt, synthetic construct
  misc_feature 1..432: note = derived and/or modified sequence opt3 from anti-HIV_cap256-048-148246_VR-Chain
  source 1..432: mol_type = other RNA
caggtgcaactggtcgagagcggcgggggagttgtgcagcccggtagatccctcaggctttcttgcgccacctcaggcttcacatttagtacttacagcatgcactgggtacggcaggctcctgggaagggactggaatgggtggcagtcatctcctatgacggctctaacgagtactatgtggattcggttaaaggtcgcttcacgatttcacgagacaatagcaagaacaccttgtacttacagatgaatagtctgcgtgtggaagatacagccctatattactgtgcgaaagacctcgggggaaacaaggatgacgagtggggcactgattattacgacttttccgtcgcttacccagtgcaagatccgagagccgtatctggcatattcgacgtttgggggcatggaaccatggtgacagtcagctcc

SEQ ID NO: 25028 - RNA, 432 nt, synthetic construct
  misc_feature 1..432: note = derived and/or modified sequence opt3 from anti-HIV_cap256-048-147428_VR-Chain
  source 1..432: mol_type = other RNA
caggtgcaactggtcgagagcggcgggggagttgtgcagcccggtagatccctcaggctttcttgctcagccagtggcttcacctttagcaactacgggatgcactgggtacggcaggctcctggaaagggcctggaatgggtggcagtcatctccttcgacggttctaataaagtgtatgccgattcggttaaggggcgctttacaatttcacgagacaacagcaaaaatactttgtacttagagatgaacagtctgcgtgcggaagatacggctgagtattactgtgccaaggacctaggagaatccgataaagaggagtggccatctgactattacgatttcggcagagactttaccggccaggtgccgagggcagtcgtggggatattcgatatgtggggacaaggtacaatggtaactgttagctcc

SEQ ID NO: 25029 - RNA, 432 nt, synthetic construct
  misc_feature 1..432: note = derived and/or modified sequence opt3 from anti-HIV_cap256-048-146603_VR-Chain
  source 1..432: mol_type = other RNA
gaggtgcagctggtcgaaagcggcgggggactcgttcaacccggtagatcccttaggctgtcttgcgccgcttcaggcttcacctttgacgattacgcaatccactgggtgcggcaggcccctgggaagggattggagtgggtagcgttaattagttatgacggcacagataaatactatgctgacagcgtgaagggtcgcttcactatatcccgagataactctaaaaatacgctgtacctacagatgaactcgctccgtgtcgaagacaccgccgtgtatcattgtgcaaaggatcttgggggaacaaaatcagacgagtgggccactgattactatgacctgagcatcgcttacccaattcaggatccgggcgcagttgtgggcgtctttgacatctgggggcaaggaaccatggtgacagtaagttcc

SEQ ID NO: 25030 - RNA, 432 nt, synthetic construct
  misc_feature 1..432: note = derived and/or modified sequence opt3 from anti-HIV_cap256-048-145735_VR-Chain
  source 1..432: mol_type = other RNA
caggtgcaactggtccagagcggcgggggagttgtgcagcccggtagatccctcaggctttcttgcggcgcctcagggttcacctttagtaattacgctatgcactgggtacggcaggcacctggaaagggcctggactgggtggccgtcatcagctatgatggtacaaatgagaaccatgcggactccgtgaaagggcgcttcactatttctcgagataattcgaagaacacggtttacttgcaaatgaactcattacgtgctgaagacaccgccgtgtattactgtgcaaaagatgtcggaggcagcaaggacgatgagtgggccacagactattacgatctgagtatagcttatccagtgccggaccccagagcagtagttggcgcctttgatatctgggggcagggaactatggtgaccgtctcctct

SEQ ID NO: 25031 - RNA, 432 nt, synthetic construct
  misc_feature 1..432: note = derived and/or modified sequence opt3 from anti-HIV_cap256-048-145116_VR-Chain
  source 1..432: mol_type = other RNA
caggtgcacctggtcgagagcggcgggggagttgtgcaacccggtggctccctcagactttcttgcgccgcttcagggttcacctttagtaactacggaatgcattgggtaaggcaggcacctggcaagggtctggaatgggtggccgcgatcagcttcgctgggacaaataaatattacgccgactccgtcaagggacggtttactatttctcgcgataactcgaaaaatgcattgtatttacagatgaactcactgcgagccgaggacacggctctatactattgtgcaaaggatctccgtgaaagcgagtgcgaagagtgggccagtgactactatgatttcggcagagactacccatgtcaggatccgaggggcgtggttgggaccctggacatatggggacaaggtacaatggtgactgtctcctct

SEQ ID NO: 25032 - RNA, 432 nt, synthetic construct
  misc_feature 1..432: note = derived and/or modified sequence opt3 from anti-HIV_cap256-048-144077_VR-Chain
  source 1..432: mol_type = other RNA
caggtgaagctggtcgagagcggcgggggagttgtgcaacccggtagatccctcaggctttcttgcgccgcttcaggcttcaccctgagtagctacgcaatgcactgggtacggcaggcccctgggaaaggattggaatgggtggcggtcatctcctatgacggctctaaccgctacacagctgattcggtgaagggtcgatttactatttcacgtgacaatagcaaaaacacgttaaatctgcagatgaacagtctaagaccagaggataccgccgtttattactgtgcaaaggacgtgggggccaataaagatgacgaatgggctacagattattacgacctctccatagcatatccggtccccgatcctagggccgtggtaggagctttcgacatctggggccagggcactaccgttacagtgtctagc

SEQ ID NO: 25033 - RNA, 432 nt, synthetic construct
  misc_feature 1..432: note = derived and/or modified sequence opt3 from anti-HIV_cap256-048-142876_VR-Chain
  source 1..432: mol_type = other RNA
caggtgcaactggtcgagagcggcgggggagttgtgcagcccggtggctccctcagactttcttgcgtagcctcagggttcacctttagtacatacggaatgcactgggtgaggcaggctcctggcaagggtctggaatgggtcgcattcatgcggtttgacgggagcaaccgctattacggagattccgtgaaaggccgattcactatctctcgtgacaattcgaagaacacgttgtatttacagatgatttcactgagagccgaggataccgcggtttaccattgtgctaaagacctaggcgggaataagccagatgaatgggccacagactattacgatctcagcatagcatatccggtgcaagaccccagggccgtcgtgggagtatttgatatctggggtcagggcactattatcaccgttagttcc

SEQ ID NO: 25034 - RNA, 432 nt, synthetic construct
  misc_feature 1..432: note = derived and/or modified sequence opt3 from anti-HIV_cap256-048-140582_VR-Chain
  source 1..432: mol_type = other RNA
caggtgcaactggtcgagagcggcgggggagttgtgcagcccggtagatccctcaggctttcttgcgccgcttcaggcttcagttttagcaactacgcaatggactgggtacggcaggcccctgggaagggactggaatgggtggcgttcgtctcctctgatggctcgaataaaaactatgctgactcagtgaagggtcgctttaccatcagccgagataatagtaaaaacacagtttacttgcagatgaactccttacgtgtggaggacactgccgtctattactgtgcaaaggatctgggggccaataaagacgatgaatgggctacggactattacgatctatctgtggcatatccagtaccggaccccagagccgttgtgggagctttcgatgtctggggccaaggcaccatggtgacagtgagctcc

SEQ ID NO: 25035 - RNA, 432 nt, synthetic construct
  misc_feature 1..432: note = derived and/or modified sequence opt3 from anti-HIV_cap256-048-139355_VR-Chain
  source 1..432: mol_type = other RNA
caggtgcaactggtcgagagcggcgggggagttgtgcagcccggtcggtccctcaggctttcttgcgccgcttcaggcttcacctttagtagctacgcaatgcactgggtacggcaggcccctgggaagggactggaatgggtggcgatcatttcctatgacggctctaacaaatactatgctgattcggtcaagggtcgcttcacaatatcacgagacaatagcaaagggactttgtacttacagatggatggaccacgtccggaggacacggccctgtattactgtgcaaaggatctaggcgaaagagagtgcgaagagtgggccagtgactattacgattttggcagggacttcccctgtcaagatcctagaggggtggttggaacctttgacatctggggtcagggcacaatggtgactgtctcctct

SEQ ID NO: 25036 - RNA, 432 nt, synthetic construct
  misc_feature 1..432: note = derived and/or modified sequence opt3 from anti-HIV_cap256-048-139151_VR-Chain
  source 1..432: mol_type = other RNA
caggtgcaactggtcgagagcggcgggggagttgtgcagcccggtaagtccctcagactttcttgcgccgcttcaggcttcacctttaacacatacgggatgcactgggtaaggcaggcacctggaaaaggcctggaatgggtggccgtcatcagttatgacggtagcattcagaagtacgcggattccgtgaaagggcggttcactatatctcgcgacaattcgaagaacacgttgtatttacaaatgaactcactgagcgttgaggataccgctgtgtactattgtgccaaagacctaggaaagaataaggatgacgaatgggcaacagattactatgacatcagtattgcctacccagtcccggatccccgagctgtggtaggcgtttttgacatctggggccaggggactgtggtcaccgtgtcctct

SEQ ID NO: 25037 - RNA, 432 nt, synthetic construct
  misc_feature 1..432: note = derived and/or modified sequence opt3 from anti-HIV_cap256-048-137672_VR-Chain
  source 1..432: mol_type = other RNA
gaggtgcagctggtcgaaagcggcgggggagttgccagacccggtggctccctcaggctttcttgcgctgcatcagggttcatctttacccactacgccatggactgggtgcggcaagcgcctggaaagggcctggagtgggtagctgtgattagtagcgatggttcctctaaaaactatgccgactcggtcaaggggcgcttcacaatatcacgagataatagcaaaaacactgtgagtttgcagatgaactccttacgtccagaagacacggcagtttactattgtgccaaggatgtgggagctaataaagacgatgagtgggcaaccgactactatgatctgtctatcgcctacccggtccccgaccctagagctgtggtaggcgcctttgatatttggggccaggggacaatggttactgtgagctcc

SEQ ID NO: 25038 - RNA, 432 nt, synthetic construct
  misc_feature 1..432: note = derived and/or modified sequence opt3 from anti-HIV_cap256-048-137506_VR-Chain
  source 1..432: mol_type = other RNA
caggtgagactggtcgacagcggcgggggagttgtgcaacccggtggctccctcaggctttcttgcgccgcttcagggttcacctttagtacatacggaatgcactgggtacggcaggcacctggcaagggtctggagtgggtggccttcatccgcagcgatgggtccaacaaatattacgcggactctgtccagggacgattttcgatttcacgtgataatagcaagaacactttgtatttacagatgaatagtctgagagctgaagacacggccgtgtactattgtgcaaaagatctaggcgagtccgacaaggaagagtggccatctgattactatgacttcggcagggattttaccgggcaagacccgcgggccgttgtgggagtcttcgatatatggggtcagggcacaactgtgatcgtaagctcc

SEQ ID NO: 25039 - RNA, 432 nt, synthetic construct
  misc_feature 1..432: note = derived and/or modified sequence opt3 from anti-HIV_cap256-048-137270_VR-Chain
  source 1..432: mol_type = other RNA
caggtgcaactggtcgagagcggcgggggagttgtgcagcccggtagatccctcaggctttcttgcgccgcttcaggcttcacctttagtagctacgcaatgcactgggtacggcaggcccctgggaagggactggaatgggtggcggtcatgtccccagacggctctaaccgctattacacagattcggtgaaaggtcgattcactatctcacgtgacaatagcaagaacacgttgagtttacagatgaactccctgagaccggaggataccgctgtttattactgtgccaaagacgtgggggcaaataaggatgacgaatgggccacagattattacgacctatctattgcttatcccgtccctgatccaagggcagtggtaggagcctttgacatatggggccaaggcactatggttaccgtgagctcc

SEQ ID NO: 25040 - RNA, 432 nt, synthetic construct
  misc_feature 1..432: note = derived and/or modified sequence opt3 from anti-HIV_cap256-048-135447_VR-Chain
  source 1..432: mol_type = other RNA
gaggtgcagctggtcgaaagcggcggggccgttgtgcaacccggaagatccctcaggctttcttgcaccgcttcaggtttcagttttacaagctacactatccactgggtacggcaggcacctggcaaggggctggagtgggtggccttcatttcctatgacggaacggagaaaaagtacaccgattctgtcaaaggccgctttacaatatcgcgagacaactcaaagaatactttgagcttacagatgaacagtctgcgtccagaagataccgcggtgtattactgtgctaaagacctaggtgcctccaaggatgacgaatgggcaacagattattacgacttctctatcgcctatccggttcaggatcccagagctgtggtcggggcatttgacatttggggacaaggcaccatggtgactgtaagctcc

SEQ ID NO: 25041 - RNA, 432 nt, synthetic construct
  misc_feature 1..432: note = derived and/or modified sequence opt3 from anti-HIV_cap256-048-131966_VR-Chain
  source 1..432: mol_type = other RNA
caggagcaactggtggaaagcggcgggggagtcgttcagcccggtagatccctcaggctttcttgcgccgcttcaggcttcacctttagtaactacgcaatgcactgggtgcggcaggcccctgggaagggactggagtgggtagcggctatgagccatgacggctccgataaatattacgccgactctgtgaagggtcgcttcacaatctcgcgagataattcaaagaacactttgtatatgcagatgaatagcttacgtgcagaagacacggccgtctactattgtgctaaagatcaaggggagagtgaaaaagaggagtgggcatccgactactatgattttggaagagactacccaggccaggatccgaggcgggtggttgccaccttcgctatttggggccaggggacaatggtgactgtctctagc

SEQ ID NO: 25042 - RNA, 432 nt, synthetic construct
  misc_feature 1..432: note = derived and/or modified sequence opt3 from anti-HIV_cap256-048-131008_VR-Chain
  source 1..432: mol_type = other RNA
gaggtgagactggtcgaaagcggcgggggactcgttaagcccggtggctcccttaggctgtcttgcgccgcttcagggttcaccgtgagtagcaactacatgtcctgggtacggcaggcacctggaaaaggcttggagtgggtggccgcgatctcttttgctggtacaaataagtattacgccgactcggtcaaagggcgcttcactatttcacgagataacagcaagaatgcattatatctgcaaatgaacagtctacgtgccgaagacacggctctctactattgtgcaaaagatctgagagagtccgaatgcgaggagtgggcctctgactactatgattttggaagggactacccatgtcaggatccgcggggcgtggttggcacccttgacatatgggggcagggaacaatggtgactgtcagctcc

SEQ ID NO: 25043 - RNA, 432 nt, synthetic construct
  misc_feature 1..432: note = derived and/or modified sequence opt3 from anti-HIV_cap256-048-129369_VR-Chain
  source 1..432: mol_type = other RNA
caggtgcaactggtcgagagcggcgggggagttgtgcagcccggtagatccctcaggctttcttgcgccgcttcaggcttcacctttagtaactacgtaatgcactgggtgcggcaggcacctgggaagggactggaatgggtcgccttggtgagcttcgacggctccaataaatattacgcggattctgttaagggtcgctttacaatctcgcgagacaacagcaaaaatactgtgtatttacagatgaactcactgcgtggggtcgatacggctgtgtactattgtgccaaggacctaggaggcggcgaggtagaagagtgggcaaccgattactatgactggagtattgcctacccagttgaacatccgagagctgtggtcggggtgttcgatatatggggacaaggtacaaaagtgactgtctcctct

SEQ ID NO: 25044 - RNA, 432 nt, synthetic construct
  misc_feature 1..432: note = derived and/or modified sequence opt3 from anti-HIV_cap256-048-128476_VR-Chain
  source 1..432: mol_type = other RNA
gaggtgcaggtcctggaaagcggcgggggactcgttcaacccggtggctcccttagactggcctgcgctgcatctgggttctcatttagtagctacggaatgcactgggtgaggcaggcccctggcaagggtttggagtgggtatccttcatccggtatgacggggcgaacaaataccatgctgattctgtgaagggacgctttattatatcgcgagacgatagcaaaaataccgtctcattacagatgaacagtctgcgtccagaagacacagccgtgtattactgtgcaaaggatctaggcgccaataaagacgatgagtgggctactgactattacgatctctccatcgcatatccggttcccgaccctagagccgtggtcggcgctttcgatatttgggggcagggaacgatggtgaccgtatctagc

SEQ ID NO: 25045 - RNA, 432 nt, synthetic construct
  misc_feature 1..432: note = derived and/or modified sequence opt3 from anti-HIV_cap256-048-128270_VR-Chain
  source 1..432: mol_type = other RNA
caggtgcaactggtcgagagcggcgggggagttgtgcagcccggtagatccctcaggctttcttgcaccgcctcaggcttcacatttcggagttacgctatgcactgggtacgccaggcacctgggaagggactggaatgggtggccttgatcagctatgacggctccaacaaatactatgcggattctgtcaagggtcgattcactatttcgcgtgacaattcaaagaacacgttatacctgcagatgaatagcctaaccagtgaggatacagctgtgtattactgtgccaaagacctcgggggatccaaaactgatgaatggggcaccgactattacgagttttggaacgcatacccagttcaagatccgagagtggtcgtgggcgccttcgacatatgggggcatggaacaatggtaaccgtttctagc

SEQ ID NO: 25046 - RNA, 432 nt, synthetic construct
  misc_feature 1..432: note = derived and/or modified sequence opt3 from anti-HIV_cap256-048-126220_VR-Chain
  source 1..432: mol_type = other RNA
caggtgcaactggtcgagagcggcgggggagttgtgcagcccggtagatccctcaggctttcttgcgccgcttcaggcttcatctttagtccttacgggattcactgggtacggcaggcaccaggaaagggcctggaatgggtggccttgataagccatgacggttccaaaaagtattacgcggattctgtcaaagggcgcttcaccatctcgcgagacaattttaaggatacattatatctgcagatgaactcactacgtggagtggacactgctgtttactattgtgccaaagatctcggcggcggggaggtggaagagtgggcaacggactactatgattggagcaccgcctacccggtcgaacaccccagagctgtggtaggagttttcgacatttggggtcaaggcacaaaggtgactgtcagttcc

SEQ ID NO: 25047 - RNA, 432 nt, synthetic construct
  misc_feature 1..432: note = derived and/or modified sequence opt3 from anti-HIV_cap256-048-125713_VR-Chain
  source 1..432: mol_type = other RNA
gaggtgcagctggtcgaaagcggcgggggactcgttcaacccggtggctcccttagactgtcttgcgaggcctcagggttcagttttagcacctacgaattgaactgggtgaggcaggctcctggaaagggcttagagtgggtagcagtgatctcctatgacggttctaattactattacgccgattcggtcaaagggcggttcacaatttcacgcgacaacagcaagaatactctgtatctacagatgaacagtctccgagcggaagatacggctgtgtactattgtgccaaagacgttggagcaaataaggatgacgagtgggccaccgattactacgacctgtccatagcttatccagtgccggatccccgtgcagtcgtgggcgcctttgacatctggggccaggggacaatggtaactgtttctagc

SEQ ID NO: 25048 - RNA, 432 nt, synthetic construct
  misc_feature 1..432: note = derived and/or modified sequence opt3 from anti-HIV_cap256-048-123934_VR-Chain
  source 1..432: mol_type = other RNA
caggtgcaactggtcgagagcggcgggggagttgtgcagcccggtagatccctcaggctttcttgcgccgcttcaggcttcacctttagtagctacgggatggcatgggtacggcaggcccctggaaagggcctggaatgggtgacagcgatctccttcgctggtactaacaaatattacgccgactctgtcaaggggcgctttacgatttcgcgagataattcaaaagacaccttgtatttacagatggatggactgcgtccagaggacacagcactatactattgtgccaaggatctcggcgaaagagagtgcgaagagtgggctagcgactactatgatttcggcagggactttccggggcaagatcagcgggcagtggccggagttttcgacatgtggggtcagggcactatggtgaccgtcagttcc

SEQ ID NO: 25049 - RNA, 432 nt, synthetic construct
  misc_feature 1..432: note = derived and/or modified sequence opt3 from anti-HIV_cap256-048-122673_VR-Chain
  source 1..432: mol_type = other RNA
gaggtgcaggtcgttgaaagcggcgggggactggtgaagcccggtggctccctcagactttcttgcgccgcttcagggttcacctttagtagccacgtaatgaactgggtgaggcaagcacctggaaaaggcctggagtgggtctcctctatctcgggtgggtcaagcagtaaggactacgccgattccgtgaaaggacggttcacaatttctcgcgacaatagcaagaacactttgtccttacagatgaactcactgcgaccagaagatacggcggtttattactgtgctaaagacgtgggcgccaataaggatgacgagtgggcaaccgattattacgacctaagtatagcctatccggtccccgatcctcgtgctgtggtaggcgcatttgacatctgggggcagggaacaatggttactgtgagctct

SEQ ID NO: 25050 - RNA, 432 nt, synthetic construct
  misc_feature 1..432: note = derived and/or modified sequence opt3 from anti-HIV_cap256-048-122208_VR-Chain
  source 1..432: mol_type = other RNA
agagtgcaggtcgttgagagcggcgggggagtggtaaagcccggtggctccctgaggctctcttgcggggcctcaggattcacctttagtaacgcttggcttagctgggtgcggcaagcacctggcaaaggtctggaatgggtcgccgtgatctcctctgacgggtcgtcaaagaattacgcggatagcgttaaaggacgcttcacaattagtcgagacaactccaagaatactgtgtctttgcagatgaacagcttacgtccagaggatacggctgtctattactgtgccaaagacgtgggcgcaaataaggatgacgaatgggccaccgattattacgacctgtccatagcttatccggtacccgatcctagagcagttgtgggcgcctttgacatctgggggcagggaacaatggtcactgtgtcaagt

SEQ ID NO: 25051 - RNA, 432 nt, synthetic construct
  misc_feature 1..432: note = derived and/or modified sequence opt3 from anti-HIV_cap256-048-121552_VR-Chain
  source 1..432: mol_type = other RNA
caggtgcaactggtcgagagcggcgggggagttgtgcagcccggtggctccctcagactttcttgcgccgcttcagggttcacctttagtagctacgcaatgcactgggtaaggcaggcccctggaaagggcctgaaatgggtggcggacatctcctatgatgcttcttcgaagtactatgccgactcagtcaaaggtcggttcacaattagccgcgataacagtaagaatactttgtacttagaaatgaactccctgcgaccagaggacacggcagtgtattactgtgccaaagatctaggggaacgtgagtgcgaagagtgggcttctgactattacgattttggaagagacttcccgtgtcaggatcccaggggcgttgtgggcacctttgacatatgggggcaaggaacaatggtcactgtgagctcc

SEQ ID NO: 25052 - RNA, 432 nt, synthetic construct
  misc_feature 1..432: note = derived and/or modified sequence opt3 from anti-HIV_cap256-048-120643_VR-Chain
  source 1..432: mol_type = other RNA
caggtgcaactggtcgagagcggcgggggagttgtgcagcccggtagatccctcaggctttcttgcgccgcttcaggcttcaccctgagtgcatacacaatgcactgggtacggcaggcccctgggaagggattggaatgggtgagcgtcatctcctttgcgggcaacaataaatattacgctgactctgtgaagggtcgcttcactatttcgcgagagaacagcaaaaatatgttatatctgcagatgaactcactacgtggggaagatacggccgtttactattgtgcaaaggacctcagagagtttgaatgcgaggagtgggccagtgattactatgacttcggaagggattacccatgtcaagacccgcggggcgtggtcggcacctttgatgtgtgggggcatggatccctggtaacagtttctagc

SEQ ID NO: 25053 - RNA, 432 nt, synthetic construct
  misc_feature 1..432: note = derived and/or modified sequence opt3 from anti-HIV_cap256-048-118458_VR-Chain
  source 1..432: mol_type = other RNA
caggtgcaactggtcgagagcggcgggggagttgtgcagcccggtagatccctcaggctttcttgcgccgcttcaggcttcacctttagtacaagcgggatgcactgggtacggcaggcacctggaaagggcctggaatgggtggccttcatctcctctgaccgctcgaacaaattttacgcggattcagtcaagggtcgattcagcattagtcgtgacaattccaaatatactttgtacttacagatgaactctctgagagctgatgacacggccgtgtatttttgtgcaaaggatctaggggttaataaaaacgacgagtgggccaccgattactatgacctcagcgtggcttacccagtccaagatccgaggggagtggcaggcatattcgacatctggggccaggggacaatggtaactgtttcctca

SEQ ID NO: 25054 - RNA, 432 nt, synthetic construct
  misc_feature 1..432: note = derived and/or modified sequence opt3 from anti-HIV_cap256-048-118112_VR-Chain
  source 1..432: mol_type = other RNA
caggagcaactggtggaaagcggcgggggagtcgttcagcccggtagatccctcaggctttcttgcgccgcttcacagttcacctttagtaactacggcatgcactgggtgcggcaggcacctgggaagggactggtatgggtggccggcatcagcttcgcgggtacaaataaatattacgctgcctccgtcaaggggcgctttactatttctcgagacaactcgaaaaatacgttgtatttacaaatgaactcactgcgtgcagaggataccgccctatactattgtgctaaggacatgagagaatacgagtgcgaagagtgggcaagcgattattacgacttcggaagggattacccatgtcaggacccgcggggcgtggttggcacatttgatatatgggggcagggaactatggtgaccgtcagttcc

SEQ ID NO: 25055 - RNA, 432 nt, synthetic construct
  misc_feature 1..432: note = derived and/or modified sequence opt3 from anti-HIV_cap256-048-116469_VR-Chain
  source 1..432: mol_type = other RNA
caggtgcaactggtcgagagcggcgggggagttgtgcagcccggtagatccctcaggctttcttgcgccgcttcaggcttcacctttagtagctacgcaatgcactgggtacggcaggcccctgggaagggactggaatgggtggcgatcatttcctatgacggctctaacaaatactatgctgattcggtcaagggtcgcttcacaatatcacgagacaatccgaaaaacactttgtacttacagatgaatagcctgcgtgccgaggatacggggctatattactgtgcaaaggacatgggagaaagtgagaaagaagagtgggcctccgattattacgactttggcagagattacccaggccaagagcccagggctatggtggggaccttcgacatctggggacagggtacaatggttactgtgtctagc

SEQ ID NO: 25056 - RNA, 432 nt, synthetic construct
  misc_feature 1..432: note = derived and/or modified sequence opt3 from anti-HIV_cap256-048-113917_VR-Chain
  source 1..432: mol_type = other RNA
gaggtgcagctggtcgaaagcggcgggggactcgttcaacccggtggctcccttagactgtcttgcgccgcttcagggttgaccgtgagtgacacatacatgaactggttaaggcaggcacctggaaagggcctggagtgggtagccgtggtcagctccgatggttctaataaaaactatgcggactcggtgaaggggcggttcactatctcacgcgataatagcaaaaacacggtttacctacagatgaatagtctccgagctgaagacaccgccgtgtattactgtgcaaaggatctgggagccaacaaagacgatgagtgggctacagactattacgatctttccgtcgcatatccagtgccggacccccgtgccgtagttggcgcttttgatgtgtggggccaggggactatggtcaccgtgtctagc

SEQ ID NO: 25057 - RNA, 432 nt, synthetic construct
  misc_feature 1..432: note = derived and/or modified sequence opt3 from anti-HIV_cap256-048-112368_VR-Chain
  source 1..432: mol_type = other RNA
caggtgcaactggtcgagagcggcgggggagttgtgcagcccggtagatccctcaggctttcttgcgccgcttcaggcttcacctttagtcggaacgcaatgcactgggtacgccaggcccctgggaagggactggaatgggtggcggtcatcagctacgacggctccaataaatattacgctgattctgtgaagggtcgattcacaatttcgcgtgacaacagcaaaaatactttgtatttacagatgaactcactgagagccgaggatacggcagtttactattgtgccaaggacctagggggaggcgaagtggaggaatgggctaccgattactatgactggagtacagcatacccagtcgagcatccgagggccgtggtaggcgtttttgatatatgggggcaaggaactaaagtgaccgtctcctct

SEQ ID NO: 25058 - RNA, 432 nt, synthetic construct
  misc_feature 1..432: note = derived and/or modified sequence opt3 from anti-HIV_cap256-048-112047_VR-Chain
  source 1..432: mol_type = other RNA
gaggtgcagctggtcgaaagcggcgggggactcgttcaacccggtggctcccttagactgtcttgcgccgcttcagggttgaccgtgagtggatactatatgagctgggtaaggcaggcacctggcaagggtttagagtggctggccttcatccactttgacgggtccaaaattcattacgcgggatctgtgaagggccggataacagtctcgcgcgataacagcaaaaatactctagacctccagatgaactcactgcgagctgaagatacggccgtgtattactgtgcaaaggacgttggcgatagtaaatccgacgagtgggccaccgattattacgacctttctgtggcttatccagtcccggatccccgtgcagtggtaggggccttcgacatctggggacagggtacaatggttactgtgagctcc

SEQ ID NO: 25059 - RNA, 432 nt, synthetic construct
  misc_feature 1..432: note = derived and/or modified sequence opt3 from anti-HIV_cap256-048-112029_VR-Chain
  source 1..432: mol_type = other RNA
caggtgcaactggtcgagagcggcgggggagttgtgcagcccggtagatccctcaggctttcttgcgccgcttcacagttcacctttagtagctacggcatgcactgggtacggcaggcacctgggaagggactggaatgggtggccggcatctccttcgcgggtattaaaaagtattacgctgactctgtcaaagggcgctttacaatatcgcgagataactcaaagaatactttgtatttacaaatgaacagcctgcgtggagaggacacggccctatactattgtgcaaaagatctcagagaatacgagtgcgaagagtgggccagtgactattacgatttcggcagggactacccatgtcaggatccgcggggcgtggttgggatctttgacatttggggacagggtaccatggtgacagtctcctct

SEQ ID NO: 25060 - RNA, 432 nt, synthetic construct
  misc_feature 1..432: note = derived and/or modified sequence opt3 from anti-HIV_cap256-048-110957_VR-Chain
  source 1..432: mol_type = other RNA
caggtgagactggtcgagagcggcgggggagttgtgaggtccggtcggtctctccgcctttcatgcgccgctagtggcttcacctttagcaacttcgcactgcactgggtacgacaagcccccgggaagggattggaatgggtggcggtcatctcctacgacggcaattctaaattttatgctgattcggtgaagggtcgtttcacaatttcaactgacaacagcaaaaatacgttatacctgcagatgaacagtctaaccgccgaggatacagcagtttattactgtgccaaggacctcgggggaaataaagatgacgaatggggcactgattattacgacttttccgtggcttatcctgtccaggatccaagagcagtgtctggcatattcgacgtatgggggcatggaaccatggttacagtgagctcc

SEQ ID NO: 25061 - RNA, 432 nt, synthetic construct
  misc_feature 1..432: note = derived and/or modified sequence opt3 from anti-HIV_cap256-048-110526_VR-Chain
  source 1..432: mol_type = other RNA
caggtgcaactggtcgagagcggcgggggagttgtgcagcccggtagatccctcaggctttcttgcgccgcttcaggcttcacctttagtaatttcgggtttcactgggtacggcaggcacctggaaagggcctggaatgggtggccgcgatcagcttcgctggtaataacaaatactatgccgactccgtcaaggggcgctttacaatttctcgagaaaattcgaaaaacatattgtacttacagatgaactcactgcgtggagaggatactgcagtgtattactgtgccaaggacctaagagagttcgaatgcgaggagtgggctagcgattattacgactggagtacggcatatccagttgaacatccgagggccgtggtcggcgtgtttgatatctggggccaagggaccaaagtaacagtttcctct

SEQ ID NO: 25062 - RNA, 432 nt, synthetic construct
  misc_feature 1..432: note = derived and/or modified sequence opt3 from anti-HIV_cap256-048-109336_VR-Chain
  source 1..432: mol_type = other RNA
gaggtgcagctggtcgaaagcggcgggggactcgttcaacccggtggctcccagagactttcttgcgccgcttcagggctgaccgtgaacagtaattacatgacatgggtaaggcaggcacctggaaagggcttggagtgggtggccatcattagctccgacggttctgggcagtattacgcggattcggtcaaaggacggttcactatatcacgcgacaacagcaagaatacgttaagtctgcaaatgaactccctacgaccagaagataccgctgtgtattactgtgccaaagacctcggcgcatctaaggatgacgagtgggccacagattattacgactttagcatcgcttatccggttcaggatccccgtgcagtggtcggcgccttcgacatttgggggcagggaactatggtgaccgtatcctca

SEQ ID NO: 25063 - RNA, 432 nt, synthetic construct
  misc_feature 1..432: note = derived and/or modified sequence opt3 from anti-HIV_cap256-048-108152_VR-Chain
  source 1..432: mol_type = other RNA
caggcccaactggtggagagcggcgggggagtcgttcagcccggtagatccctcgtgctttcttcagtagctagtggcttcagcttttccacctacgcaatgcactgggtgaggcaggcccctgggaagggactggaatgggtcgcggtgatctcttatgacggcggtaacaaatactatgctgattcggttaaggggcggttctcaattagccgcgacaatagtaaaaacacagtgtacttgcagataaattccttacgagccgaggatactgcagtctattactgcgccaaggacctgggagctaacaaagatgacgaatgggcaacggattattacgacctatctgtggcctacccagtaccggatccccgtgctgttgtgggcgcctttgacgtctggggccaagggaccatggtgacagtgagctcc

SEQ ID NO: 25064 - RNA, 432 nt, synthetic construct
  misc_feature 1..432: note = derived and/or modified sequence opt3 from anti-HIV_cap256-048-107799_VR-Chain
  source 1..432: mol_type = other RNA
gaggtgcaggtcgttgaaagcggcgggggagtggtacaacccggtagatccctgaggctctcttgcgccgcttcaggcttcacctttagtaactacgcaatggactgggtgcggcaggcccctgggaagggacttgagtgggtcgcgttcgtgagctccgatggctctaataaaaactatgctgactcggttaagggtcgctttacaatctcacgagataatagcaaaaacactctgagtttgcagatgaactccttacgtgccgaagacacggcagtgtactattgtgccaaggaggtcggggaaaataaagatgacgagtgggcttctgattactatgacctgagcattgcatacccaatacacgatccgagagccgtggtaggaggcttcgacatctggggccaggggaccatggttacagtgtcctca

SEQ ID NO: 25065 - RNA, 432 nt, synthetic construct
  misc_feature 1..432: note = derived and/or modified sequence opt3 from anti-HIV_cap256-048-107384_VR-Chain
  source 1..432: mol_type = other RNA
gaggtgagactggtcgaaagcggcggggccctcgttaagcccggaacctcccttaggctgtcttgcgctgcatcaggtttcacatttactcactacgccatggactgggtgcggcaggcgcctggcaaagggttggagtgggtagctatcattagtagcgatggatccacgaagaactatgccgactctgtgaaaggccgcttcaccatatcgcgagataattcaaagaacacattaagcctgcaaatgaatagtctacgtccagaagacactgcagtctactattgtgccaaagatgtgggtgctaacaaggacgatgagtgggcaaccgactactatgatctctccatcgcctacccggttcccgaccctagagctgtggtcggggcctttgatatttggggacagggcacaatggtgaccgtatctagc

SEQ ID NO: 25066 - RNA, 432 nt, synthetic construct
  misc_feature 1..432: note = derived and/or modified sequence opt3 from anti-HIV_cap256-048-106530_VR-Chain
  source 1..432: mol_type = other RNA
gaggtgcagctgctcgaaagcggcgggggacttgtccaacccggtggctccctgagattgtcttgcgccgcttcagggttcacctttagtagctacgcaatggactgggttaggcaggcccctggaaagggcttagagtgggtggcggtaatctcctctgatggttcgaacaaaaattatgctgactcagtgaaggggcggttcacaattagccgcgataacagtaaaaatactctgtacctacagatgtcctctctccgaccagaagacacggccgtctattactgtgcaaaggatgtgggagacagcaaatccgatgagtgggccaccgactattacgatttttcaatagcttatccgatccaggacccccgtgcagttgtgggcgccttcgatatttggggccaagggacaatggtcactgtgagtagc

SEQ ID NO: 25067 - RNA, 432 nt, synthetic construct
  misc_feature 1..432: note = derived and/or modified sequence opt3 from anti-HIV_cap256-048-106464_VR-Chain
  source 1..432: mol_type = other RNA
gaggtgcagatggtccaaagcggcgggggactggttcagcccggtggctccctcagactttcttgcgccgctttcgggtttaccttcacaaaccacgcaatggactgggtgaggcaggtacctggaaagggcctggaatgggtggcctttatctcaagtgatggtagcaataaaaactacgcggactccgtcaaggggcggttcactatttctcgcgataattcgaaaaacacggtgtatttgcagatgagctcattacgaccagaggacaccgctgtttactattgtgccaaggatgtgggagacagtaaatccgatgaatgggcaacagactactatgatctgtctgtcgcctacccggtgcccgaccctcgtgctgtagttggcgcatttgatatatggggccaagggactatggtgaccgtcagctcc

SEQ ID NO: 25068 - RNA, 432 nt, synthetic construct
  misc_feature 1..432: note = derived and/or modified sequence opt3 from anti-HIV_cap256-048-106411_VR-Chain
  source 1..432: mol_type = other RNA
caggtgcaactggtcgagagcggcgggggagttgtgcagcccggtagatccctcaggctttcttgcgccgcttcaggcttcacctttagttacagcgggatgcactgggtacggcaggcacctggaaagggcatggaatgggtggccgtcatctcctatgacggttctaacaaatactatgcggattcggtgaaggggcgcttcacaatttcacgagacaatagcaaaaacactctgtacttgcagatgaatagtttacgtgttgaggatacggctgtgtatcattgtgccaaggacctgggaggcaccaaatccgatgaatgggcaacagactactatgatctatctatagcctacccaatccaagacccgggcgctgtcgtgggggtatttgatatttggggacagggtactatggttaccgtgagctcc

SEQ ID NO: 25069 - RNA, 432 nt, synthetic construct
  misc_feature 1..432: note = derived and/or modified sequence opt3 from anti-HIV_cap256-048-106306_VR-Chain
  source 1..432: mol_type = other RNA
gaggtgcagctggtcgaaagcggcgggggactcgttcaacccggtggctcccttagactgtcttgcgaggcctcagggttcacctttaacaattacggaatggtgtgggtaaggcaggctcctggcaagggtttggaatgggtggcaatcattagttatgacgggacagagaaatactatgtcgatagcgtgaagggacggttcactatatcccgcgacaactctaaaaatacgttatcgctgcagatgaactcactacgagccgaagataccgcggtttactattgtgctaaggaggtgggcgagaataaagacgatgaatgggccagcgactactatgatctcagtatcgcatacccaattcacgacccgcgtgccgtcgtgggcgggtttgatatctggggacagggtacaatggtaactgtttcctct

SEQ ID NO: 25070 - RNA, 432 nt, synthetic construct
  misc_feature 1..432: note = derived and/or modified sequence opt3 from anti-HIV_cap256-048-104496_VR-Chain
  source 1..432: mol_type = other RNA
caggtgcaactggtcgagagcggcgggggactcgttaagcccggtggctcccttagactgtcttgcgccgcttcagggttcacctttagtagctacggaatgcactgggtgaggcaggcacctggcaaaggtttggaatgggtagccttcgtgtcctctgacgggaacaataagaactatgcggattcggtcaaaggacggtttacaatctcacgcgacaatagcaagaacactgtgtacttacagatgaatagtctgcgagttgaggatacggctgtgtattactgtgccaaagacctaggcgcaaacaaggatgacgaatgggccaccgattattacgacctctccgtcgcttatccagtgccggatccccgtgcagtagttggcgccttcgacgtgtgggggcagggaacaatggtcactgtgtctagc

SEQ ID NO: 25071 - RNA, 432 nt, synthetic construct
  misc_feature 1..432: note = derived and/or modified sequence opt3 from anti-HIV_cap256-048-103074_VR-Chain
  source 1..432: mol_type = other RNA
caggtgcacctggtcgagagcggcgccggggttgtgcaacccggaggttccctcagactttcttgcgctgtatcaggcttcacctttaacagttacgggatgcattgggtgaggcaggcacctggaaagggcctggaatgggtcgccgtgatcagctatgacggttccgataaatactatgcggactctgttaaggggcggttcacaatttcgcgcgattcaagcaaaaatactttgtacttacagatgaacagtctgcgagtggaggacacggctgtctattactgtgccaaggatctaggagcaaataaagacgatgaatgggccaccgactattacgatctctccgtggcttacccagtaccggacccccgtgcagttgtgggcgcctttgatgtctggggccaggggacaatggtgactgtgtctagc

SEQ ID NO: 25072 - RNA, 432 nt, synthetic construct
  misc_feature 1..432: note = derived and/or modified sequence opt3 from anti-HIV_cap256-048-100832_VR-Chain
  source 1..432: mol_type = other RNA
caggtgcaactggtcgagagcggcgggggagttgtgcagcccggtagatccctcaggctttcttgcgccgcttcaggcttcacctttagtagctacgggatgcactgggtacggcaggcacctggaaagggcctggaatgggtggccgtcgtgtcctctgacggtacaaacaaaaattatggggattcggttaagggacgcttcactatctcacgagacaacagccgtaatacggtgtacttgcagatgagttccttaagaccagaggataccgcggtctattactgtgctaaagacgtgggcgatacaaagtctgacgaatgggccactgattattacgactttagcattgcatatccggtacaagatcccagggccgttgtgggcgctttcgacatatgggggcagggaaccatggtcacagtgtcctca

SEQ ID NO: 25073 - RNA, 432 nt, synthetic construct
  misc_feature 1..432: note = derived and/or modified sequence opt3 from anti-HIV_cap256-048-100188_VR-Chain
  source 1..432: mol_type = other RNA
caggtgcacctggtcgagagcggcgggggagttgtgcaacccggtagatccctcaggatctactgcgccgtatctgagttcacctttcggaactatgctatgcattgggtgcgccttgcacctggcaaggggctgcagtgggtcgccgtgatttcatacaatggaggcaaaaagtattacgcggacagtgttaaaggtcgattcacaataagccgtgataactccaagaatgctttgtatttacagatgaactctctgagagccgaagacactgggctatactattgtgcaaaagatctcagggaatttgagtgcgaagagtgggcctcggactactacgatttcggacgggagtatccatgtcaggacccgcgcggcgtggtcggcacgtttgatatctgggggcaaggaaccatggtgacagtatcaagc

SEQ ID NO: 25074 - RNA, 432 nt, synthetic construct
  misc_feature 1..432: note = derived and/or modified sequence opt3 from anti-HIV_cap256-048-099645_VR-Chain
  source 1..432: mol_type = other RNA
caggtgcaactggtcgagagcggcgggggagttgtgcagcccggtagatccctcaggctttcttgcgccgcttcaggcttcacctttagtcggtacgcactgcactgggtacgccaggcccctgggaagggattggaatgggtggcggtcatcagctatgacggctcctctaaatactatgctgattcggtgaagggtcgattctcaattagccgtgacaacagtaaatacacattatatctgcagatgaactccctaagagccgatgacactgcagtttacttttgtgccaaggatctcggggtgaataaaaatgacgagtgggctacggattattacgacctgtctgtcgcatacccagtgcaagatccgaggggagtagccggcatattcgacatctggggccaggggaccatggttacagtgagctcc

SEQ ID NO: 25075 - RNA, 432 nt, synthetic construct
  misc_feature 1..432: note = derived and/or modified sequence opt3 from anti-HIV_cap256-048-098137_VR-Chain
  source 1..432: mol_type = other RNA
caggtgcaactggtcgagagcggcgggggagttgtgcagcccggtagatccctcaggctttcttgcgccgcttcaggcttcaccctgcggaactacgcaatgcactgggtacgccaggcccctgggaagggattggaatgggtggcggtcatcagtagcgacggcaataacaaatattacgctgattccgtgaagggtcgatttacagtttctcgtgacaattcgaaagatactttatatctgcagatgaactcactaagaccagaggacacggccctctactattgtgcaaaggatctgggggaaagggagtgcgaagagtgggccagcaattactatgacttcggacgggattacccgtgtcaagacccccgcggcgtggtcggcacctttgatatttgggggcagggaacaatggtgactgtaagttcc

SEQ ID NO: 25076 - RNA, 432 nt, synthetic construct
  misc_feature 1..432: note = derived and/or modified sequence opt3 from anti-HIV_cap256-048-097878_VR-Chain
  source 1..432: mol_type = other RNA
caggtgcaactgctcgagagcggcgggggagtcgttcagcccggtaagtcccttagactgtcttgcgccgcttcaggcttcacctttaatacatacgggatgcactgggtgaggcaggcacctggaaaaggcttgcagtgggtagccgtgatcagttatgacggtactattcaaaagtacgcggatagcgtcaaagggcggttcacgatatcccgcgaaaattctaagaacatgttatatctgcagatgaactcgctacgaggagaggacaccgctgtgtactattgtgccaaagatctccgtgaatttgagtgcgaagagtgggcatcagactactatgatttcggcagagactacccatgtcaggatccgaggggcgttgtggggacatttgacgtctggggacatggtagcctggtgactgtaagttcc

SEQ ID NO: 25077 - RNA, 432 nt, synthetic construct
  misc_feature 1..432: note = derived and/or modified sequence opt3 from anti-HIV_cap256-048-097510_VR-Chain
  source 1..432: mol_type = other RNA
caggtgcaactggtcgagagcggcgggggagttgtgcagcccggtagatccctctggctttcttgcgccgcttcagagttcaccctgaggagttacggcatgcactgggtacggcaggcacctgggaagggattggaatgggtggcctttgtcgcgttcgacgaaagcgataaatattacgctgactccgtgaagggccgctttacaatctctcgagataactcgaaaaatactttatcactgcagatgaacagcctacgtgccgaggacacggcagtttattactgtgccaaggaagtgggtgataataaagacgatgagtgggctagtgactattacgatctctccattgcatatccagtccatgacccgagagccgtggtagggggattcgatatatggggccaaggcaccatggttacagtgtctagc

SEQ ID NO: 25078 - RNA, 432 nt, synthetic construct
  misc_feature 1..432: note = derived and/or modified sequence opt3 from anti-HIV_cap256-048-097313_VR-Chain
  source 1..432: mol_type = other RNA
caggtgcaactggtcgagagcggcgggggactcgttcagcccggtggcgcccttagactgtcctgcttggtgtctgggttcacctttgacgattacgctttacactgggtaaggcaggcacctggaaagggcccagaatgggtggccgtcctgtcaagtgacggtagctataaatactatacagagtccgtgcaggggcggttcactatctctcgcgataactcgaagaatacggtttacctacaaatgaactcactccgaggagtggacaccgcggtctattactgtgctaaagatctgggcggcggggaagtggaggaatgggccacagactattacgattggagcattgcatacccggtagagcatccccgtgccgttgtgggagtctttgacatatggggtcagggcactaaggtgaccgtgagttcc

SEQ ID NO: 25079 - RNA, 432 nt, synthetic construct
  misc_feature 1..432: note = derived and/or modified sequence opt3 from anti-HIV_cap256-048-096626_VR-Chain
  source 1..432: mol_type = other RNA
gaggtgcagctggtcgaaagcggcgggggactcgttcaacccggtgagtcccttagactgtcttgcgccggctcagggttcacctttagtagctactggatgtcctgggtgaggcaggctcctggaaagggcttggaatggatggcattaatctcttatgacggttcgaacaaatactatgtagattcagtgaaggggcggttcacaattagccgcgacaatagtaaaaacactctgtacctacagatgaactccctccgagccgaggatacggcggtctattactgtgctaaggacctgggaggcaataaagatgacgaatgggccaccgattattacgacctttctatagcatacccagtgcaggatccgcgtgttgtggtcggcatctttgacatttgggggcaaggaacaatggtgactgtaagctcc

SEQ ID NO: 25080 - RNA, 432 nt, synthetic construct
  misc_feature 1..432: note = derived and/or modified sequence opt3 from anti-HIV_cap256-048-096483_VR-Chain
  source 1..432: mol_type = other RNA
gaggtgcagctggtcgaaagcggcgggggactcgttcaacccggtagatcccttaggctgtcttgcgccgcttcaggcttcagttttgaggactacgcaatgcactgggtgcggcaggcccctgggaagggattggaatgggtagcgggcatcagcttcgctggtaccaaaaagtattacgccgattccgtgaaagggcgctttacaatttctcgagacaactcgaagaatgcattatatctgcagatgaactcactacgtgccgaggatactgctctctactattgtgcaaaagacctgagagaatacgagtgcgaggaatgggccagcgattattacgacttcggaagggattacccatgtcaggacccgcggggcgtcgtgggcacgtttgatatatgggggcaaggaaccatggttacagtgagttcc

SEQ ID NO: 25081 - RNA, 432 nt, synthetic construct
  misc_feature 1..432: note = derived and/or modified sequence opt3 from anti-HIV_cap256-048-095691_VR-Chain
  source 1..432: mol_type = other RNA
caggtgcaactggtcgagagcggcgggggagttgtgcagcccggtcggtccctcaggctttcttgcgccgcttcaggcttcacctttagtagctacgggatggcatgggtacggcaggcccctggaaagggcctggaatgggtgacagcgatctccttcgctggtactaacaaatattacgccgactctgtcaaggggcgctttacgatttcgcgagataattcaaaagacaccttgtatttacagatggatggactgcgtccagaggacacagcactatactattgtgccaaggatctcggcgaaagagagtgcgaagagtgggctagcaactactatgacttcggcagggattacccgtgtcaagaccccagaggggtggttggaacttttgatatatggggtcagggcaccatggtgacagtcagttcc

SEQ ID NO: 25082 - RNA, 432 nt, synthetic construct
  misc_feature 1..432: note = derived and/or modified sequence opt3 from anti-HIV_cap256-048-095525_VR-Chain
  source 1..432: mol_type = other RNA
caggtgcaactggtccagagcggcgggtccgttgtgcagcccggaaagtctctcagactttcatgcgccgctagtggtttcacctttagctccttcggcatgcactgggtaaggcagacacctgggaaaggactggagtgggtggcagtcatctcttacgacggctcggaaaagtcatatgccgatagcgtgaaaggtcggtttactattagtcgcgacaactccaagaatacgttgtacttacaaatgaactctctgcgagcggaggataccgctgtttattactgtgccaaagacctagggggaacaaaggatgacgaatgggcaactgattattacgacataagcatcgcctatccagtgcaggatccgcgtgctgtcgcaggcgccttcgacatttggggccaggggaccatggtgacagtatcctca

SEQ ID NO: 25083 - RNA, 432 nt, synthetic construct
  misc_feature 1..432: note = derived and/or modified sequence opt3 from anti-HIV_cap256-048-094783_VR-Chain
  source 1..432: mol_type = other RNA
gaggtgcagctggtcgaaagcggcgggggactcgttaagcccggtggctcccttagactgtcttgcgccgcttcagggatcaccttcagtacatacgagatgaactgggtgaggcaagcacctggaaaaggcatggaatgggtagccgtgattagctatgacggttccaataagtactatgcggattctgtcaaagggcggtttactatatcgcgcgacaactcaaagaatacggtgtacttgcagatgaacagcttacgaggagttgataccgctgtgtattactgtgccaaagacctgggcggcggggaggtcgaagagtgggcaacagattattacgactggagtatcgcctacccagtggagcacccgcgtgctgtagttggagtgttcgatatttggggtcagggcactaaggtcaccgtgtcctct

SEQ ID NO: 25084 - RNA, 432 nt, synthetic construct
  misc_feature 1..432: note = derived and/or modified sequence opt3 from anti-HIV_cap256-048-094356_VR-Chain
  source 1..432: mol_type = other RNA
caggtgcaactggtcgagagcggcgggggagttgtgcagcccggtagatccctcaggctttcttgcgccgcttcaggcttcatctttacccactacgcaatggactgggtacggcaggcccctgggaagggactggaatgggtggcggtcattagtagcgatggctcctctaaaaactatgctgactcggtgaagggtcgcttcacaatatcacgagataatagcaaaaacactgttagtttgcagatgaactccttacgtccagaggacacggccgtgtactattgtgcaaaggatgtcggggacaataaatctgatgaatgggccaccgactactatgattttagcatcgcttacccggtgcccgaccctagagcagtagttggagccttcgatctgtggggccaaggcacaatggtgactgtctcctca

SEQ ID NO: 25085 - RNA, 432 nt, synthetic construct
  misc_feature 1..432: note = derived and/or modified sequence opt3 from anti-HIV_cap256-048-090756_VR-Chain
  source 1..432: mol_type = other RNA
caggtgcaactggtcgagagcggcgggggagttgtgagacccggtaggtccctccggctttcttgcgccgtatcaggcttcacctttagtaactacgctatccactgggtgcgccaggcacctgggaagggactggaatgggtcgccgtgattagctatgacggctccgataaatactatgcggactctgttaagggtcgattcacaatatcgcgtgagaatagcaaaaatatgttgtacttacagatgaactcactgagaggggaagatactgctgtgtattactgtgccaaggacctaagggagtttgaatgcgaggagtgggcaagtgattattacgacttcggacgggattacccatgtcaggacccgcgcggcgtcgtgggcacgtttgatgtatgggggcatggatccctcgttaccgtgtctagc

SEQ ID NO: 25086 - RNA, 432 nt, synthetic construct
  misc_feature 1..432: note = derived and/or modified sequence opt3 from anti-HIV_cap256-048-089065_VR-Chain
  source 1..432: mol_type = other RNA
caggtgcaactggtcgagagcggcgggggagttgtgcagcccggtagatccctcaggctttcttgcgccgcttcaggcttcacctttagtacatacgcaatgcactgggtacggcaggcccctgggaagggactggaatgggtggcgttgatcagctatgacggcactaacaaatactatgtcgattccgtgaagggtcgcttcacgatttctcgagacaattcgaaaaacaccttatacctgcagatgaactcactaacagctgaggatactgccgtttattactgtgcaaaggacctcgggggaaataaagatgacgaatggggcaccgattattacgactttagcgtggcctacccagtccaagatccgcgtgctgtgagtggcatattcgacgtatgggggcatggaacaatggttaccgtgtcctct

SEQ ID NO: 25087 - RNA, 432 nt, synthetic construct
  misc_feature 1..432: note = derived and/or modified sequence opt3 from anti-HIV_cap256-048-084986_VR-Chain
  source 1..432: mol_type = other RNA
caggtgcaactggtcgagagcggcgggggagttgtgcagcccggtagatccctcaggctttcttgcgccgcttcaggcttcacctttagtgactacgcaatgcactgggtacggcaggcccctgggaagggactggaatgggtggcgttgatcagctatgatggctccaacaaatactatgctgactctgtcaagggtcgcttcacaatttcgcgagataatagcaaaaacactttatacctgcagatgtcaagtctaacggccgaggacaccgcagtgtattactgtgccaaggatctcgggggaaataaaaacgacgaatgggctacagattattacgacctgtccatagcatacccaatccatgatccgcgtgccgttcttggcgcttttgacgtgtggggccaagggactatgctgaccgtctctagc

SEQ ID NO: 25088 - RNA, 432 nt, synthetic construct
  misc_feature 1..432: note = derived and/or modified sequence opt3 from anti-HIV_cap256-048-083355_VR-Chain
  source 1..432: mol_type = other RNA
caggtgcaactggtcgagagcggcgggggagttgtgcagcccggtagatccctcaggctttcttgcgccgtatcaggcttcatctttagtagctacgctatgcggtgggtgcgccaggcacctgggaagggactggaatgggtcgccgtgatttcctatgacggctctaaaaccaactacgcggattcggttaagggtcgattcacaatatcacgtgacaatagcaaaaacactttgtatttacagatgaatagtctgacgtccgaggataccgctgtgtactattgtgccaaggacctagggggatctaaaacagatgaatggggcactgactactatgagttttggaacgcatacccagtccaagatccgagagtggtagttggcgccttcgacatctgggggcacggaaccatggtgacagtcagctcc

SEQ ID NO: 25089 - RNA, 432 nt, synthetic construct
  misc_feature 1..432: note = derived and/or modified sequence opt3 from anti-HIV_cap256-048-082462_VR-Chain
  source 1..432: mol_type = other RNA
caggtgcacctggtcgagagcggcgggggagttgtgcaacccggtaagtccctcagactttcttgcaccgcctcaaggttcatctttcggaactacgctatggactgggtacgccaggcacctggcaaagggctggaatgggtggccgtcattagttatgatggagtgaaggagcattacgcggaaagcgttaaaggccgattcacaatatcccgtgacaattctaagaacactgtgtatttgcagatgaactcgttaagagtcgaggatacggctgtgtactattgtgccaaagacctgggtgcaaataaggatgacgaatgggccaccgattactatgacctatcagtagcttacccagttccggatcccagggcagtggtcggggcctttgacgtgtggggacagggcacaatggtgactgtcagcagt

SEQ ID NO: 25090 - RNA, 432 nt, synthetic construct
  misc_feature 1..432: note = derived and/or modified sequence opt3 from anti-HIV_cap256-048-082246_VR-Chain
  source 1..432: mol_type = other RNA
caggtgcacctggtcgagagcggcgggggagttgtgcaacccggtagatccctcaggatctcttgcgccgcttcaggcttcacctttagtaagaacgcaatgcattgggtacggcaggcccctgggaaaggacttgaatgggtggcgttcgtcgcttttgacgagagcgataagtactatgccgactccgtgaaaggccgcttcacaatttctcgagataattcgaagaacatactgtcattgcagatgaatagcttacgtgcagaagacactgccgtttactattgtgctaaagaggtggatgaatacaaggacgatgagtgggcaagtgactattacgatctgtccatcgcctatccagtcagagacccgagggctgtggtaggtgggtttgatatttggggacagggcacgatggttaccgtgtctgcc

SEQ ID NO: 25091 - RNA, 432 nt, synthetic construct
  misc_feature 1..432: note = derived and/or modified sequence opt3 from anti-HIV_cap256-048-080752_VR-Chain
  source 1..432: mol_type = other RNA
caggtgcaactggtcgagagcggcgggggagttgtgcagcccggtggctccctcagactttcttgcgccgcttcagggttcacctttagtaattacggaatgcactgggtaaggcaggcacctggcaagggtctggaatgggtggccttcatccggtatgacggggatattacatactatgtcgacagcgtgaaaggacgctttactatatcccgagataattctaagaacgcgttgtacttacagatgaactcgctgcgtgctgaggacacggccctatattactgtgcaaaagatctcagagaatatgagtgcgaagagtgggcctcagactactacgatttcggcagggagtatccatgtcaagacccgcggggcgttgtggggacctttgatatctggggacagggtacaatggtcactgtgagcagt

SEQ ID NO: 25092 - RNA, 435 nt, synthetic construct
  misc_feature 1..435: note = derived and/or modified sequence opt3 from anti-HIV_cap256-048-078409_VR-Chain
  source 1..435: mol_type = other RNA
caggtgcaactggtcgagagcggcgggggagttgtgcagcccggtagatccctcaggctttcttgcgccgcttcaggcttcacctttaataattacgcaatggactgggtacggcaggcccctgggaagggactggaatgggtggcgttgatcagttatgatggcagcaacaaatactatgctgagtccgtcaagggtcgcttcacaatttctcgagacaattcgaaaaacactttatacctgcagatgaactcactacgtgccgaagatacggcagtgtattactgtgccaaggacgttggggagaaacaaagcatgatgagatgggctaccgattattacgacctcagtatagcatacccagtgccggatcccagggccgtcgtgggagcttttgacctgtggggccggggcacaatggtaactgtttcctct

SEQ ID NO: 25093 - RNA, 432 nt, synthetic construct
  misc_feature 1..432: note = derived and/or modified sequence opt3 from anti-HIV_cap256-048-078273_VR-Chain
  source 1..432: mol_type = other RNA
gaggtgcagctggtcgaaagcggcgggggactcgttcaacccggtggctcccttagactgtcttgcgccgcttcagggttcaccgtgagtagcaactacatgtcctgggtaaggcaggcacctggaaagggcttggagtgggtggccgtcatctcttcggacggttcaaataaaaactatgcggatagcgtgaaggggcggtttacaattagtcgcgacaattccaaaaacactttattcctgcagatgaactctctacgaccagaagatacggctgtttacttttgtgccaaggacctcggagcaaataaagatgacgagtgggccaccgattattacgacctgagcatagcttatccggtgcacgatccccgtgcagtcgtgggcatcttcgacctttggggccaggggacaatggtaactgtttcctca

SEQ ID NO: 25094 - RNA, 432 nt, synthetic construct
  misc_feature 1..432: note = derived and/or modified sequence opt3 from anti-HIV_cap256-048-078062_VR-Chain
  source 1..432: mol_type = other RNA
gacgtgtacctggtcgagagcggcgggggactcgttcagcccggtggctcccttagactgtcttgcaccgcctcagggatcacattcagtacttatgaaatgaactgggtgaggcaagctcctggaaagggcttggagtgggtagcatttgtggccttcgatggtagcgacaaatactatgcggattccgtcaaggggcggtttgtgatttctcgcgacaattcgaaaaacacgttatcactgcagatgaatagcctacgagctgaagataccgccgtttactattgtgcaaaggaggtgggagaagacaaagatgacgagtgggccagtgattactatgacctctccatagcttacccagtccacgatccgcgtgcagtggtaggcggcttcgacatctgggggcagggaacaatggttactgtgtctagc

SEQ ID NO: 25095 - RNA, 432 nt, synthetic construct
  misc_feature 1..432: note = derived and/or modified sequence opt3 from anti-HIV_cap256-048-077798_VR-Chain
  source 1..432: mol_type = other RNA
caggtgcaactggtcgagagcggcgggggagttgtgcagcccggtagatccctcaggctttcttgcgccgcttcaggcttcacctttagtaactacgggatgcactgggtacggcagacacctggaaagggcctggaatgggtggcagtcatcagctatgacggttccaataaattctacgccgattctgtgaaggggcgctttactatttcgcgagacaacagcaaaaatacgttgtatttacagatgaactcactgcgtgttgaggataccgcggtgtaccattgtgctaaggacctaggaggcagtaaatccgatgaatgggccacagactattacgattggtctatagcatatccagtccacgacccgagagccgtggtaggcgttttcgatatctgggggcaaggaactctcgtgaccgtcagctcc

SEQ ID NO: 25096 - RNA, 432 nt, synthetic construct
  misc_feature 1..432: note = derived and/or modified sequence opt3 from anti-HIV_cap256-048-073853_VR-Chain
  source 1..432: mol_type = other RNA
gaggtgcagctggtcgaaagcggcgggggactcgttaagcccggtggctcccttagactgtcttgcgccgcttcagggttcacctttagtgacgcatggatgaactgggtgaggcaagcccctggaaaaggcttggagtgggtagcgggtatcagcttcgctgggacaaataagtactatgccgattccgtgaaaggacggtttactatttctcgcgacaactcgaagaatacgttatacctgcagatgaactcactacgagcagaagataccgccctctattactgtgctaaagacatgcgtgagtatgaatgcgaggagtgggcaagcgattactatgacttcggcagagattacccatgtcaggacccgaggggcgtcgtggggacatttgatatatggggacagggtactatggttaccgtgagttcc

SEQ ID NO: 25097 - RNA, 435 nt, synthetic construct
  misc_feature 1..435: note = derived and/or modified sequence opt3 from anti-HIV_cap256-048-071661_VR-Chain
  source 1..435: mol_type = other RNA
caggtgcaactggtcgagagcggcgggggagttgtgcagcccggtagatccctcggcctttcttgcgaagtatcagggttcacctttagtgactacttcatgagctggatcaggcaggcccctggaaagggcctggagtgggtggctgtcatttcccacgatggtaacaataaatattacccagactctgtgcaggggcggtttacaatatcgcgcgaaaactcaaagaatactttgtatttacaaatgaacagcctgaaaccggaggatacggcagtttacttctgtgccaaggacctaggaggcgaaagtgaggtggaggaatgggcgtccgattattacgactttggccgagatatccccgggcctgacccacgtggagtcgtgggtaccctcgatatttggggccatgggacaatggtaactgtttctagc

SEQ ID NO: 25098 - RNA, 432 nt, synthetic construct
  misc_feature 1..432: note = derived and/or modified sequence opt3 from anti-HIV_cap256-048-071360_VR-Chain
  source 1..432: mol_type = other RNA
caggtgcaactggtcgagagcggcgggggagttgtgcagcccggtagatccctcaggctttcttgcgccgcttcaggcttcaccctgacaaactacgcaatggactgggtacggcaggcccctgggaagggattggaatgggtggcggtcatcagtagcgatggctccaataaaaactatgaggactctgtgaagggtcgctttactatttcgcgagataatagcaaaaacacgttatacctgcagatgtcaagtctacgtccagaagacaccgctgtttattactgtgccaaggatgtgggggacaataaatccgatgagtgggcaacagactattacgatttctctatagcctatccggtccccgaccctagagctgtggtaggagcatttgatctctggggccaaggcactatggttaccgtgagctcc

SEQ ID NO: 25099 - RNA, 432 nt, synthetic construct
  misc_feature 1..432: note = derived and/or modified sequence opt3 from anti-HIV_cap256-048-070955_VR-Chain
  source 1..432: mol_type = other RNA
gaggtgcagctggtcgaaagcggcgggggactcgttcaacccggtggctccgtgagactttcttgcgccgtatcagggttcacctttagtagctactggatgtcctgggtgaggcaggctcctggaaagggcctggagtgggtcgcagtgatctctgactcgggttcaaataaatattacgccgatagcgttaaggggcggttcacaattagtcgcgacaattccaaaaacactttgtatttacagatgaactctctgcgagcggaagatacggctgtgtacttttgtgccaaggacctaggaggccgtgagaccgaagagtgggcaagcgattattacgacttcggcagagattttccagggcaggaccaaagggccgtcgctggagtgttcgatatgtggggtcagggcacaatggtaactgtttcctca

SEQ ID NO: 25100 - RNA, 432 nt, synthetic construct
  misc_feature 1..432: note = derived and/or modified sequence opt3 from anti-HIV_cap256-048-070061_VR-Chain
  source 1..432: mol_type = other RNA
gaggtgcagctgctcgaaagcggcgggggacttgtccaacccggtggctccctgagattgtcttgcgccgcttcagggttcacctttagtagctacgcaatgcactgggttaggcaggcccctggaaagggcttagagtgggtggcggtaacatcctatgacggttctaacaaatactatgctgattcggtgaaggggcggttcactatctcacgcgacaatagcaaaaacacgctgtacatgcagatgaatagtctacgagccgaagataccgcagtctattactgtgccaaggaccagggagagtccgaaaaagaggagtgggcttctgattattacgactttggccgtgattacccaggcagagacccgaggcgggtggttgcaacattcgccatttgggggcaaggaactatggtgaccgtcagctcc

SEQ ID NO: 25101 - RNA, 432 nt, synthetic construct
  misc_feature 1..432: note = derived and/or modified sequence opt3 from anti-HIV_cap256-048-069669_VR-Chain
  source 1..432: mol_type = other RNA
caggtgcaactggtcgagagcggcgggggagttgtgcagcccggtagatccctcaggctttcttgcgccgtatcaggcttcacctttagtaagttccctatgcactgggtgcggcaggctccagggaaaggactggaatgggtcgcagtgatcagctacgacggcaacaagaaatattacgttgattccgccaagggtcgctttacaatttctcgagacaattcgcgtaaaactttgtatttacagatgacggggctgagaccggaggataccgcggtgtactattgtgctaaggacctaggaggcggcgaatgcgagacatgggcctcagattactatgacttcgggaaggattacccctgtctcgaccctagggatgtcgtgggaacttttgacatatggggtcaaggcaccctggtaacagttagcagt

SEQ ID NO: 25102 - RNA, 432 nt, synthetic construct
  misc_feature 1..432: note = derived and/or modified sequence opt3 from anti-HIV_cap256-048-069205_VR-Chain
  source 1..432: mol_type = other RNA
caggtgcaactggtcgagagcggcgggggagttgtgcagcccggtagatccctcaggctttcttgcgccgcttcaggcttcacctttagtagctacgcaatgcactgggtacggcaggcccctgggaagggactggaatgggtggtcgtgatctccaacgacggcaataacaaatattacgcggattctgttaagggtcgcttcacaatttcgcgagacaattcaaagaacactgtgtatttgcagatgaatagcttacgtgctgaggatacggccgtctactattgtgcaaaagacgtgggggataccaaaaaggacgaatgggccacagattactatgacctgagtatagcttacccagtacaagatccgcaggcagttgtgggagcctttgacatctggggccagggcactatggtcaccgtgtcctct

SEQ ID NO: 25103 - RNA, 432 nt, synthetic construct
  misc_feature 1..432: note = derived and/or modified sequence opt3 from anti-HIV_cap256-048-068882_VR-Chain
  source 1..432: mol_type = other RNA
caggtgcaactggtcgagagcggcgggggagttgtgcagcccggtagatccctcaggctttcttgcgccgcttcaggcttcacctttagtacatacgcaatgcactgggtacggcaggcccctgggaagggactggaatgggtggcgttgatcagctatgacggcactgataaatactatgctgactccgtcaagggtcgcttcacgatttctcgagataactcgaaaaataccgtgtacttacagatgaactcactgcgtggggttgacacagccgtgtattactgtgcaaaggatctaggaggcggcgaggtcgaagagtgggccactgactattacgattggagcaccgcttacccagtggaacatccgagagcagtagttggggtgtttgacatatggggacaaggtacaaaagtcaccgtgagttcc

SEQ ID NO: 25104 - RNA, 432 nt, synthetic construct
  misc_feature 1..432: note = derived and/or modified sequence opt3 from anti-HIV_cap256-048-067764_VR-Chain
  source 1..432: mol_type = other RNA
gaggtgcagctggtccaaagcggcgggggactcgttaagcccggtggctcccttagactgtcttgcgccgcttcagggttcacctttagtacatacagcatgaactgggtgaggcaggcacctggaaaaggcttggaatgggtagccgtgatctcctctgacggttcgtcaaagaattatgcggatagcgtcaaagggcggttcactattagtcgcgacaactccaagaatacggtgtctttacagatgaacagcctgcgaccagaggataccgctgtttactattgtgccaaagacgtgggagcaaataaggatgacgaatgggccacagattactatgacctatccatagcttacccggtccccgatcctcgtgcagtggtaggcgcctttgacatctggggccaggggactatggttaccgtgtcaagt

SEQ ID NO: 25105 - RNA, 432 nt, synthetic construct
  misc_feature 1..432: note = derived and/or modified sequence opt3 from anti-HIV_cap256-048-066845_VR-Chain
  source 1..432: mol_type = other RNA
caggtgctgctcgtcgagagcggcgggggagttgtgcaacccggtggctcccttaccctgtcttgcgccgcttcagggttcacatttagtaactacggaatgcactgggtaagacaggcacctggcaagggtttggaatgggtggccttcatcaggtatgacgggaataacaaatactatgcggatagcgtcaagggacggtttactatttcccgcgacaattctaaagatacgttatacctgcagatggacggcctacgaccagaggataccgctctctattactgtgccaaggacctgggcgaacgtgagtgcgaagagtgggcatcgaactattacgatttcgggagagactacccgtgtcaggatcccaggggagtggttggtacatttgacatatggggccaagggactatggtgaccgtctcaagc

SEQ ID NO: 25106 - RNA, 432 nt, synthetic construct
  misc_feature 1..432: note = derived and/or modified sequence opt3 from anti-HIV_cap256-048-065226_VR-Chain
  source 1..432: mol_type = other RNA
gaggtgcagctggtcgaaagcggcgggggactcgttaagcccggtggctcccttaggctgtcttgcgtggcctcagggttcacctttagtaactacggaatgcactgggtaaggcaagctcctggcaaaggtttggtgtgggtcgcagggatcagcttcgccggaacaaataagtattacgcggcttccgtgaaaggccggtttactatttctcgcgacaactcgaagaatacgttatatctgcagatgaactcactacgagccgaggataccgcactctactattgtgccaaagacatgcgtgaatacgagtgcgaagagtgggctagcgattattacgacttcggcagagattacccatgtcaggacccgagaggggttgtgggaacatttgatatatggggtcagggcactatggtcaccgtgagttcc

SEQ ID NO: 25107 - RNA, 432 nt, synthetic construct
  misc_feature 1..432: note = derived and/or modified sequence opt3 from anti-HIV_cap256-048-063717_VR-Chain
  source 1..432: mol_type = other RNA
caggtgcaactggtcgagagcggcgggggagttgtgcagcccggtagatccctcaggctttcttgcgccgcttcaggcttcagttttagcaaccacgcaatggactgggtacggcaggcccctgggaagggactggaatgggtggcggtcatctcctctgatggctcggacaaaatttacgctgagtcagtgaagggtcgcttcaccataagccgagataatagtaaaaacacattgtatttacagatgaactccctgcgtgttgaagacactgccgtgtacttttgtgcaaaggatctaggggccaataaagacgatgagtgggctacggactattacgatctctctatcgcatatccagtcccggaccccagagccgtggtaggagctttcgatatttggggccaaggcaccatggttagcgtgtcctca

SEQ ID NO: 25108 - RNA, 432 nt, synthetic construct
  misc_feature 1..432: note = derived and/or modified sequence opt3 from anti-HIV_cap256-048-063150_VR-Chain
  source 1..432: mol_type = other RNA
gaggtgcagctggtcgaaagcggcgggggagttgtgcaacccggtagatccctcaggctttcttgcgccgcttcaggcttcacctttagtagctacgcaatgcactgggtacggcaggcccctgggaagggactggagtgggtggcgcatatccgctatgacggctccaataaatactatattgattctgtccagggtcgattcacaatatcgcgtgacaatccaaagaacactttgtacttacagatgaactcactgagaacggaagataccgctgtgtattactgtgccaaagacctagggggaggcgaggttgaagagtgggcaacagattattacgactggagcatcgcctacccggtggagcaccccagggctgtcgtgggcgtatttgatatttgggggcaaggaactaaggttaccgtgagttcc

SEQ ID NO: 25109 - RNA, 432 nt, synthetic construct
  misc_feature 1..432: note = derived and/or modified sequence opt3 from anti-HIV_cap256-048-062431_VR-Chain
  source 1..432: mol_type = other RNA
caggtgcaactggtcgagagcggcgggggagttgtgcagcccggtagatccctcaggctttcttgcgccgcttcaggcttcacctttagtaacttcgcaatggactgggtacggcaggcccctgggaagggactggaatgggtggcggtcatcagctccgatggctctaaaaagaattacggtgactcggtgaaagggcgctttacaatttcacgagataacagcaagaatactttgttcttacagatgaacagtctgcgtccagaggacacggctctatattactgtgccaaagatctcggaggctataagtccgacgaatgggcaaccgattactatgacctgtctatagcctacccggttcaagatcccagaccttggcttgagctgttgtatatctggggccagggggctatggtgacagtcagctcc

SEQ ID NO: 25110 - RNA, 432 nt, synthetic construct
  misc_feature 1..432: note = derived and/or modified sequence opt3 from anti-HIV_cap256-048-060745_VR-Chain
  source 1..432: mol_type = other RNA
caggtgcaactggtcgagagcggcgggtccgttgtgcagcccggaagatctctcaggcttacctgcacagcctcaggtttcacttttagtcactacgctatggactgggtacggcaggcacctggcaaggggctggaatgggtggccgtcatcagctccgatgcgacgaacaaaaattatgctgactctgtgaagggacgcttcaccatttcgcgagataacagcaaaaatacagtttacttgcagatggactcattacgtgccgaggatactgcagtgtattactgtgccaaggacgtcggcgattataaagacgatgaatgggctaccgactactatgattttagtatagcatacccagtgccggaccccagagccgtagttggtgctttcgatttttgggggcaaggaacaatggtgaccgtctcctct

SEQ ID NO: 25111 - RNA, 432 nt, synthetic construct
  misc_feature 1..432: note = derived and/or modified sequence opt3 from anti-HIV_cap256-048-060420_VR-Chain
  source 1..432: mol_type = other RNA
caggtgcaactggtcgagagcggcgggggagttgtgcagcccggtagatccctcaggctttcttgcgccgcttcaggcttcacctttagtagctacgggatggcatgggtacggcaggcccctggaaagggcctggaatgggtgacagtcatctccttcgcgggtgtgaaaaagtattacgctgactctgttaaagggcgctttactatttcgcgagataactcaaagggaacgttgtatttacagatgaatagcctgcgtgccgaggacaccgcagtgtactattgtgccaaagatgtcggcgacacaaagaaggatgaatgggctactgactactatgatctaagtatagcatacccagtgcaagacccgcaggccgtagttggcgctttcgatatctgggggcagggaaccatggtgacagtctcctct

SEQ ID NO: 25112 - RNA, 435 nt, synthetic construct
  misc_feature 1..435: note = derived and/or modified sequence opt3 from anti-HIV_cap256-048-060014_VR-Chain
  source 1..435: mol_type = other RNA
caggtgcaactggtcgagagcggcgggggagttgtgcagcccggtaggtccctcaggctttcttgcgccgcttcaggcttcacctttagtaactacgggatgcactgggtacggcaggcacctggaaagggcctggaatgggtggccttgatcagccatgacggttccaataaaaacttcgcggattctgtcaaggggcgctttacaatttcgcgagacaattcaaagaacactttatatctgcagatgaatagcctacgtacggaggataccgctatatactattgtgccaaagacctcggaggcgaaagtgagatcgaagagtggccatccgattactatgacttcggcagagattacccggtgcccgaccctagaggggttgtgggaacatttgatttctggggtcaaggcactatggtcaccgtgtctagc

SEQ ID NO: 25113 - RNA, 432 nt, synthetic construct
  misc_feature 1..432: note = derived and/or modified sequence opt3 from anti-HIV_cap256-048-059747_VR-Chain
  source 1..432: mol_type = other RNA
caggtgcaactggtcgagagcggcgggggagttgtgcagcccggtagatccctcaggctttcttgcgccgcttcaggcttcacctttacacactacgcaatggactgggtacggcaggcccctgggaagggactggaatgggtggcggtcatcagtagcgatggctcctctaaagactatgctgattcggtgaagggtcgcttcactatttcacgagacaacagcaaaaatacgttgagtttacagatgaactccctgcgtccagaggataccgccgtttactattgtgcaaaggacctaggggcctctaaagatgacgaatgggctacagattactatgacctcagcatagcatacccggtgcatgatcccagagccgtcgtgggaggctttgacatctggggccaagggactatggtaaccgtttcctca

SEQ ID NO: 25114 - RNA, 432 nt, synthetic construct
  misc_feature 1..432: note = derived and/or modified sequence opt3 from anti-HIV_cap256-048-058393_VR-Chain
  source 1..432: mol_type = other RNA
caggtgcaactggtcgagagcggcgggggagttgtgcagcccggtggctccctcagactttcttgcgccgcttcagggttcacctttaacacatacggaatgcactgggtaaggcaggcacctggcaagggtctggaatgggtgactttcatccggtatgacgggagtaatgagtactatgccgatagcgtcaaaggacgctttacgatttcccgagacaactctaagaataccttgtacttacagatgaactcgctgtcagtggaagatacagcggtttattactgtgctaaagacctaggcaagaataaagatgacgagtgggccactgattattacgacataagcatcgcatacccagtgccggatccccgtgccgtcgtgggcgtattcgacatttgggggcaaggaaccgttgtgacagtcagttcc

SEQ ID NO: 25115 - RNA, 432 nt, synthetic construct
  misc_feature 1..432: note = derived and/or modified sequence opt3 from anti-HIV_cap256-048-058159_VR-Chain
  source 1..432: mol_type = other RNA
caggtgcaactggtcgagagcggcgggggagttgtgcagcccggtagatccctcaggctttcttgcgccgcttcaggcttcacctttagtagctaccctatgcactgggtacggcaggcaccagggaaaggactggaatgggtggccgtcatctccttcgcgggcacaaacaaatattacgctcattctgtgaagggtcgctttactatttcgcgagacaattcaaagaacacgttgtatttacagatgaatagcctgcgtgccgaggataccgcactatactattgtgccagagacctcagggaaagtgagtgcgaagagtgggcttccgattactatgacttcgggcgggagtacccgtgtcaagatccccgcggagttgtgggcacatttgacatatggggcagagggactatggtcaccgtgtctagc

SEQ ID NO: 25116 - RNA, 432 nt, synthetic construct
  misc_feature 1..432: note = derived and/or modified sequence opt3 from anti-HIV_cap256-048-057127_VR-Chain
  source 1..432: mol_type = other RNA
gacgtgtacctggtcgagagcggcgggggactcgttcagcccggtggctcccttagactgtcttgcgtggcctcagggatcaccttcagtagctatggaatgcactgggtaaggcaagctcctggcaagggtttggaatgggcagcctttattcggtacgatgggcgcaacaaatattacgcggactccgtgaagggacgattcacaatatctcgtgataattcgaaaaacactttatcactgcagatgaataacctaagagctgaggacacggccgtctattactgtgcaaaggaagtgggcgataataaagacgatgagtgggccagcgactattacgatctcagtatcgcttacccagttcaggacccgagggcagtggtcggcgggtatgatatttggggacagggtaccatggtgacagtatcctct

SEQ ID NO: 25117 - RNA, 432 nt, synthetic construct
  misc_feature 1..432: note = derived and/or modified sequence opt3 from anti-HIV_cap256-048-056251_VR-Chain
  source 1..432: mol_type = other RNA
gaggtgcagctggtcgaaagcggcgggggactcgttcaacccggtagatcccttaggctgtcttgcgccggctcagggttcacctttagtaacttcggatttcactgggtgcggcaggctcctggcaagggtttggagtgggtagcagccatcagcttcgcggggtacaataaatattacgctgactccgtgaagggacgctttacaatttctcgagaaaactcgaataacatgttatatctgcagatgtcaagcctacgtgccgaggatactgcagtctactattgtgccaaagacctcagagaaagtgagtgcgaggaatgggcttccgattactatgacttcggcaaggattacccatgtcaggacccgaggggcgtggttgggacgtttgatgtgtggggacatggttctctggtcaccgtgagctcc

SEQ ID NO: 25118 - RNA, 432 nt, synthetic construct
  misc_feature 1..432: note = derived and/or modified sequence opt3 from anti-HIV_cap256-048-055421_VR-Chain
  source 1..432: mol_type = other RNA
caggtgcaactggtcgagagcggcgggggagttgtgcagcccgccagatccctcaggctttcttgcgctgcatcaggtttcatctttagtacctacggcatgcactgggtacggcaggcccctgggaagggactggaatgggtggcggtcattagctccgacggttcttcgaaagattatgctgactcagtgaagggccgcttcacaataagccgagataacagtaaaaatactttgtccttacagatgaactctctgcgtccagaggacacggccgtttactattgtgcaaaggatctaggggccagcaaagacgatgaatgggctaccgactactatgatttttccatcgcatacccggtgcaagaccccagagccgtcgtgggagctttcgatatttggggccagggcacaatggtaactgtttcaagt

SEQ ID NO: 25119 - RNA, 432 nt, synthetic construct
  misc_feature 1..432: note = derived and/or modified sequence opt3 from anti-HIV_cap256-048-054989_VR-Chain
  source 1..432: mol_type = other RNA
caggtgcaactggtcgagagcggcgggggagttgtgcagcccggtggctccctcagactttcttgcgccgcttcagggttcacctttagtacaaacggaatgcactgggtaaggcaggcacctggcaagggtctggaatgggtggccttcatccggtacgacgggagcaataaatattacgcggattccgtcaagggacgctttactatttctcgagacaactcgaaaaatacggtgtatttgcagatgaactcattacgtggcgttgataccgctgtgtactattgtgccaaggacctgggcgggggagaggtcgaagagtgggcaacagattactatgactggagcatagcctacccagtggaacatccgagagctgtagttggtgtgttcgatatctggggccaagggactaaagtcaccgtgagttcc

SEQ ID NO: 25120 - RNA, 435 nt, synthetic construct
  misc_feature 1..435: note = derived and/or modified sequence opt3 from anti-HIV_cap256-048-054759_VR-Chain
  source 1..435: mol_type = other RNA
caggtgcaactggtcgagagcggcgggggagttgtgcagcccggtagatccctcaggctttcttgcgccgcttcaggcttcagttttagcaagaacgggatgcactgggtacggcaggcacctggaaaaggcctggaatgggtggccttcgtcgcgtttgacgagtccgataagtactatgctgactctgtgaaaggtcgcttcaccatctcgcgagataattcaaagaacacattgagcttacagatgaatagtctgcgtgttgaagacactgccgtgtactattgtgcaaaagaggtcggggaaaacaaggatgacgagtgggccgctccagattactatgacttttccattgcatacccggtgcaagatcccagagccgtagttggaggcttcgacatatggggccaggggacgatggtgaccgtctctagc

SEQ ID NO: 25121 - RNA, 432 nt, synthetic construct
  misc_feature 1..432: note = derived and/or modified sequence opt3 from anti-HIV_cap256-048-052573_VR-Chain
  source 1..432: mol_type = other RNA
caggtgaagctggtcgagagcggcgggggagttgtgcaacccggtagatccctcaggctttcttgcgccgcttcaggcttcagttttagcaactacgcaatggactgggtacggcaggcccctgggaaaggactggaatgggtggcggtcgtgtcctctgatggctcgaataagaactatgctgactcagttaaaggtcgcttcaccatcagccgagataatagtaagaacacagtgtacttgcagatgaactccttacgtgccgaggacactgcagtctattactgtgccaaagatctgggggctaataaggacgatgaatgggcaacggactattacgattggtctattgcctatccagtgcacgacccgagagctgtagttggagtgtttgatatatggggccagggcaccctagtcacagtgagctcc

SEQ ID NO: 25122 - RNA, 432 nt, synthetic construct
  misc_feature 1..432: note = derived and/or modified sequence opt3 from anti-HIV_cap256-048-051477_VR-Chain
  source 1..432: mol_type = other RNA
caggagcaactggtggaaagcggcgggggagtcgttcagcccggtagatccctcaggctttcttgcgccgcttcaggcttcacctttagtaactacgcaatgcactgggtgcggcaggcccctgggaagggactggagtgggtagcggctatgagccatgacggctccgataaatattacgccgactctgtgaagggtcgcttcacaatctcgcgagataattcaaagaacactttgtatatgcagatgaatagcttacgtgcagaagacacggccgtctactattgtgctaaagatcaaggggagagtgaaaaagaggagtgggcatccgactactatgatctgtctattgcctacccaatacaggacccgagagctatggtgggagcctttgatatctggggccagggcaccatggttacagtgagctcc

SEQ ID NO: 25123 - RNA, 432 nt, synthetic construct
  misc_feature 1..432: note = derived and/or modified sequence opt3 from anti-HIV_cap256-048-051299_VR-Chain
  source 1..432: mol_type = other RNA
caggtgcaactggtcgagagcggcgggggagttgtgcagcccggtagatccctcaggctttcttgcgccgcttcaggcttcacctttagtacattcgggatgcactgggtacggcaggcacctggaaagggcctggaatgggtggccttgatcagccatgacggtaacaataaatactatgcggattccttaaaggggcgctttactatttctcgagagaactcgaaaaatacgctgttcctacagatgaactcactccgtgctgaagacaccagcgtctactattgtgccaaggatctgggagacagtgagtgcgaagagtgggcatccgattactatgactttggcaaagattacccatgtcttcacccgagaggcgtggttgggacattcgacttttggggacatggtactatggtgaccgtctctagc

SEQ ID NO: 25124 - RNA, 432 nt, synthetic construct
  misc_feature 1..432: note = derived and/or modified sequence opt3 from anti-HIV_cap256-048-050815_VR-Chain
  source 1..432: mol_type = other RNA
caggtgcaactggtcgagagcggcgggggagttgtgcagcccggtggctccctcagactttcttgcgtagtgtcagggttcacctttagtagctacggaatgcactgggtcaggcaggcccctggcaagggtctggaatgggtgtccttcatccggtttgacgggaactatgagtactatgttgattctgtgaaaggacgcttcacaatttcgcgagacaattcaaagaacactgtctacttgcagatggatagcttacgtgctgaagacacggcagtgtattactgtgccaaagatgtaggcgactataaggatgacgagtgggcgaccgattactacgactttagtatagcttatccagttccggatcccagagccgtggtcggcgcattcgacttttgggggcaaggaacaatggtgactgtgtcctct

SEQ ID NO: 25125 - RNA, 432 nt, synthetic construct
  misc_feature 1..432: note = derived and/or modified sequence opt3 from anti-HIV_cap256-048-049884_VR-Chain
  source 1..432: mol_type = other RNA
caggtgcaactggtcgagagcggcgggggagttgtgcagcccggtagatccctcaggctttcttgcgccgcttcaggcttcagttttaacacctacgcaatgcactgggtacggcaggcccctgggaagggactggaatggatggcgttgatcagctatgacggctccaataaatactatgtggattctgtcaagggtcgcttcacaatttcgcgagacaacagcaaaaatactttatacctgcagatgaactcactacgtgctgaggatacggccgtgtattactgtgcaaaggacctcgggggaaataaagatgacgaatgggccaccgattattacgacctgagtatagcttacccagttcaagatccgagagtggtcgtgggcatctttgacatttggggccaggggacaatggtaactgtttcctct

SEQ ID NO: 25126 - RNA, 432 nt, synthetic construct
  misc_feature 1..432: note = derived and/or modified sequence opt3 from anti-HIV_cap256-048-049170_VR-Chain
  source 1..432: mol_type = other RNA
caggtgcaactggtcgagagcggcgggggagttgtgcagcccggtagatccctcaggctttcttgcgccgcttcaggcttcatctttagtagctacgggatgcactgggtacggcaggcacctggaaagggcctggaatgggtggccgtcatttccggtgacgggaccaaaaaggatttcgcggactctgtgaaaggacgctttacaatatcgaaggataacagcaaaaatatggtttcattgcagatgaacagtttacgagctgaggacgccgcagtgtattactgtgccaaggatctgggcgaatccgacaatgaggaatggccatctgattattacgacttcggccgtgattttactgggcaaaacccgagagctgtcgtgggaacgttcgacctatggggtcagggcaccatggtaacagttagctcc

SEQ ID NO: 25127 - RNA, 435 nt, synthetic construct
  misc_feature 1..435: note = derived and/or modified sequence opt3 from anti-HIV_cap256-048-048531_VR-Chain
  source 1..435: mol_type = other RNA
caggtgcaactggtcgagagcggcgggggagttgtgcagcccggtagatccctcaggctttcttgcgccgcttcaggcttcacctttagtagctacgggctgcactgggtacggcaggcacctggaaagggcttggaatgggtggccttcatctcctatgacggtaacaataaacattacgtcgattctgtgaaggggcgctttacaatttcgcgagacaacagcaaaaatactttatatctgcagatgaactcactacgtgcggaggatacggctgtttactattgtgccaaggacctcggaggcgaaagtgagatagaagagtgggcaaccgattactatgacttctccatcgcctacccagtgaaagagtctagaggcgtcgtggggatttttgatatgtggggacaaggtacaatggtaactgttagctcc

SEQ ID NO: 25128 - RNA, 432 nt, synthetic construct
  misc_feature 1..432: note = derived and/or modified sequence opt3 from anti-HIV_cap256-048-048259_VR-Chain
  source 1..432: mol_type = other RNA
caggtgcaactggtcgagagcggcgggggagttgtgcagcccggtagatccctcaggctttcttgcgccgcttcaggcttcacctttagtacatgtgcaatgcactgggtacggcaggcccctgggaagggactggaatgggtggcggtcatcagctacgacggctccaacaaatattacgtggattctgttaagggtcgcttcactatttcgcgagacaattcaaagaacacgttgtatttacagatgaatagcctgcgtgctgaggataccgccgtgtactattgcgcaaaagaagtcgacataaacaaagaggatgaatgggccagtgactactatgatttttccatcgcttacccagtgcaagacccgagagcagtagttgggggattcgatatttggggccagggcacaatggtgactgtctctagc

SEQ ID NO: 25129 - RNA, 432 nt, synthetic construct
  misc_feature 1..432: note = derived and/or modified sequence opt3 from anti-HIV_cap256-048-047313_VR-Chain
  source 1..432: mol_type = other RNA
caggtgcaactggtcgagagcggcgggggagttgtgcagcccggtagatccctcaggctttcttgcgccgcttcaggcttcacctttagtacattcgggatgcactgggtacggcaggcacctggaaagggcctggaatgggtggccgtcatcagccatgacggtaacaataaatactatgcggattccgtgaaggggcgctttactatttctcgagacaactcgaaaaatacggtttacttgcagatgaactcattacgtgctgaggataccgccgtgtattactgtgcaaaggacctgggagccaataaagatgacgaatgggctacagattattacgacctaagcgtcgcatatccagtgccggatcccagagccgtagttggcgctttcgacgtgtggggccaagggactatggtcaccgtgagttcc

SEQ ID NO: 25130 - RNA, 432 nt, synthetic construct
  misc_feature 1..432: note = derived and/or modified sequence opt3 from anti-HIV_cap256-048-046596_VR-Chain
  source 1..432: mol_type = other RNA
caggtgcaactggtcgagagcggcgggggagttgtgcagcccggtggctccctcagactttcttgcgccgcttcagggttcacctttagtagctacggaatgcactgggtaaggcaggcacctggcaagggtctggaatgggtggccttcatgcggtttgacgggtccaaccgctattacggagattctgtcaaaggccgattcacaatctcgcgtgacaattcaaagaacactttgtatttacagatgaatagcctgagaacggaggatgcggctctatactattgtgccaaagacatgagggaatttgagtgcgaagagtgggcaagtgattactatgacttcggccgggattacccatgtcaagacccgcgcggggtggttggaatttttgatatatggggtcagggcaccatggtgacagtctcctct

SEQ ID NO: 25131 - RNA, 432 nt, synthetic construct
  misc_feature 1..432: note = derived and/or modified sequence opt3 from anti-HIV_cap256-048-044781_VR-Chain
  source 1..432: mol_type = other RNA
caggtgcaactggtcgagagcggcgggggagttgtgcagcccggtagatccctcaggctttcttgcgccgcttcaggcttcacctttacaagttacgcaatccactgggtacggcaggcccctgggaagggactggaatgggtggcggtcattagctatgacggctccaaaaagaactacgctgattctgtgaaaggtcgcttcactatatcgcgagacaattcaaagaacacgttgtatgttcagatgaatagcttacgtgccgaggataccgcagtgtactattgtgccaaagaagtcggggaggacaaggatgacgaatgggctagtgattactatgacctgtccatcgcatacccagtgcatgatccgagagccgtagttggaggctttgacatttggggccaagggacaatggtgactgtctctagc

SEQ ID NO: 25132 - RNA, 432 nt, synthetic construct
  misc_feature 1..432: note = derived and/or modified sequence opt3 from anti-HIV_cap256-048-042599_VR-Chain
  source 1..432: mol_type = other RNA
caggtgcaactggtcgagagcggcgggggagttgtgcagcccggtagatccctcaggctttcttgcgccgcttcaggcttcacctttagtaactacgggatgcactgggtacggcagacacctggaaagggcctggaatgggtggcagtcatcagctatgacggttccaataaattctacgccgattctgtgaaggggcgctttactatttcgcgagacaacagcaaaaatacgttgtatttacagatgtcaagtctgcgtgcggatgacaccgctgtttactattgtgccaaggaggtgggagaagataaagacgatgagtgggcatccgactactatgatctatctatagcctacccagtccatgacccgagagctgtggtaggcggcttcgatatctgggggcaaggaacaatggttactgtgagctcc

SEQ ID NO: 25133 - RNA, 432 nt, synthetic construct
  misc_feature 1..432: note = derived and/or modified sequence opt3 from anti-HIV_cap256-048-041276_VR-Chain
  source 1..432: mol_type = other RNA
caggtgcaactggtcgagagcggcgggggagttgtgcagcccggtagatccctcaggctttcttgcgccgcttcacggttcacctttagtagctacgcaatgcactgggtacgccaggcccctggcaaggggctggaatgggtggcgatcatttcctatgacggatctaacaaatactatgctgattcggtcaagggccgattcacaatatcacgtgacaatagcaaaaacactttgtttttacagatgaatagtctgagagccgaggatacggcactatactattgtgccaaggacctcggtgggtacaaatccgatgaatgggctaccgactattacgatctgtctatcgcatacccaattcaagacccgagggccgtggttggagctttcgatatctggggccagggcacaatggtgactgtcagctcc

SEQ ID NO: 25134 - RNA, 432 nt, synthetic construct
  misc_feature 1..432: note = derived and/or modified sequence opt3 from anti-HIV_cap256-048-040200_VR-Chain
  source 1..432: mol_type = other RNA
caggtgcaactggtcgagagcggcgggggagttgtgcagcccggtagatccctcaggctttcttgcgtagcctcaggcttcacctttagtagcttcgggatgcactgggtgcggcaggctcctggaaagggcctggaatgggtcgcagtgatctcccatgacggtcacaacaaatactatgccgattctttgaaggggcgctttacagtttcgcgagagaatagcaaaaatactttattcctgcagatgaactcactacgtgcggaagacacgagtgtgtactattgtgctaaggatctcggaggcggcgagtgcgaagagtgggcctccgactactatgattttgggagagactacccatgtctgaccccgaggggagtcgtgggtacattcgatatttggggccatgggactaccgtaacagtttctagc

SEQ ID NO: 25135 - RNA, 432 nt, synthetic construct
  misc_feature 1..432: note = derived and/or modified sequence opt3 from anti-HIV_cap256-048-039061_VR-Chain
  source 1..432: mol_type = other RNA
gaggtgcagctgctcggcagcgggggaggtcttgtccaacccggcgggtccctgagattgacctgcgccgtttctggattcacattttcaagtttcgctatgagctgggtgaggcaggcacctggcaagggtttagaatgggtagccctgatctcctacgacgggactgataaatattacgcggactctgtgaagggacggtttacgatttcgcgcgataacagcaaaaataccctatatctccagatgaactcactgcgagtcgaggacacagctatataccactgtgccaaggatcttggcggcactaaaagtgacgaatgggcaaccgattattacgacctgtccatcgcctatccaattcaggatccgggggctgtggttggagtgttcgacatctggggtcaaggcacaatggtcaccgtgtctagc

SEQ ID NO: 25136 - RNA, 432 nt, synthetic construct
  misc_feature 1..432: note = derived and/or modified sequence opt3 from anti-HIV_cap256-048-038515_VR-Chain
  source 1..432: mol_type = other RNA
caggtgcaactggtcgagagcggcgggggagttgtgcagcccggtagatccctcaggctttcttgcgccgcttcaggcttcacctttagtacatacgcaatgcactgggtacggcaggcccctgggaagggactggaatgggtggtcgtgatcagctatgacggctccaacaaatactatgcggattctgttaagggtcgcttcactatttcgcgagacaattcaaagaacacgttgtttttacagatgaatagcctgcgtgctgaggataccgccctatactattgtgcaaaagacgtgggggaatacaaaagtgatgagtgggccacagactattacgatctctccatagcttacccaatccaagacccgagagcaatggtcggagccttcgatatttggggccagggcactatggtgaccgtatctagc

SEQ ID NO: 25137 - RNA, 432 nt, synthetic construct
  misc_feature 1..432: note = derived and/or modified sequence opt3 from anti-HIV_cap256-048-038255_VR-Chain
  source 1..432: mol_type = other RNA
caggtgcaactggtcgagagcggcgggggagttgtgcagcccggtagatccctcaggctttcttgcgccgcttcaggcttcaccctgagtagctacgcaatgcactgggtacggcaggcccctgggaagggattggaatgggtggcggtcatctcctatgacggctctaacaaatactatgctgattcggtgaagggtcgctttacaatttcacgagacaatagcaaaaacgccttatacctgcagatgaatagtctacgtgcagaggatactgccctctattactgtgctaaggacctgagagaatatgagtgcgaagagtgggcatccgattactacgacttcgggagggattatccatgtcaagacccgcggggagttgtgggcacgtttgatatatggggccaggggaccatggtcacagtgtctagc

SEQ ID NO: 25138 - RNA, 432 nt, synthetic construct
  misc_feature 1..432: note = derived and/or modified sequence opt3 from anti-HIV_cap256-048-038177_VR-Chain
  source 1..432: mol_type = other RNA
caggtgcaactggtcgagagcggcgggggagttgtgcagcccggtagatccctcaggctttcttgcgccgcttcaggcttcacctttaatacatacgggatccactgggtacggcaggcacctggaaagggcctggaatgggtggccttgattagttatgacggtactgataaatactatgcggacagcgtcaaggggcgcttcacgatatcccgagataattctaaaaacaccttatacctgcagatgaactcgctacgtgtggaggacacagctatctatcattgtgccaaggatctcggaggcactaaatcagacgaatgggcaaccgattactatgacctgagcattgcctacccaatccaagatccgggcgctgttgtgggggtctttgacatttggggacagggtacaatggtgaccgtaagttcc

SEQ ID NO: 25139 - RNA, 432 nt, synthetic construct
  misc_feature 1..432: note = derived and/or modified sequence opt3 from anti-HIV_cap256-048-035513_VR-Chain
  source 1..432: mol_type = other RNA
caggtgcaactggtcgagagcggcgggggagttgtgcagcccggtagatccctcaggctttcttgcgccgcttcaggcttcacctttagtagctacgggatggcatgggtacggcaggcccctggaaagggcctggaatgggtgacagtcatctccttcgcgggtgtgaaaaagtattacgctgactctgttaaagggcgctttactatttcgcgagataactcaaagggaacgttgtatttacagatggacggcctgcgtccagaggataccgccctatactattgtgcaaaagacctcggcgaaagagagtgcgaagagtgggccagcgattactatgacttcgggagggattttccgtgtcaagacccccggggagtggtcggtacattcgatatatggggccaggggactatggtgaccgtaagttcc

SEQ ID NO: 25140 - RNA, 432 nt, synthetic construct
  misc_feature 1..432: note = derived and/or modified sequence opt3 from anti-HIV_cap256-048-034112_VR-Chain
  source 1..432: mol_type = other RNA
cagatgcaactggtggagagcggcgggggagtcgttcagcccggtagatccctcaggctttcttgcgccgcttcaggcttcacctttaacagttacgcaatgcactgggtgcggcaggcccctgggaagggactggaatgggtagcggtgatcagctatgacggctccaataaatactatgctgattctgtcaagggtcgcttcacaatttcgcgagacaacagcaaaaatactgtgtacttgcagatgaactcattacgtggggttgatacggccgtgtattactgtgcaaaggacctgggaggcggcgaggtcgaagagtgggccaccgattattacgactggagtatagcttacccagtggaacatccgagagcagtagttggggtgtttgatatctggggacaaggtacaaaagtcactgtgtcctct

SEQ ID NO: 25141 - RNA, 432 nt, synthetic construct
  misc_feature 1..432: note = derived and/or modified sequence opt3 from anti-HIV_cap256-048-033983_VR-Chain
  source 1..432: mol_type = other RNA
caggtgcaactggtcgagagcggcgggggagttgtgcagcccggtgaatccctcagactttcttgcgccgcttcaggcttcaccctgagtagccacgggatccattgggtaaggcaggcacctggaaagggcttggagtgggtggcctttatttcctctgacggttcgaacaaaaattacggggattcagtcaagggacggttcacaataagccgcgacaacagtaaaaatactttatttctgcagatgaactccctacgagcggaagatacggctctctattactgtgccaaggacgtgggcgagtataaatctgatgaatgggcaaccgactactatgatctgagcatcgcctacccaattcaagacccgcgtgctatggttggcgcattcgatatctgggggcagggaacaatggtgactgtctcctca

SEQ ID NO: 25142 - RNA, 432 nt, synthetic construct
  misc_feature 1..432: note = derived and/or modified sequence opt3 from anti-HIV_cap256-048-032688_VR-Chain
  source 1..432: mol_type = other RNA
caggtgcaactggtcgagagcggcgggggagttgtgcagcccggtagatccctcaggctttcttgcgccgcttcaggcttcatctttaacagttacgggatgcactgggtacggcaggcacctggaaagggcctggaatgggtggccgtcgtgcatggtgacgggggaaataaatattacgcggatagcgttaagggccgcttcaccatttcccgagacaactctaaaaatacattgtatttagagatgaactcgctgcgtgctgaagatactgccgagtactattgtgcaaaggacctaggcgaatcagataaagaggagtggccaagcgactactatgattttgggagagacttcacgggacaggtgccgagggccgtcgtgggtgcttttgatatatggggccaagggaccatggtaacagttagttcc

SEQ ID NO: 25143 - RNA, 432 nt, synthetic construct
  misc_feature 1..432: note = derived and/or modified sequence opt3 from anti-HIV_cap256-048-031092_VR-Chain
  source 1..432: mol_type = other RNA
caggtgcaactggtcgagagcggcgggggagttgtgcagcccggtagatccctcaggctttcttgcgccgcttcaggcttcagtttttacaacttcgcaatggactgggtacggcaggcccctgggaagggactggaatgggtggcggtcatcagctccgatggcggtaataaaaactatgtggactctgttaaggggcgctttaccatttcgcgagataattcaaagaacacattgtacttacagatgaatagcctgcgtgctgaggacactgccgtgtattactgtgcaaaagatctaggaggcacgaaagacgatgaatgggccaccgactattacgatataagtatcgcttatccagtccaagacccgagagcagtggccggcgctttcgatatttgggggcagggaacaatggtaactgtttcctct

SEQ ID NO: 25144 - RNA, 435 nt, synthetic construct
  misc_feature 1..435: note = derived and/or modified sequence opt3 from anti-HIV_cap256-048-030464_VR-Chain
  source 1..435: mol_type = other RNA
caggtgcaactggtcgagagcggcgggggactcgttaagcccggtggctcccttagactgtcttgcgaagcctcagggttcagttttaccaactactatatgagctggatcaggcaggctcctggaaaaggcttggagtgggtggcagtaatttccttcaatggtcggaacaagtactatgccgactttgtgaaagggcgcttcacaatatctcgagataattcgaagaacactttatcactgcagatgaatagcctacgtgtcgaagacacggcggtgtactattgtgctaaagaggttggagaaaacaaggatgacgagtgggccgcaccagattactatgactttagtatcgcctacccggtgcaggatcccagagctgtcgtgggcggcttcgacatttgggggcaaggaaccatggtaacagtttcctct

SEQ ID NO: 25145 - RNA, 432 nt, synthetic construct
  misc_feature 1..432: note = derived and/or modified sequence opt3 from anti-HIV_cap256-048-030289_VR-Chain
  source 1..432: mol_type = other RNA
caggtgcaactggtcgagagcggcgggggagttgtgcagcccggtggctccctcagactttcttgcgccgcttcagggttcacctttagtagctacggaatgcactgggtaaggcaggcacctggcaagggtctggaatgggtggccttcatccggtatgacgggtccaacaaatactatgcggattctgtcaagggacgctttacaatttcgcgagacaattcaaagaacactgtgtacttgcagatgaatagcttacgtgttgaggatacggctgtgtattactgtgccaaagacctgggcgcaaacaaagatgacgaatgggccaccgattattacgacctaagtgtcgcttacccagtgccggatcccagagcagtagttggcgccttcgacgtgtgggggcaaggaacaatggtcactgtgtcctct

SEQ ID NO: 25146 - RNA, 432 nt, synthetic construct
  misc_feature 1..432: note = derived and/or modified sequence opt3 from anti-HIV_cap256-048-030261_VR-Chain
  source 1..432: mol_type = other RNA
caggtgcaactggtcgagagcggcgggggagttgtgcagcccggtggctccctcagactttcttgcgccgcttcagggttcacctttagtacattcggaatgcactgggtaaggcaggcacctggcaagggtctggaatgggtggccgtcatcagccatgacgggtccaacaaatactatgcggattctttgaagggacggtttactatttcgcgcgagaatagcaaaaatacgttatacctgcagatgaactcactacgactcgaagacaccgctgtgtatcactgtgccaaggatctgggcggcagtaaatccgacgagtgggcaacagattactatgacctttctgttgcctacccagtgcaagatccgcgtgctgtcgtgggggtattcgacatatggggacagggtactatggttaccgtgagctcc

SEQ ID NO: 25147 - RNA, 432 nt, synthetic construct
  misc_feature 1..432: note = derived and/or modified sequence opt3 from anti-HIV_cap256-048-029362_VR-Chain
  source 1..432: mol_type = other RNA
caggtgcaactggtcgagagcggcgggggagttgtgcagcccggtagatccctcaggctttcttgcgccgcttcacagttcacctttagtagctacggcatgcactgggtacggcaggcacctgggaagggactggaatgggtggccggcatctccttcgcgggtacaaacaaatattacgctgactctgtcaaggggcgctttactatttcgcgagataattcaaagaacacgttgtatttacaaatgaatagcctgcgtaccgaggacgccgcactatactattgtgccaaagatatgagagagttcgaatgcgaagagtgggctagtgactactatgattttggaagggactacccatgtcaggatccgcggggcgtggttggcatattcgacatctgggggcagggaacaatggtgactgtctcctct

SEQ ID NO: 25148 - RNA, 432 nt, synthetic construct
  misc_feature 1..432: note = derived and/or modified sequence opt3 from anti-HIV_cap256-048-027638_VR-Chain
  source 1..432: mol_type = other RNA
caggtgcaactggtcgagagcggcgggggagttgtgcagcccggtagatccctcaggctttcttgcgtagcctcaggcttcatctttagtagctacgggattcactgggtgcggcaggctcctggaaagggcctggaatgggtcgcagtgatatccggtgacgggaccaacaaatattgtgccgattctgttaagggacgcttcacaatctcgcgagacaattcaaagaacactgtgtttttgcagatgaatagcttacgtgcggaggatacggctgtcttctactgcgccaaagacctgggcgaaagtgataaagaggaatggccatccgactattacgattttggcagagacttcaccgggcaagtgccgagggcagtagttggagcctttgatatttggggtcagggcacaatggtgactgtctctagc

SEQ ID NO: 25149 - RNA, 432 nt, synthetic construct
  misc_feature 1..432: note = derived and/or modified sequence opt3 from anti-HIV_cap256-048-027613_VR-Chain
  source 1..432: mol_type = other RNA
gtgcagcaactggtcgagagcggcggggacgttgtgcagcccggaacctccctcagactttcttgcgaagcctcaggtctgatcttgagtggctacgggttacactgggtaaggcaggctcctggaaagggcatggagtgggtggcagtcattagctatgatggttccaacaaatactatgccgactctgtgaaggggcggttcacaatatcgcgcgataattcaaagaacactgtttacctgcagatgaatagcctacgaggagtggacacggcggtctattactgtgctaaagatctcggcggcggggaagtggaggaatgggccaccgactattacgattggagtacagcatacccagtagagcatccgcgtgccgttgtgggagtctttgacatctggggtcaaggcactaaagtgaccgtgtcctct

SEQ ID NO: 25150 - RNA, 432 nt, synthetic construct
  misc_feature 1..432: note = derived and/or modified sequence opt3 from anti-HIV_cap256-048-026627_VR-Chain
  source 1..432: mol_type = other RNA
caggtgcaactgctcggcagcgggggaggttccgtccagcccggcgggtctcttagactgacctgcgccgtttcaggattcacatttagtagcttcgctatgtcctgggtgaggcaggcacctggcaagggtttggagtgggtagcctttatctcttcggacgggactaacaaaaattacggagattcagtgaagggccggttcacgattagccgcgacaacagtaaaaataccttatttctgcagatgaactccctacgagcggaagatacagctctctattactgtgccaaggacctgggcgggtataaatctgatgagtgggcaactgactactatgatcttagcatagcctacccaatccaagacccgcgtgctgtcgtgggagcattcgatatttggggtcagggcaccatggttacagtgtcctca

SEQ ID NO: 25151 - RNA, 432 nt, synthetic construct
  misc_feature 1..432: note = derived and/or modified sequence opt3 from anti-HIV_cap256-048-026239_VR-Chain
  source 1..432: mol_type = other RNA
cagatgcaactggtggagagcggcgggggagtcgttcagcccggtagatccctcaggctttcttgcgccgcttcaggcttcacctttaacagttacgcaatgcactgggtgcggcaggcccctgggaagggactggaatgggtagcggtgatcagctatgacggctccaataaatactatgctgattctgtcaagggtcgcttcacaatttcgcgagacaacagcaaaaatactttgtacttacagatgaactcactgcgtacggaggatgccgcactatattactgtgccaaggacatgagagaatttgagtgcgaagagtgggctagtgattattacgacttcgggagggattacccatgtcaagacccgcggggagtggttggcatatttgatatctggggccaggggaccatggtgacagtctcctct

SEQ ID NO: 25152 - RNA, 432 nt, synthetic construct
  misc_feature 1..432: note = derived and/or modified sequence opt3 from anti-HIV_cap256-048-025518_VR-Chain
  source 1..432: mol_type = other RNA
caggtgcaactggtcgagagcggcgggggagttgtgcagcccggtagatccctcaggctttcttgcgccgtatcaggcttcacctttagtcagcacgctatgcattgggtgcggcaggcacctgggaagggactggaatgggtcacattgatcagcaacgacggcactgagaaattctacgccgattccgtgaagggtcgctttacgatttctcgagacaattcgaaaaacaccttatatctgcaaatgaactcactaagcgttgaagatacagcggtgtactattgtgctaaggacctcgggaaaaataaggatgacgagtgggccactgattactatgacataagtatcgcatacccagtcccggatccccgtgccgtggtaggagttttcgacatttggggccagggcaccgtggtcacagtgtcctct

SEQ ID NO: 25153 - RNA, 432 nt, synthetic construct
  misc_feature 1..432: note = derived and/or modified sequence opt3 from anti-HIV_cap256-048-024854_VR-Chain
  source 1..432: mol_type = other RNA
caggtgcaactggtcgagagcggcgggggagttgtgcagcccggtagatccctcaccctttcttgcgccgcttcaggcttcacatttaataattacgacatgcactgggtaaggcaggcacctgggaagggactggaatgggtggccttcactcggtatgatggcagtaaccagtactatgcggacagcgtcacgggtcgctttaccatctcccgagataattctaaaaacacagtgtacttgcaaatgaactcgttacgtggggttgacactgctgtgtattactgtgccaaggatctgggaggcggcgaggtcgaagagtgggcaaccgactattacgattggtcaattgcctacccagtggaacatccgagagctgtagttggggtgttcgacatatggggacagggtacaaaagtcaccgtgagcagt

SEQ ID NO: 25154 - RNA, 432 nt, synthetic construct
  misc_feature 1..432: note = derived and/or modified sequence opt3 from anti-HIV_cap256-048-024537_VR-Chain
  source 1..432: mol_type = other RNA
caggtgcaactggtcgagagcggcggggccgttgtgcagcccggaagatccctcaggctttcttgcgtagcttcaggtttcacctttagtagctacgcaatgcactgggtgcggcaggcccctggcaaggggctggactgggtcgcgttgatctcctatgatggatctaacaaatacttcgctgactcggtgaagggccgctttgccatttcacgagataatagcaaaaacacattatatctgcagatgaatagtctacgtccagaagacactgcagtttactattgtgccaaggatctcggtgggggagagtgcgaaacgtgggcttccgactactatgatttcggcaaagactacccgtgtctggatcccagagacgtggtcggcacctttgatatatgggtgcaagggacacttgtaactgtttctagc

SEQ ID NO: 25155 - RNA, 432 nt, synthetic construct
  misc_feature 1..432: note = derived and/or modified sequence opt3 from anti-HIV_cap256-048-021781_VR-Chain
  source 1..432: mol_type = other RNA
caggtgcacctggtcgagagcggcgggggactcgttaagcccggtggctcccttagactgtcttgcgaagcctcagggttcagttttagcaactacgctatggactgggtgaggcaagcacctggaaaaggcttggagtgggtagccttcgtgtcctctgatggttcgaataagaactatgcggactcagtcaaagggcggtttaccatcagccgcgataatagtaagaacacagtgtacttacagatgaactccctgcgagttgaagacactgctgtgtattactgtgccaaagatctaggagcaaataaggacgatgagtgggccacggactattacgatctctctgtcgcttatccagtgccggacccccgtgcagtagttggcgccttcgatgtgtggggccaggggaccatggtcacagtgagctcc

SEQ ID NO: 25156 - RNA, 432 nt, synthetic construct
  misc_feature 1..432: note = derived and/or modified sequence opt3 from anti-HIV_cap256-048-021758_VR-Chain
  source 1..432: mol_type = other RNA
caggtgcaactggtcgagagcggcgggggagttgtgcagcccggtagatccctcaggctttcttgcgccgcttcaggcttcacctttagtcggtacgggatgcactgggtacgccaggcacctggaaagggcctggaatgggtggccgtcatcagctatgacggttccaaagagtactatgcggattctgtgaaggggcgattcacaatttcgcgtgacaactcaaaagatactttgtacttacagatgagcagtctgagagttgaagacacggctgtgtattactgtgccaaggatgtcggagcaaataaagacgatgagtgggccaccgactattacgatctatccatagcttacccagtgccggaccccagggcagtagttggcgcctttgatatctggggccaagggacaatggtgactgtctctagc

SEQ ID NO: 25157 - RNA, 432 nt, synthetic construct
  misc_feature 1..432: note = derived and/or modified sequence opt3 from anti-HIV_cap256-048-020988_VR-Chain
  source 1..432: mol_type = other RNA
caggtgcaactggtcgaaagcggcgggggagttgtgcagcccggtagatccctcaggctttcttgcgaagcctcagctttcacctttagtagctacggcatgcactgggtacggcaggcacctgggaagggactggagtgggtgacattcatctcctattctggcaacaataaatactatgccgactcggtcaagggtcgctttactgtgtcacgagataacagcaaaaatacgttgtacttacagatgaacagtctgacctccgaagacacagcggtttattactgtgctaaggatctagggggatctaaaactgacgagtggggcaccgattattacgagttctggaatgcctacccagtgcaagacccgcgtgtcgtggtaggcgcatttgatatttgggggcatggaacaatggttaccgtgagctcc

SEQ ID NO: 25158 - RNA, 435 nt, synthetic construct
  misc_feature 1..435: note = derived and/or modified sequence opt3 from anti-HIV_cap256-048-020663_VR-Chain
  source 1..435: mol_type = other RNA
caggtgcaactggtcgagagcggcgggggagttgtgcagcccggtatgtccctcagactttcttgcgccgcttcaggcttcacctttagtaatttcgggatgcactgggtaaggcaggcacctggaaagggcctggaatgggtggccgtcatcagccatgacggtaataacaaatactatccagattccgtgcaggggcggtttacaatttctcgcgaaaattcgaagaacactttgtacttacaaatgaactcactgaaaccggaggacacggcggtttatttctgtgctaaggatctaggaggcgagagcgaagtggaggagtgggccagtgactactatgattttggccgagacatacccgggcctgatccacgtggagtcgtgggtaccctcgacatctggggccacgggacaatggtaactgtttcctct

SEQ ID NO: 25159 - RNA, 432 nt, synthetic construct
  misc_feature 1..432: note = derived and/or modified sequence opt3 from anti-HIV_cap256-048-020590_VR-Chain
  source 1..432: mol_type = other RNA
caggtgcaactggtcgagagcggcgggggagttgtgcagcccggtggcgtacctagactcgcctgcgctgcatccgggttcaccttttcttcatacgccatgcactgggtgaggcaggcgccaggaaagggccttgaatgggtcacagtgatcagttatgacggtagcaataaatactatgctgattccgttaaggggcggttcactatttctcgcgacaattcgaaaaacacgctgtacttgcagatgaactcattacgagccgaggataccgcagtgtattactgtgccaaggacctgggaggcacaaaagatgacgaatgggctactgattattacgacataagcatcgcatacccggtccaagatccccgtgccgtggctggcgcctttgacatttgggggcagggaaccatggtaacagttagttcc

SEQ ID NO: 25160 - RNA, 432 nt, synthetic construct
  misc_feature 1..432: note = derived and/or modified sequence opt3 from anti-HIV_cap256-048-019765_VR-Chain
  source 1..432: mol_type = other RNA
caggtgcaactggtcgagagcggcgggggagttgtgcagcccggtagatccctcaggctttcttgcgccgcttcaggcttcatctttaccaactacgcaatggactgggtacggcaggcccctgggaagggactggaatgggtggcggtcattagtagcgatggctccaataaaaactatgctgactctgtgaagggtcgcttcacaatatcgcgagataatagcaaaaacactgtttcattgcagatgaatagtttacgtgccgaggacacggcagtgtactattgtgccaaggatctgggggactccaaaaaggatgaatgggctaccgactactatgatctatctatcgcatacccagtcccggaccccagagccgtggtaggagcttttgatatttggggccaaggcacaatggttactgtgagctcc

SEQ ID NO: 25161 - RNA, 432 nt, synthetic construct
  misc_feature 1..432: note = derived and/or modified sequence opt3 from anti-HIV_cap256-048-019254_VR-Chain
  source 1..432: mol_type = other RNA
caggtgcaactggtcgagagcggcgggggagttgtgcagcccggtagatccctcaggctttcttgcgccgcttcaggcttcaccagtagcacatacgcaatgcactgggtacggcaggcccctgggaagggactggaatgggtggcgttgatctcctatgacggcactgataaatactatgctgactctgtcaagggtcgctttacgatttcgcgagataacagcaaaaataccttatacctgcagatgaactcactacgtgtggaggacacagccgtttatcattgtgcaaaggatctcgggggaaataaaccagacgaatgggccactgattactatgacctgagtatagcttacccggtgcaagatcccagagcagtcgtgggcgtattcgacatctggggccaggggaccattatcacagtttcctct

SEQ ID NO: 25162 - RNA, 432 nt, synthetic construct
  misc_feature 1..432: note = derived and/or modified sequence opt3 from anti-HIV_cap256-048-018073_VR-Chain
  source 1..432: mol_type = other RNA
caggtgcaactggtcgagagcggcgggggagttgtgcagcccggtagatccctcaggctttcttgcgccgcttcaggcttcagtctgagctcctacgcaatggactgggtacggcaggcccctgggaagggattggaatgggtggcggtcatctcttcggatggcaccaacaaatattacgctgactcagtgaagggtcgctttacaattactcgagataatagcaaaaacacgttatatctgcagatgaatagtctacgtgttgaggacaccgccctctactattgtgcaaaggatatgggggaatccgagaaagaagagtgggcctctgactactatgatttcggaagagacataccaggccaagatccgaggggcgaggtggggagctttgacatctggggacagggtacaatggtcactgtgtcctca

SEQ ID NO: 25163 - RNA, 432 nt, synthetic construct
  misc_feature 1..432: note = derived and/or modified sequence opt3 from anti-HIV_cap256-048-016775_VR-Chain
  source 1..432: mol_type = other RNA
gaggtgcagctggtcgagttcggcgggggactcgttcaacccggtagaagccttaggctgtcctgcgccgcttctgcatttaccttctcacactacggcatccattgggtgcggcaggcccctgggaagggattggaatgggtagcggtgattagtcacgacggcagcacaaaagattatgctgactccgtcaagggtcgctttactatatctcgagataactcgaaaaatacgatgtacttacagatgaactcactgcgtgccgaagacaccgcagtgtattactgtgccagagatctaggggagagcgaaacagaggagtgggctactgactattacgatttcagtatcgcatatccagttcagaatccgaggggagtgattggcgtcctcgacatctggggcctggggaccatggtgacagtatcctct

SEQ ID NO: 25164 - RNA, 432 nt, synthetic construct
  misc_feature 1..432: note = derived and/or modified sequence opt3 from anti-HIV_cap256-048-016069_VR-Chain
  source 1..432: mol_type = other RNA
caggtgcaactggtcgagagcggcgggggagttgtgcagcccggtagatccctcaggctttcttgcgccgcttcaggcttcacctttagtaagtacgcaatgcactgggtacggcaggcccctgggaaaggactggaatgggtggcgttcgtcgcttttgacgagagcgccaagttctatgcagattccgtgaaaggccgctttacaatctctcgagacaactcgaagaatactttgtcattacagatgaacagcctgcgtgccgaagatacggctgtttactattgtgcaaaagaggtgggtgaaaataaggacgatgagtgggccagtgactactatgatctatccattgcttacccagtccatgacccgagagccgtggtagggggattcgatgtttggggccaaggcaccatggtgacagtctctagc

SEQ ID NO: 25165 - RNA, 432 nt, synthetic construct
  misc_feature 1..432: note = derived and/or modified sequence opt3 from anti-HIV_cap256-048-015867_VR-Chain
  source 1..432: mol_type = other RNA
caggtgcaactggtcgagagcggcgggggagttgtgcagcccggtagatccctcaggctttcttgctcagccagtggcttcagctttaccaactacgctatggactgggtacggcaggcacctgggaagggactggaatgggtggccgtcatctcctctgatggctcgaataaaaactatgcggactcagtgaagggtcgcttcacaattagccgagataatagtaaaaacactttgtttttacagatgaactccctgcgtccagaggacacggctgtttacttctgtgccaaggatctaggggcaaataaagacgatgaatgggccaccgactattacgatctctctatagcttatccggtgcacgaccccagagcagtcgtgggaatctttgatctgtggggccaaggcacaatggtaactgttagctcc

SEQ ID NO: 25166 - RNA, 432 nt, synthetic construct
  misc_feature 1..432: note = derived and/or modified sequence opt3 from anti-HIV_cap256-048-015673_VR-Chain
  source 1..432: mol_type = other RNA
caggtgcacctggtcgagagcggcgggggagttgtgcaacccggtagatccctcaggctttcttgcgccgcttcaggcttcacctttagtaacttcgcaatggggtgggtacggcaggcccctggaaagggcctggaatgggtggcgtttatcagctccgacggtacaaataaaaactacggggattctgtcaagggacgcttcactatttcgcgagacaattcaaagaacacgttgtttttacagatgaatagcctgcgtgctgaggataccgccctatattactgtgcaaaagacctcggcggctataaaagtgatgaatgggccacagactactatgatctgtccatagcttacccaatccaggacccgagagcagtggttggggccttcgatatttggggacaaggtactatggtgaccgtctctagc

SEQ ID NO: 25167 - RNA, 432 nt, synthetic construct
  misc_feature 1..432: note = derived and/or modified sequence opt3 from anti-HIV_cap256-048-015156_VR-Chain
  source 1..432: mol_type = other RNA
caggtgcaactggtcgagagcggcgggggagttgtgcagcccggtagatccctcaggctttcttgcgccgcttcaggcttcacctttagtgtatacgcactgcactgggtgcggcagacacctgggaagggattggaatgggtcgccttaatcagctatgacggcactaacaaatactatgtggattccgttaagggtcgcttcacgatttctcgagacaattcgaaaaacaccctgtacctacagatgaactcactcacagcggaggatactgctgtgtattactgtgccaaggaccttgggggaagcaaaaatgatgaatgggcaaccgactattacgatctgagtatagcctacccaatccaagacccgcgtgctgtcgcaggcatttttgatgtgtggggcagagggacaatggtaaccgtttcctct

SEQ ID NO: 25168 - RNA, 432 nt, synthetic construct
  misc_feature 1..432: note = derived and/or modified sequence opt3 from anti-HIV_cap256-048-014521_VR-Chain
  source 1..432: mol_type = other RNA
gaggtgcagctggtcgaaagcggcgggggactcgttcaacccggtagatcccttaggctgtcttgcgccgcttcaggcttcatctttagtagctacgggattcactgggtgcggcagggacctggcaagggtttggagtgggtagcattaatatccggggacggaaacaataaatattacgccgattctgtgcagggccgcttctcgatctcacgagacaacagcaagaataccctgtatctacagatgaacagtctccgtgcggaagatacagctgtctactattgtgccaaagacctgggcgagtccgataaggaagagtggccatctgactactatgattttgggagagacttcactggacaagatccgagggcagtggttggtgtgtttgacatttggggccaggggacgaccgtcatcgtgagctcc

SEQ ID NO: 25169 - RNA, 432 nt, synthetic construct
  misc_feature 1..432: note = derived and/or modified sequence opt3 from anti-HIV_cap256-048-014475_VR-Chain
  source 1..432: mol_type = other RNA
caggtgcaactggtcgagagcggcgggggagttgtgcagcccggtagatccctcaggctttcttgcgccgcttcaggcttcacctttaatacattcgggatgcactgggtacggcaggcacctggaaagggcctggaatgggtggccgtcatcagtcatgacggtaataacaaatactatgcggatagcttgaaggggcgctttactatttcccgagaaaattctaaaaacacgttattcctgcagatgaactcgctacgtgctgaggacacctcagtgtactattgtgccaaggatctcggacacggcgagtgcgaagagtgggcaagcgactactatgattttggcaaagactacccatgtctgacaccgagaggggttgccggaactttcgatatatggggtcatggcaccacagtgaccgtcagttcc

SEQ ID NO: 25170 - RNA, 432 nt, synthetic construct
  misc_feature 1..432: note = derived and/or modified sequence opt3 from anti-HIV_cap256-048-013798_VR-Chain
  source 1..432: mol_type = other RNA
caggtgcaactggtcgagagcggcgggggagttgtgcagcccggtagatccctcaggctttcttgcgccgcttcaggcttcacctttaacaattacgggacacactgggtacggcaggcacctggaaagggcctggaatgggtggccgtcatcagtgacagcggttccaacaaatattacgcggattctgtgaaggggcgcttcactatttcgcgagacaattcaaagaacacgttgtatttacagatgaatagcctgcgtgctgaggataccgccgtttacttttgtgcaaaagacctaggaggcagagaaacagaggaatgggccagtgattattacgacttcggcagggattttccagggcaagaccagcgggctgtggcaggagtcttcgatatgtggggtcagggcactatggtgaccgtatcctct

SEQ ID NO: 25171 - RNA, 432 nt, synthetic construct
  misc_feature 1..432: note = derived and/or modified sequence opt3 from anti-HIV_cap256-048-013271_VR-Chain
  source 1..432: mol_type = other RNA
gaggtgcagctggtcgaaagcggcgggggagttgtgagacccggtggctccctcaggctttcttgcgccgcttcagggttcatctttagtagctacggcattcactgggtacggcaagcacctggaaagggtctggagtgggtggccgtcatatccggggacggaaccaacaaatattgtgcggattctgtgaagggccgcttcacaatctcgcgagacaatagcaaaaacactttgtacttacagattaattcactgcgtgttgaagatacggctgtgtattactgcgccaaggacctaggcaaaaacaaggatgacgagtgggcaaccgattattacgacctcagtatcgcctatccagtcccggatcccagagctgtggtaggggtttttgacatttggggacagggtacagtggtcactgtgtcctct

SEQ ID NO: 25172 - RNA, 432 nt, synthetic construct
  misc_feature 1..432: note = derived and/or modified sequence opt3 from anti-HIV_cap256-048-013180_VR-Chain
  source 1..432: mol_type = other RNA
caggtgcaactggtcgagagcggcgggggagttgtgcagcccggtagatccctcaggctttcttgcgccgcttcaggcttcacctttagtaagaacgggatgcactgggtacggcaggcacctggaaaaggcctggaatgggtggccttcgtcgcgtttgacggtagcgataagtactatgctgactccgtgaaagggcgcttcgttatctctcgagataattcgaagaacacattgtcattacagatgaatagcctgcgtgccgaggacactgcagtgtactattgtgccaaagaagtcggagaggataaggacgatgaatgggctagtgactactatgatctatccattgcatacccagtgcatgacccgagagccgtagttggcggctttgatatatgggggcaaggaacgatggtgaccgtctctagc

SEQ ID NO: 25173 - RNA, 432 nt, synthetic construct
  misc_feature 1..432: note = derived and/or modified sequence opt3 from anti-HIV_cap256-048-012148_VR-Chain
  source 1..432: mol_type = other RNA
caggtgcaactggtcgagagcggcgggggagttgtgcagcccggtagatccctcaggctttcttgcgccgcttcaggcttcacctttacacactacgcaatggactgggtacggcaggcccctgggaagggactggaatgggtggcggtcatcagtagcgatggctcctctaaaaactatgctgactcggtgcgcggtcgattcactatttcacgtgataatagcaagaacacgttgagtttactgatgaatgggctaagaccagaggacaccgccgtttactattgtgcaaaagatgtgggagacgtcaagaacgatgaatgggccacagactactatgatctctccatagcttacccggtgcaggaccccagggcagtagttggcgcctttgatttctggggccaagggactatggtgaccgtctctgct

SEQ ID NO: 25174 - RNA, 432 nt, synthetic construct
  misc_feature 1..432: note = derived and/or modified sequence opt3 from anti-HIV_cap256-048-011870_VR-Chain
  source 1..432: mol_type = other RNA
caggtgcaactggtcgagagcggcgggggagttgtgcagcccggtagatccctcaggctttcttgcgccgtatcaggcttcacctttagtttctacgggatgcactgggtgcggcaggctcctggaaagggcctggaatgggtcgcagtgatcagctatgacggtaacaataaatactatgttgattccgtgaaggggcgctttattatatctcgagacaactcgaaaaatacattgtacttacagatgaactcactgcgtgtcgaggatactgccgtgtattactgtgcgagagacctaggagaaagggagaatgaagagtgggctacggattattacgacttcagcatcgcctacccaattgagggcccgcggggcgtagttggggtgtttgatatctggggacgcggtaccatggtcacagtgagttcc

SEQ ID NO: 25175 - RNA, 432 nt, synthetic construct
  misc_feature 1..432: note = derived and/or modified sequence opt3 from anti-HIV_cap256-048-011530_VR-Chain
  source 1..432: mol_type = other RNA
caggtgcacctggtcgagagcggcgggggagttgtgcaacccggtagatccctcaggctttcttgcgccgcttcaggcttcagttttcggaactacgcaatggactgggtacgccaggcccctgggaagggactggaatgggtggcggtcatcagctccgatggctctgacaaacattatgctgattcggtgcgaggtcgtttcaccatttcaagagacaatagcaagaacacattgtacttacagatgaatagtctgagggttgaggatactgccgtgtattactgtgcaaaagacctaggggccaacaagaatgatgaatgggctacggactattacgatttttccatagcatatccagtcccggacccccgggccgtggtaggagctttcgatatctggggccagggcaccatggttacagtgtctagc

SEQ ID NO: 25176 - RNA, 432 nt, synthetic construct
  misc_feature 1..432: note = derived and/or modified sequence opt3 from anti-HIV_cap256-048-010968_VR-Chain
  source 1..432: mol_type = other RNA
caggtgcaactggtcgagagcggcgggggagttgtgcagcccggtagatccctcaggctttcttgcgccgcttcaggcttcatctttagtagctacgggatgcactgggtacggcaggcacctggaaagggcctggaatgggtggccttgatttccggtgacgggtctaacaaatattacgcggattcggtcaagggacgcttcaccatatcacgagacaatagcaaaaacacattatatctgcagatgaatagtctacgtgctgaggattccgccctctacttttgtgcaaaggacctgggcgaatctgataaagaggaatggccaagcgactattacgatttcggcagagactttactgggcaagtgccgagggccgttgtgggaatcttcgatatgtggggtcagggcacgatggtcaccgtgtcctca

SEQ ID NO: 25177 - RNA, 426 nt, synthetic construct
  misc_feature 1..426: note = derived and/or modified sequence opt3 from anti-HIV_cap256-048-010224_VR-Chain
  source 1..426: mol_type = other RNA
gaggtgcacctggtcgaaagcggcggggacctcgttcagcccggaggttcccttagactgtcttgcgtggtatcagagttcacctttagtagctacggcatgcattgggtgaggcaagcccctgggaagggattggaatgggtcgctttcatccggtatgatggctccaacaaatactatgcagactctgtgaagggtcgctttacaatttcgcgagataattcaaaagtttacttagagatgaacagcctgcgtgccgaagacactgcggtgtattactgtgctaaggaggtcggggagaataaagatgacgaatgggccagtgattattacgacctatccatagcatacccaatccacgatccgagagccgtggtaggaggcttcgacatttggggccaggggacgatggttaccgtgtctagc

SEQ ID NO: 25178 - RNA, 432 nt, synthetic construct
  misc_feature 1..432: note = derived and/or modified sequence opt3 from anti-HIV_cap256-048-009749_VR-Chain
  source 1..432: mol_type = other RNA
caggtgcaactggtcgagagcggcgggggagttgtgcagcccggtagatccctcaggctttcttgcggcgcctcagggttcacctttagtagctacgctatgcactgggtacggcaggcacctggacgcggcctggaatgggtggccttcacatcctctgacggttcgaacaagaattatggggattcagtcaaaggacgatttactatcagccgtgacaacagtaagaatacgttgttcttacagatgaactccctgagagcggaggataccgctctatactattgtgccaaagacgtgggcgaatacaagtctgatgagtgggcaacagactattacgatctcagcattgcctatccaatacaagacccgagggctatggttggcgcatttgatatctgggggcagggaactatggtgaccgtctcctca

SEQ ID NO: 25179 - RNA, 432 nt, synthetic construct
  misc_feature 1..432: note = derived and/or modified sequence opt3 from anti-HIV_cap256-048-009623_VR-Chain
  source 1..432: mol_type = other RNA
caggtgcaactggtcgagagcggcgggggagttgtgcagcccggtagatccctcaggctttcttgcgccgcttcaggcttcagttttagcaagtacgggatgcactgggtacggcaggcacctggaaaaggcctggaatgggtggccttcgtcgcgtttgacgagggtgataagtattacgtggactccgttaaagggcgcttcaccatctctcgagataactcgaagaatacattgtcattacagatgaacagcctgcgtgctgaagacactgccgtgtattactgtgcaaaagaggtcggagaaaataaggatgacgagtgggccagtgattattacgacctatccattgcttatccaatacatgatccgagagcagtggtaggcggctttgacatctgggggcaaggaacgatggttaccgtgtctagc

SEQ ID NO: 25180 - RNA, 432 nt, synthetic construct
  misc_feature 1..432: note = derived and/or modified sequence opt3 from anti-HIV_cap256-048-008234_VR-Chain
  source 1..432: mol_type = other RNA
caggtgcaactggtcgagagcggcgggggagttgtgcagcccggtagatccctcaggctttcttgcgccgcttcaggcttcacctttacaaactacgcaatggactgggtacggcaggcccctgggaagggactggaatgggtggcggtcatcagtagcgatggctccaataaaaactatgctgactctgtgaagggtcgcttcactatttcgcgagataatagcaaaaacacggtttacttgcagatgtcaagtttacgtccagaggacaccgccgtgtattactgtgcaaaggatgtcggggacacaaaatccgatgaatgggccactgactattacgatctgtctatagcttatccggtgcaagaccccagagcagtagttggagcctttgatatctggggccagggcaccatggtgacagtcagctcc

SEQ ID NO: 25181 - RNA, 432 nt, synthetic construct
  misc_feature 1..432: note = derived and/or modified sequence opt3 from anti-HIV_cap256-048-008149_VR-Chain
  source 1..432: mol_type = other RNA
caggtgcaactggtcgagagcggcgggggagttgtgcagcccggtagatccctcaggctttcttgcgccgcttcaggcttcacctttagtgtatacacaatgcactgggtgcggcaggcacctgggaagggactggaatgggtcgccgtgatcagctatgacggccgcaacaaatactatgcggattccgttaagggtcgattcactatttctcgtgacaattcgaaaaacacggtgtacttgcagatgaactcattaagagtcgaggataccgctgtgtattactgtgccaaggacctgggggcaaataaagatgacgaatgggccacagattattacgacctaagcgtagcttacccagttccggatcccagggcagtggtcggagcctttgacgtgtggggccaaggcactatggtgaccgtcagttcc

SEQ ID NO: 25182 - RNA, 432 nt, synthetic construct
  misc_feature 1..432: note = derived and/or modified sequence opt3 from anti-HIV_cap256-048-007301_VR-Chain
  source 1..432: mol_type = other RNA
caggtgcaactggtcgagagcggcgggggagttgtgcagcccggtagatccctcaggctttcttgcgccgcttcaggcttcagttttaactactatgcaatggactgggtacggcaggcccctgggaagggactggaatgggtggcggtcatcagctccgatggccgcaataaaaactacgctgactctgtgaagggtcgattcaccatttcgcgtgataattcaaagaacacattgtatttacagatgaatagcctgagtgttgaggacactgccgtgtactattgtgcaaaagatctagggaaaaacaaggacgatgaatgggccacggactactatgatatatccatcgcttacccagtcccggaccccagagcagtggtaggagtttttgatatttggggccaaggcaccgtggtcacagtgtctagc

SEQ ID NO: 25183 - RNA, 432 nt, synthetic construct
  misc_feature 1..432: note = derived and/or modified sequence opt3 from anti-HIV_cap256-048-007174_VR-Chain
  source 1..432: mol_type = other RNA
caggtgcaactggtcgagagcggcgggggagttgtgcagcccggtcggtccctcaggctttcttgcgccgcttcaggcttcacctttaacagttacgggatggcatgggtacggcaggcccctggaaagggcctggaatgggtggcgttgatcagctatgacggttccaataaatactatgctgattctgtccgcgggcgattcacaatttcgcgtgacaactcaaaggatactttatacctgcagatggacggactaagaccagaggatacggccctctattactgtgcaaaagacctgggcgaaagcgagtgcgaagagtgggccagtgattattacgactttggcagggattacccgtgtcttgctcccagaggggtgcctggaaccttcgacatatggggtcaaggcacaatggttactgtgtcctct

SEQ ID NO: 25184 - RNA, 432 nt, synthetic construct
  misc_feature 1..432: note = derived and/or modified sequence opt3 from anti-HIV_cap256-048-007079_VR-Chain
  source 1..432: mol_type = other RNA
caggtgcaactggccgagagcggcgggggagtcgttcagcccggtagatccctcaggctttcttgcgctgcatcaggcttcacctttagtatctacgggatgcactgggtgcggcaggcccctggaaagggcctggaatgggtagcgttcattttgagcgacggtacagataaatattccgctgactctgtgaaggggcgctttactatatcgcgagataacagcaaaaatacgttatacctgcagatgaactcactacgtgccgaggacaccgcagtctattactgtgccaaggatctcggaaaagctaaggacgatgaatgggcaacagactattacgatttcagtatcgcctatccagtgcatgacccgagaggcgttgctggcatttttgatatctgggggcaaggaactatggtgaccgtctcctct

SEQ ID NO: 25185 - RNA, 432 nt, synthetic construct
  misc_feature 1..432: note = derived and/or modified sequence opt3 from anti-HIV_cap256-048-007033_VR-Chain
  source 1..432: mol_type = other RNA
caggtgcaactggtcgagagcggcgggggagttgtgcagcccggtagatccctcaggctttcttgcgccgcttcaggcttcacctttagtaatttcgggtttcactgggtacggcaggcacctggaaagggcctggaatgggtggccgcgatcagcttcgctggtaataacaaatactatgccgactccgtcaaggggcgctttacaatttctcgagaaaattcgaaaaacatattgtacttacagatgaactcactgcgtggagaggatactgcagtgtattactgtgccaaggacctaagagagttcgaatgcgaggagtgggctagcgattattacgactttggcagggattatccatgtcaagacccgcggggcgttgtggggacgttcgatgtctggggacatggtagtctcgtgaccgtatcctct

SEQ ID NO: 25186 - RNA, 432 nt, synthetic construct
  misc_feature 1..432: note = derived and/or modified sequence opt3 from anti-HIV_cap256-048-006128_VR-Chain
  source 1..432: mol_type = other RNA
caggtgcaactggtcgagagcggcgggggagttgtgcagcccggtagatccctcaggctttcttgcgccgcttcaggcttcacctttagtacatacgcaatgcactgggtacggcaggcccctgggaagggactggaatgggtggcgttgatcagctatgacggcactgataaatactatgctgactccgtcaagggtcgcttcacgatttctcgagataactcgaaaaataccttatacctgcagatgaactcactacgtgtggaggacacagccgtttatcattgtgcaaaggatctcgggggaagcaaaagtgacgaatgggccactgattactatgactggtccatagcttacccagtgcacgatccgagagcagtcgtgggcgtatttgacatctggggccaagggaccctggttacagtgtctagc

SEQ ID NO: 25187 - RNA, 432 nt, synthetic construct
  misc_feature 1..432: note = derived and/or modified sequence opt3 from anti-HIV_cap256-048-005999_VR-Chain
  source 1..432: mol_type = other RNA
caggtgcaactggtcgagagcggcgggggagttgtgcagcccggtagatccctcaggctttcttgcgccgcttcaggcttcacctttacacacttcgcaatggactgggtacggcaggcccctgggaagggactggaatgggtggcggtcatcagtagcgatggctcctctaaaaactacgctgactcggtgaagggtcgctttactatttcacgagataatagcaaaaacacggttagtttgcagatgaactccttacgtccagaggacaccgccgtgtattactgtgcaaaggatctgggggccaataaagacgatgaatgggctacagactattacgatctatctatagcatatccggtccccgaccctagagccgtggtaggagctttcgatatctggggccaaggcactatggttaccgtgagctcc

SEQ ID NO: 25188 - RNA, 432 nt, synthetic construct
  misc_feature 1..432: note = derived and/or modified sequence opt3 from anti-HIV_cap256-048-005394_VR-Chain
  source 1..432: mol_type = other RNA
caggtgcaactggtcgagagcggcgggggagttgtgcagcccggtagatccctcaggctttcttgcgccgcttcacagttcacctttagtagctacggcatgcactgggtacggcaggcacctgggaagggactggaatgggtggccgcgatctccttcgctggcacaaacaaatattacgccgactctgtcaagggtcgctttactatttcgcgagataattcaaagaacgcattgtatttacaaatgaatagcctgcgtgccgaggacacggctctatactattgtgcaaaagatctcagagagttcgaatgcgaagagtgggccagtgactactatgattttgggagggactacccatgtcaggatccgcggggagtggttggcaccttcgacatatggggccaggggacaatggtgactgtctcctct

SEQ ID NO: 25189 - RNA, 432 nt, synthetic construct
  misc_feature 1..432: note = derived and/or modified sequence opt3 from anti-HIV_cap256-048-004226_VR-Chain
  source 1..432: mol_type = other RNA
caggtgcaactggtcgagagcggcgggggagttgtgcagcccggtagatccctcaggctttcttgcgccgcttcaggcttcacctttaacaagcacgggatgcattgggtacggcaggcacctggaaaaggcctggaatgggtggccttcgtcgcgtttgacggtagtgataagtactatgctgacagcgtgaaagggcgcttcacaatctcccgagataattctaagaacactttgtcgttacagatgaataacctgcgtgccgaggacacggcagtttactattgtgccaaagaagtgggagataataaggacgatgagtgggcttcagactactatgatctaagcattgcatacccagtccaagacccgagagccgtggtaggcggctatgatatatgggggcagggaaccatggttacagtgagttcc

SEQ ID NO: 25190 - RNA, 432 nt, synthetic construct
  misc_feature 1..432: note = derived and/or modified sequence opt3 from anti-HIV_cap256-048-004097_VR-Chain
  source 1..432: mol_type = other RNA
caggtgcaactggtcgagagcggcgggggagttgtgcagcccggtagatccctcaggctttcttgcgccgcttcaggcttcacctttagtgcatacacagtacactgggtgcggcaggcccctgggcgcggactggaatgggtcagcgtgatctcctatgacgatcgaaacaagtactatgcgcattctgttaaaggccgtttcactatttcgagagacaattcaaagaacacgttgtacttacagatgaatagcctgaggcgggaggataccgctgtgtattactgtgccaaagacctaggtgcaaacaaggatgacgaatgggccacagattattacgacctcagtatagcttacccagtcccggatccccgcgcagtggtaggggcctttgacatctggggacaaggcactatggttaccgtgtcctct

SEQ ID NO: 25191 - RNA, 432 nt, synthetic construct
  misc_feature 1..432: note = derived and/or modified sequence opt3 from anti-HIV_cap256-048-003289_VR-Chain
  source 1..432: mol_type = other RNA
caggtgcaactggtcgagagcggcgggggagttgtgcagcccggtagatccctcaggctttcttgcgccgcttcaggcttcacctttagtaagtacgggatgcactgggtacggcaggcacctggaaaaggcctggaatgggtggccttcgtcgcgtttgacggtagctccaagaactatgctgattctgtgaaagggcgcttcacaatctcgcgagacaattcaaagaacactgttagcttgcagatgaatagtttacgtccagaggatacggccgtgtactattgtgcaaaagacctgggagccaacaaggatgacgaatgggctaccgattactatgacctatccattgcatacccggtccccgatcctagagccgtggtaggcgcttttgacatatggggccaagggacaatggttactgtgtctagc

SEQ ID NO: 25192 - RNA, 432 nt, synthetic construct
  misc_feature 1..432: note = derived and/or modified sequence opt3 from anti-HIV_cap256-048-002601_VR-Chain
  source 1..432: mol_type = other RNA
caggtgcaactggtcgagagcggcgggggagttgtgcagcccggtagatccctcaggctttcttgcgccgcttcaggcttcagttttaacaattacgcaatggactgggtacggcaggcccctgggaagggactggaatgggtggcggtcatcagctccgatggccgcaacaaaaattatgctgagtctgtgaagggtcgattcaccatttcgcgtgacaacagcaaaaatacagtttacttgcagatgaactcattaagagccgaagatactgcagtgtattactgtgccaaggacgtcggggatacgaaaaaggacgagtgggctaccgattattacgacctgagtatagcatatccagtgcaagatccgcaggccgtagttggagcttttgacatctggggccagggcacaatggtgactgtctcctct

SEQ ID NO: 25193 - RNA, 432 nt, synthetic construct
  misc_feature 1..432: note = derived and/or modified sequence opt3 from anti-HIV_cap256-048-002129_VR-Chain
  source 1..432: mol_type = other RNA
caggtgcaactggtcgagagcggcgggggagttgtgcagcccggtagatccctcaggctttcttgcgccgcttcaggcttcacctttagtacatacgcaatgcactgggtacggcaggcccctgggaagggactggaatgggtggcgttgatcagctatgacggcactgataaatactatgctgactccgtcaagggtcgcttcattatatctcgagataactcgcgttcaacgttatacctgcagatgaatagcctaagactcgaggacaccgccgtgtatcattgtgcaaaagatcttgggggaagtaagtccgacgaatgggccacagattactatgacctgtctgttgcttacccagtgcaagatccgagggcagtcgtgggcgtatttgacatctggggccaggggactatggttaccgtgagctcc

SEQ ID NO: 25194 - RNA, 432 nt, synthetic construct
  misc_feature 1..432: note = derived and/or modified sequence opt3 from anti-HIV_cap256-048-001875_VR-Chain
  source 1..432: mol_type = other RNA
caggtgcaactggtcgagagcggcgggggagttgtgcagcccggtggctccctcagactttcttgcgccacctcagggctgacattcagtaactacggaatgcactgggtaaggcaggctcctggccggggtttggaatgggtggcatttactcgctatgacgggacgtacaattattacgccgatagcgtcaagggacgattcaccatctcccgtgacaactctaaaggcacattatatctgcagatggatggcctaagaccagaggacactgcgctctactattgtgctaaggatctgggggaaagggagtgcgaagagtgggcctcggactactacgattttggacgggacttcccgtgtcaagatccccgcggtgtggttggcacctttgacatttgggggcagggaacaatggtgaccgtctcaagc

SEQ ID NO: 25195 - RNA, 432 nt, synthetic construct
  misc_feature 1..432: note = derived and/or modified sequence opt3 from anti-HIV_cap256-048-001302_VR-Chain
  source 1..432: mol_type = other RNA
caggtgcaactggtcgagagcggcgggggagttgtgcagcccggtagatccctcaggctttcttgcgccgcttcaggcttcacctttagttacagcgggatgcactgggtacggcaggcacctggaaagggcatggaatgggtggccgtcatctcctatgacggttctaacaaatactatgcggattcggtgaaggggcgcttcacaatttcacgagacaatagcaaaaacactgtttacctgcagatgaatagtttgcgtggagtggatacggctgtctattactgtgccaaggacttaggcggcggggaggtggaagagtgggcaaccgattattacgactggtccatagcctacccagtagaacatccgagagctgttgtgggagtctttgatatctggggtcaaggcacaaaagtgactgtgtctagc

SEQ ID NO: 25196 - RNA, 432 nt, synthetic construct
  misc_feature 1..432: note = derived and/or modified sequence opt3 from anti-HIV_cap256-048-001203_VR-Chain
  source 1..432: mol_type = other RNA
caggtgcaactggtcgagagcggcgggggagttgtgcagcccggtagatccctcaggctttcttgcgccgcttcaggcttcacctttagtagctacgcaatgcactgggtacggcaggcccctgggaagggactggaatgggtggcgatcatttcctatgacggcacaataaaatactatgctgattctgtcaagggtcgcttcactatctcgcgagacaacagcaaaaatacggtgtcattgcagatgaacagtttacgtccagaggataccgccgtttactattgtgcaaaggacgtgggggccaataaagatgacgaatgggctacagattactatgacctgtccattgcatacccggtccccgatcctagagccgtggtaggagcttttgacatctggggccaaggcactatggttaccgtgtctagc

SEQ ID NO: 25197 - RNA, 432 nt, synthetic construct
  misc_feature 1..432: note = derived and/or modified sequence opt3 from anti-HIV_cap256-048-000383_VR-Chain
  source 1..432: mol_type = other RNA
caggtgcaactggtcgagagcggcgggggagttgtgcagcccggtagatccctcaggctttcttgcaccgcctcaggcttcacatttaaccactacgctatggactgggtacggcaggcacctgggaagggactggaatgggtggccgtcatcagtagcgatggctccgacaaaacttatgcggattctgtgaagggtcgcttcacgatttcgcgagacaattcaaagaacaccgtttacttgcagatgaatagcttacgtgctgaggatacagccgtgtattactgtgcaaaagacgtcgggggaagtaaagatgacgaatgggccactgattattacgacctgtccatagcttatccagtgccggatcccagagcagtagttggcgcctttgacttctggggccctgggaccatggtgacagtctctagc

SEQ ID NO: 25198 - RNA, 432 nt, synthetic construct
  misc_feature 1..432: note = derived and/or modified sequence opt3 from anti-HIV_cap256-038-261791_VR-Chain
  source 1..432: mol_type = other RNA
caggtgcaactggtcgagttcggcgggggagttgtgcagcccggtggcagcctcagactttcctgcgccgcttttgggttcaccatctcttcatacggaatgcactgggtaaggcaggcacctggcaagggtctgcagtgggtggcctttattcggtatgacgaaagtagcaaattctacgcggattccgtcaaggggcgctttacaatatctcgagacaactcggagaatactttgtatttacaaatgaactcactgcgtgctgaagatacggccgtgtactattgtgcaaaagacctaggagagagcgaaaatgaggagtgggccaccgattactatgacttcagtatcgcttacccaggccaggatccgagaggcgttgtggggatttttgacatctggggacagggtacaatggtcactgtgtcctct

SEQ ID NO: 25199 - RNA, 432 nt, synthetic construct
  misc_feature 1..432: note = derived and/or modified sequence opt3 from anti-HIV_cap256-038-241540_VR-Chain
  source 1..432: mol_type = other RNA
caggtgcaactggtcgagagcggcgggggagttgtgcagcccggtagatccctcaggctttcttgcgccgcttcaggcttcacctttagtaacagcgcaatgcactgggtacggcaggcccctgggaagggactggaatgggtggcgttgatctcctacgtcggcggtaatatttattacgctgactctgtgaaagggcgcttcacagtttcgcgagataactcaaagaaaactttatatctgcagatgaatagcctacgtgtggaggacacggccgtctactattgtgtgaaggatgtaggagaaagtgagaacgaagagtgggcatccgactactatgattttggcagagactacccaggccaagataccagggccgttgtgggggctttcgacatatggggacagggtacaatggtcactgtgtctagc

SEQ ID NO: 25200 - RNA, 432 nt, synthetic construct
  misc_feature 1..432: note = derived and/or modified sequence opt3 from anti-HIV_cap256-038-235677_VR-Chain
  source 1..432: mol_type = other RNA
ctggtgcagctcgtcgagagcggcgggggagttgtgcaacccggtggctcccttagactgtcttgcgccgcttcagggttcaggtttagtagctacggaatgcactgggtacggcaggcacctggcaagggtttggaatgggtggccttcatccgctatgacgggtcctttaaagattacgcggactctgtccgaggacgtttcaccatttcgagagagaactcaaagaatacattatatctgcagatgaacagcctaaggactgatgacacggctgtgtactattgtgccaaagatctcggcgaaagtgagaccgaagagtggccatccgactactatgattttggccgggactacccggggcaggatccccgcggagttgtgggtacattcgacatatggggccatgggactatggtcaccgtgtctagc

SEQ ID NO: 25201 - RNA, 435 nt, synthetic construct
  misc_feature 1..435: note = derived and/or modified sequence opt3 from anti-HIV_cap256-038-234314_VR-Chain
  source 1..435: mol_type = other RNA
gaggtgcagctgctcgaaagcggcgggggacttgtccaacccggtggctccctgagattgtcttgcgccgcttcagggttcacctttagtaggtacgcaatgagctgggttcggcaggcccctggaaagggcttagagtgggtggcggtaatctcctatgacggttctaacaaatactatgctgattcggtgaaggggcgcttcacaatttcacgagacaatagcaaaaacactctgtacctacagatgaatagtctccgtgccgtcgatacggcagtgtattactgtgccaaggacctgggagaaggcgagaacgaagagtgggctaccgattattacgacttttcctactggcttccatgcccgaaatatcacggcgcatggctggagttgctctacatatgggggcagggaacaatggttactgtgtctagc

SEQ ID NO: 25202 - RNA, 432 nt, synthetic construct
  misc_feature 1..432: note = derived and/or modified sequence opt3 from anti-HIV_cap256-038-234273_VR-Chain
  source 1..432: mol_type = other RNA
gaggtgcagctggtcgaaagcggcgggggactcatccaacccggtggctcccttagactgtcttgcgccgcttcagggttcaccgttagtacaaactttatgagctgggtgaggcaggcacctggaaagggcttggagtgggtagccgtgatttcctacgacggtaataacaaatattacgcggattctgtcaaggggcggttcactatatcgcgcgaaaattcaaagaacacgttatatctgcagatgaatagcctacgaaccgacgatacagctgtgtactattgtgccaaagacctcggagagagtgaaactgaggagtggccatccgattactatgactttggccgtgattacccgggccaggaccccagaggggttgtgggaaccttcgatatctggggtcacggcacaatggtcaccgtgtctagc

SEQ ID NO: 25203 - RNA, 432 nt, synthetic construct
  misc_feature 1..432: note = derived and/or modified sequence opt3 from anti-HIV_cap256-038-223164_VR-Chain
  source 1..432: mol_type = other RNA
gaggtgcagctggtcgaaagcggcgggggactcgttagacccggtggctcccttaggctgtcttgcgccgcttcagggttcagtttgggaagctactggatgacctgggtgcggcaagcacctggcaagggtttagagtgggtagccgtgatctcctatgacgggtctaacaaatactatgcggattcggtcaagggacgctttacaatttcacgagacaatagcaaaaacactctgtacctacagatgaatagtctccgtgctgaagatacggccctgtattactgtgcaaaggaccttggcgagtccgaaaacgaggagtgggcctctgattattacgacttcggcagagattacccagggcaggacccgaggggagtggttggtacctttgatatatggggccaggggacaatggtgactgtcagctcc

SEQ ID NO: 25204 - RNA, 432 nt, synthetic construct
  misc_feature 1..432: note = derived and/or modified sequence opt3 from anti-HIV_cap256-038-220289_VR-Chain
  source 1..432: mol_type = other RNA
gaggtgcagctggtcgaaagcggcgggggactcgttcaacccggtggctcccttagactgtcttgcaccgcctcagggttcacatttagtagctacgagatgaactgggtgaggcaggctcctggaaagggcccagaatgggtagcagtgatctcctatgacggtaataacaaatactatgccgattctgtcaaggggcggttcactatttcgcgcgagaatagcaaaaatacgttgtacttacagatgaactcactgcgaaccgacgatacagcggtgtattactgtgctaaggacctaggagaaagtgagactgaggaatggccgtccgattattacgactttggccgtgattaccccggccaggaccctagaggggttgtgggaaccttcgatatatggggtcacggcacaatggtcaccgtgtctagc

SEQ ID NO: 25205 - RNA, 432 nt, synthetic construct
  misc_feature 1..432: note = derived and/or modified sequence opt3 from anti-HIV_cap256-038-220020_VR-Chain
  source 1..432: mol_type = other RNA
caggtgcaactggtcgagagcggcgggggagttgtgcagcccggtagatccctcaggctttcttgcgccgcttcaggcttcacctttagtcggaacgcaatgcactgggtacgccaggcccctgggaagggactggaatgggtggcgttgatcagctacgacggctccaataaatattacgtcgattctgtgaagggtcgattcacaatttcgcgtgacaacagcaaaaatactttatatctgcagatgaactcactaagagctgatgacacggccgtttactattgtgcaaaggatctcggggagagtgaaaccgaggaatggggaacagactactatgatttttccactggctacccagtgcaagacccgaggggcgtcgtgggggccttcgatatatggggacagggtaccatggtatctgttagctcc

SEQ ID NO: 25206 - RNA, 432 nt, synthetic construct
  misc_feature 1..432: note = derived and/or modified sequence opt3 from anti-HIV_cap256-038-216853_VR-Chain
  source 1..432: mol_type = other RNA
caggtgcaactggtcgagagcggcgggggagttgtgcagcccggtagatccctcaggctttcttgcgccgcttcaggcttcacctttagtagctacgcaatgcactgggtacggcaggcccctgggaagggactggaatgggtggcggtcatctcctatgacggctctaacaaatactatgctgattcggtgaagggtcgcttcacaatttcacgagacaatagcaaaaacactttgtacgttcagatgaatagtttacgtgccgaggatacggcagtgtattactgtgccagagacctgggggaatccgagaccgaagagtggccatctgattattacgactttggaagggattacccgggccaagacccccggggcgtcgtggggacattcgatatatggggacatggtactatggtaaccgttagctcc

SEQ ID NO: 25207 - RNA, 432 nt, synthetic construct
  misc_feature 1..432: note = derived and/or modified sequence opt3 from anti-HIV_cap256-038-213466_VR-Chain
  source 1..432: mol_type = other RNA
gaggtgcagctggtcgaaagcggcgggggactcgttcaacccggtagatcccttagggtgtcttgcgccgcttcaggcttcacctttgaggactacgcaatgcactgggtacggcaggcccctgggaagggactggaatgggtggcggtcatcagtgatgacggcaacaataaatattacgctgatagcgtgaagggtcgcttcacaatttcccgagacaactctaaaaatactttgtatttacagatgaactcgctgcgtgttgaggatacggccgtgtactattgtgtcaaggacgtgggggaatcagagaatgaggaatgggcaagcgattactatgactttggaagagattacccaggccaggacaccagggccgtagttggcgctttcgatatatgggggcaaggaacaatggtgactgtcagttcc

SEQ ID NO: 25208 - RNA, 432 nt, synthetic construct
  misc_feature 1..432: note = derived and/or modified sequence opt3 from anti-HIV_cap256-038-213212_VR-Chain
  source 1..432: mol_type = other RNA
caggtgcaactggtcgagagcggcgggggagttgtgcagcccggtggctccctcagactttcttgcgccgcttcagggttcatctttagtgactacggaatgcactgggtaaggcaggcacctggcaagggtctggaatgggtggccagcatttggcatgatgggtccaaaaagtattacgcggactctgtcaaaggacggttcaccatatcgcgcgagaactcaaagaatacattgtatttacagatgaacagcctgcgagctgaagatactgccgtgtaccactgtgcaaaagacctaggcgagagtgaaatcgaggagtggacgtccgattattacgactttggccgtgattatccagggcaagacccgagaggagttttcggtacctttgatatttggggccatgggacaatggtgactgtctctagc

SEQ ID NO: 25209 - RNA, 432 nt, synthetic construct
  misc_feature 1..432: note = derived and/or modified sequence opt3 from anti-HIV_cap256-038-213120_VR-Chain
  source 1..432: mol_type = other RNA
caggtgcacctggtcgagagcggcgggggactcgttaagcccggtggctcccttagactgtcttgcgccgcttcagggttcacctttagtgactactatatgatctggattaggcaagcacctggaaaaggcttggaatgggtggccgtaataagctccgatggttctaacaagaattacgcggactcggtgaaagggcggttcacaatctcacgcgataacagcaagaatactttatatctgcagatgaacagtctacgagctgaggacacggccgtctactattgtgcaaaagatctcggagaatccgagaatgaagagtgggccaccgactactatgattttgctacaggctacccagtgcaggacccgcgtgcagttgtgggcgccttcgatatttgggggcagggaactatggtcaccgtgtctccc

SEQ ID NO: 25210 - RNA, 432 nt, synthetic construct
  misc_feature 1..432: note = derived and/or modified sequence opt3 from anti-HIV_cap256-038-212592_VR-Chain
  source 1..432: mol_type = other RNA
ctggtgcagctcgtcgagagcggcgggggagttgtgcaacccggtaagtcccttagactgtcttgcgccgcttcaggcttcacctttagtagctacgcaatgcactggatcaggcaggcccctgggaaaggattggaatgggtagcggtgatttccgacgatggctctataaagaactatgctgactcggtcaaaggtcggttcacaatctcacgcgatactagcaagaaattaatgtacctgcagatgaatagtctatccgccaacgacacggcagtgtattactgtgccaaggatctcggggagcgagaaaatgaggaatgggcttctgactattacgattttggacgtgactatccaggccaggatccgagaggcgttgtggggagcattgacacctggggacatggtacaatggtcactgtgtcctca

SEQ ID NO: 25211 - RNA, 432 nt, synthetic construct
  misc_feature 1..432: note = derived and/or modified sequence opt3 from anti-HIV_cap256-038-211790_VR-Chain
  source 1..432: mol_type = other RNA
gagctgcagctcgtggaaagcggcgggggacttgtccaacccggtggctccctgagattgtcttgcgttgtgtcagggttcaccgtaagtacaaactacatcagctgggtgaggcaggcccctggaaagggcttagagtgggtcgctgtgatttcctatgacggttctaataaatactatgcagattcggttaaggggcggtttactatatcacgcgacaacagcaaaaatacgctgtacctacagatgaacagtctccgagccgaagataccgcgctgtattactgtgctaaggaccttggagagtccgaaaatgaggagtgggcctctgattattacgacttcggccgtgattacccaggccaggacccgagaggggtggtcggaacatttgatatctggggtcaaggcactatggtgaccgtaagctcc

SEQ ID NO: 25212 - RNA, 432 nt, synthetic construct
  misc_feature 1..432: note = derived and/or modified sequence opt3 from anti-HIV_cap256-038-209916_VR-Chain
  source 1..432: mol_type = other RNA
caggtgcaactggtcgagagcggcgggggagttgtgcagcccggtggctccctcagactttcttgcgccgcttcagggttcacctttagtagcttcggaatgcactgggtaaggcaggcacctggcaagggtctggaatgggtgtcctttatccggaacgacgggggcattcgctactctgccgattcggtccgaggacgtttcacaatatcaagagacaatagcaaaaacactttgtatttacagatgaatagtctgaggacggatgacaccgcggtgtactattgtgctaaggatctaggcgagtccgaaacagaggaatggccatctgactactatgattttgggcgggactacccgggacaagatccccgcggtgttgtgggcactttcgacatctgggggcatggaaccatggtcacagtgagctcc

SEQ ID NO: 25213 - RNA, 432 nt, synthetic construct
  misc_feature 1..432: note = derived and/or modified sequence opt3 from anti-HIV_cap256-038-207938_VR-Chain
  source 1..432: mol_type = other RNA
caggtgcaactggtcgagagcggcgggggagttgtgcaccccggtaggtccctcaggctttcttgcgccgcttcaggcttcacctttagtagctacgggatgcattgggtacggcaggcacctggaaagggcctggaatgggtggccgtcatctcccacgacggttctaacaaatattacgcggattcggtgaaggggcgcttcacaatttcacgagacaatagcaaaaacactttgtatttacagatgaatagtctgcgtgctgaggatacggccgtttactattgtgcaaaggacctaggagaatccgagaacgaagagtgggcctctgattactatgactttggcagagattacccaggccaggacccgagaggggtggtcggagtgttcgatatatggggtcaaggcaccatggtaacagttagctcc

SEQ ID NO: 25214 - RNA, 432 nt, synthetic construct
  misc_feature 1..432: note = derived and/or modified sequence opt3 from anti-HIV_cap256-038-202245_VR-Chain
  source 1..432: mol_type = other RNA
caggtgcacctggtcgagagcggcgggggagttgtgcaacccggtaggtccctcaggctttcttgcaccgtatcaggcttcacatttgggagttacgccctgcattgggtgcggcaggctcctggaaagggcttggaatggttaagcgtcatctcctatgacggtaacaataaatactatgcagattctgtgaaggggcgcttcactatttcgcgagagaacagcaaaaatacgctgtacctacagatgaactcactccgtgccgaagacaccgcggtttatcactgtgctaaggatctgggagagagtgaaaaagaggagtgggcctccgactactatgattttggcagagactacccaggccaggatccgagaggggtggtcggaacattcgacatatggggtcatggcactatggtgaccgtatctagc

SEQ ID NO: 25215 - RNA, 432 nt, synthetic construct
  misc_feature 1..432: note = derived and/or modified sequence opt3 from anti-HIV_cap256-038-197721_VR-Chain
  source 1..432: mol_type = other RNA
caggtgcaactggtcgagagcggcgggggagttgtgcagcccggtaagtccctcagactttcttgcgccggctcagggttcatctttagtaactaccctatgcactgggtaaggcaggctccaggaaaaggcctggaatggatggcagacgtgagctatgatggttccaataaggactacgccgattctgtcaaagggcggttcaccatttcgcgcgacaactcaaagaatacattgtatttacagatgaacagcctgcgagcggaggatactgctgtgtactattgtgttaaagacgtgggagaaagtgagaatgaagagtgggcctccgattactatgactttggccgtgattacccgggccaagacacgagagcagtcgtgggggccttcgatatatggggacagggtaccatggtaacagtttctagc

SEQ ID NO: 25216 - RNA, 432 nt, synthetic construct
  misc_feature 1..432: note = derived and/or modified sequence opt3 from anti-HIV_cap256-038-196679_VR-Chain
  source 1..432: mol_type = other RNA
gaggtgcagctgctcgaaagcggcgggggacttgtccaacccggtggctccctgagattgtcttgcgccgcttcagggttcacctttagtagctacgcaatgtcctgggttaggcaggcccctggaaagggcttagagtgggtggcggtaatctcttatgacggtgggaacaaatactatgctgattcggtgaagggacggttcacaatttcacgcgacaatagcaaaaacactctgtacctacagatgaatagtctccgagccgaagatacggcactgtattactgtgccaaggaccttggcgagtccgaaaacgaggagtgggcttctgattattacgactttggccgtgattacccagggcaggacagcagaggagtcgtgggtaccttcgatgtttggggccaagggacaatggtgactgtctcctca

SEQ ID NO: 25217 - RNA, 438 nt, synthetic construct
  misc_feature 1..438: note = derived and/or modified sequence opt3 from anti-HIV_cap256-038-196118_VR-Chain
  source 1..438: mol_type = other RNA
caggtgcaactggtcgagagcggcgggggagttgtgcagcccggtggctccctcagactttcttgcgccgcttcagggttcacctttagtacatacggaatgcactgggtaaggcaggcacctggcaagggtctggaatgggtgactttcatccggaacgacgggacgaataaatattacgccgatagcgtcaagggacgctttaccatttcccgagacaacactaaaaatacattgtatttacagatgtactctctgcgtgcggaggataccgctgtgtattactgtgccaaggacctaggcgaatcggagaacgaagatgaggagtgggcatcagactattacgatttcggcagagactacccagggcaagatagcaggggagttgtgggtacatttgacatgtggggccaggggaccatggtcactgtgagttcc

SEQ ID NO: 25218 - RNA, 429 nt, synthetic construct
  misc_feature 1..429: note = derived and/or modified sequence opt3 from anti-HIV_cap256-038-195382_VR-Chain
  source 1..429: mol_type = other RNA
caggtgcacctggtcgagagcggcgggggagttgtgcaacccggtaggtccctcaggctttcttgcgccgcttcaggcttcacctttagtaattaccctgtacattgggtgcggcaggcaccagggaagggactggaatgggtcgccgtgatcagcttcgacggcattaataactatgcgggttccgttaaagggcgctttataatctctcgagataattcgaagaacacattgtacttacagatgaactcactgcgtgctgaggacactgccgtgtattactgtgtcaaagatctaggagaaagcgagaaggaagagtggccgagtgactattacgatttcggcagagactatcccggccaggattccagaggggtggtaggagtttttgacatttggggtcaaggcacgatggtgaccgtctctagc

SEQ ID NO: 25219 - RNA, 432 nt, synthetic construct
  misc_feature 1..432: note = derived and/or modified sequence opt3 from anti-HIV_cap256-038-180001_VR-Chain
  source 1..432: mol_type = other RNA
gaggtgcagctggtcgaaagcggcgggggactcgttcaacccggtaggtcccttaggctgtcttgcaccgcctcaggcttcacatttggggactacgctatgagttggttccggcaggcacctggaaagggcttggagtgggtggccgatatcagctatgacggttccaacaaatactatgcggattctgtaaaggggcgcttaactatttcgcgagacaattcaaagaacacgctgtacctacagatgaatagcctccgtgctgaagataccgccgtgtattactgtgtcaaagacctgggagagagtgaaaaagaggagtggccatccgattattacgactttggcagagattacccgggccaggactctagaggggtggttggagtgttcgatatatggggtcaaggcacaatggtcactgtgagctcc

SEQ ID NO: 25220 - RNA, 432 nt, synthetic construct
  misc_feature 1..432: note = derived and/or modified sequence opt3 from anti-HIV_cap256-038-178021_VR-Chain
  source 1..432: mol_type = other RNA
caggtgaagctggtcgagagcggcgggggagttgtgcaacccggtggctccctcagactttcttgcgccgctgcagggttcatcttttcaaacagtggaatgcactgggtaaggcaggcccctgacaaaggcctggaatgggtggcgttcgtcccatacgatggtagcaataagtattacgctgactccgtgaaagggcggtttaccatttctcgcgataactcgaagaatacattgtcattacagatgaacagcctgcgaactgaggacacggccgtttattactgtgcaaaagatctaggagaaagtgagaccgaagagtggccgtccgactattacgatttcggccgtgactatcccggccaggatcctagaggggtggtcggaacatttgacatatggggtcatggcactatggtgaccgtatctagc

SEQ ID NO: 25221 - RNA, 432 nt, synthetic construct
  misc_feature 1..432: note = derived and/or modified sequence opt3 from anti-HIV_cap256-038-177104_VR-Chain
  source 1..432: mol_type = other RNA
gaggtgcagctgctcgaaagcggcgggggacttgtccaacccggtggctccctgagattgtcttgcgccgcttcagggttcacctttagtagctacgcaatgaactgggttaggcaggcccctggaaagggcttagagtgggtggcggtaatctcctatgacggtggggataaatactatgctgactctgtgaagggacggttcacaatttcgcgcgataattcaaagaacactctgtacctacagatgaatagcctccgagtcgaagacacggccgtgtattactgtgttaaagatgtgggcgagagtgaaaacgaggagtgggcatccgactattacgattttggccgtgactacccagggcaggataccagagccgtcgtgggagctttcgacatatggggtcaaggcacaatggtaactgtttctagc

SEQ ID NO: 25222 - RNA, 432 nt, synthetic construct
  misc_feature 1..432: note = derived and/or modified sequence opt3 from anti-HIV_cap256-038-171261_VR-Chain
  source 1..432: mol_type = other RNA
caggtgcaactggtcgagagcggcgggggagttgtgcagcccggtagatccctcaggctttcttgcgccgcttcaggcttcacctttagtagctacgcaatgtattgggtacggcaggcccctgggaagggactggaatgggtggcggtcatctcctctgacggctcggataaaaactacgctgactcagtgaagggtcgcttcacaattagccgagataatagtaacaatactttgtatttacagatgaactccctgcgtgccgaggacacggcagtttactattgtgccagagatctaggggaatctgagaatgaagagtggccaagcgactactatgattttggaagggactacccgggccaagatccccggggcgtgatagggaccttcgacgtctggggacagggtacaatggtgactgtatcctca

SEQ ID NO: 25223 - RNA, 432 nt, synthetic construct
  misc_feature 1..432: note = derived and/or modified sequence opt3 from anti-HIV_cap256-038-169090_VR-Chain
  source 1..432: mol_type = other RNA
caggtgcaactggtcgagagcggcgggggagttgtgcagcccggtagatccctcaggctttcttgcgccgcttcacggttcacctttaagacatacactatgcactgggtacgccaggcacctggcaaagggctggaatgggtggccttgatcagttatgacggaagcaataagtactatgcggattccgtcaaaggccgattaacgatttctcgtgacaattcgaagaacaccctgtacctacagatgaactcactcagagctgaggatacagccgtgtattactgtgttaaagacctgggtgaaagcgagaaggaagagtggccaagtgattattacgacttcgggagggattacccgggacaagactcccggggcgtggtcggcgtgtttgatatatgggggcagggaactatggtaaccgtttctagc

SEQ ID NO: 25224 - RNA, 432 nt, synthetic construct
  misc_feature 1..432: note = derived and/or modified sequence opt3 from anti-HIV_cap256-038-168705_VR-Chain
  source 1..432: mol_type = other RNA
gaggtgcagctggtcgaaagcggcgggggactcgttaagcccggtggctcccttagactgtcttgcgccgcttcagggttcacctttagtagctactccatgaactgggtgaggcgggcacctggaaaaggcttggagtgggtagccttaatctcttatgacgaaaataagaaatactatgcggattcggtgaagggtcgcttcacaatttcacgagagaacagcaaaaatactctgtacctacaaatgaacagtctccgtgctgaagacacggccgtctattactgtgcaaaggatctgggggagagagagaatgaagagtgggcctccgactattacgattttggaagggactacccaggccaggatccgcggggcgtggttgggtctatagacacctggggacacggtacaatggtgactgtcagctcc

SEQ ID NO: 25225 - RNA, 432 nt, synthetic construct
  misc_feature 1..432: note = derived and/or modified sequence opt3 from anti-HIV_cap256-038-167685_VR-Chain
  source 1..432: mol_type = other RNA
caggtgcaactggtcgagagcggcgggggagttgtgcagcccggtagatccctcaggctttcttgcgccgcttcaggcatcaccttcagtagctacgcaattcactgggtacggcaggcccctgggaagggactggaatgggtggcggtcatatcctatgacggctctaacaaatactatgctgattcggtgaagggtcgctttacaatctcacgagacaatagcaaaaacactttgtacttacagatgaatagtctgcgtgccgaggatacggcagtttattactgtgccaaggacctaggggaatccgagaacgaagagtgggctaccgattattacgacttctctattggatacccaggccaagatccgagaggcgtggtcggggcatttgacatctggggacagggtacaatggtgactgtaagcctc

SEQ ID NO: 25226 - RNA, 432 nt, synthetic construct
  misc_feature 1..432: note = derived and/or modified sequence opt3 from anti-HIV_cap256-038-158775_VR-Chain
  source 1..432: mol_type = other RNA
caggtgcaactggtcgagagcggcgggggagttgtgcagcccggtggctccctcagactttcttgcgccgcttcagggttcacctttagtacatacggaatgcactgggtaaggcaggcacctggcaagggtctggaatgggtggccttcatccgggacaacgggagcaataaatattacgcggattccgtcaagggacgctttactatttctcgagacaactcgaaaaatacgttgtatttacagatgaactcactgcgtgctgaggataccgccctatactattgtgcaaaggacctcggcgaaagcgagaatgaagagtgggccagtgattactatgacttcggcagagattacccagggcaagactccaggggagtggttggtacatttgatgtgtggggccaggggactatggtcaccgtgtctagc

SEQ ID NO: 25227 - RNA, 432 nt, synthetic construct
  misc_feature 1..432: note = derived and/or modified sequence opt3 from anti-HIV_cap256-038-157318_VR-Chain
  source 1..432: mol_type = other RNA
cacgtgcagctggtcgagagcggcgggggagttgtgcaacccggtagatccctcaggctttcttgcgccgcttcaggcatcaccttcagtacatacgacatgcattgggtacggcaggcacctgggaagggactggaatgggtggccgtcattagcaacgatggctccaataaatattacgcggactctgtgaagggtcgctttactatatcgcgagataacagcaaaaatacgttgtatttacagatgaactcactgcgtgctgaggacaccgccctatactattgtgcaaaggatctcggggaaagtgagaaagaagagtgggcctccgactactatgatttcggaagagactacccaggccaggatccgaggggcgttgtggctacatttgacatctgggggcaaggaactatggtcaccgtgtctagc

SEQ ID NO: 25228 - RNA, 432 nt, synthetic construct
  misc_feature 1..432: note = derived and/or modified sequence opt3 from anti-HIV_cap256-038-153058_VR-Chain
  source 1..432: mol_type = other RNA
caggtgcaactggtcgagagcggcgggggagttgtgcagcccggtaggtccctcaggctttcttgcgccgcttcaggcttcacctttagtacatacgcaatgcactgggtacggcaggcccctgggaagggactggaatgggtggcggtcatcagctatgacggctcccattcttactatgctggttcggtgaaagggcgcttcactacgtcacgagataacagcaagaataccttgaacttacagatgaatagtctgcgtccagaggacacagccctatactattgtgcaaaagatctcggagaatccgagaacgaagagtgggcctctgactactatgattttggcagagactacccgggccaagatagcagaggggttgtgggaactttcgacgtctggggtcagggcaccatggtgacagtatcctca

SEQ ID NO: 25229 - RNA, 432 nt, synthetic construct
  misc_feature 1..432: note = derived and/or modified sequence opt3 from anti-HIV_cap256-038-150027_VR-Chain
  source 1..432: mol_type = other RNA
ctggtgcagctcgtcgagagcggcgggggagttgtgcaacccggtggctcccttagactgtcttgcgccgcttcagggttcaggtttagtagctacggaatgcactgggtacggcaggcacctggcaagggtttggaatgggtggccttcatccgctatgacgggtcctttaaagattacgcggactctgtccgaggacgtttcaccatttcgagagataactcaaagaatacagtgtatgttcagatgaacagcttaagggctgaggacactgccgtgtactattgtgcaaaagatctgggcgaaagtgagaatgaagagtgggccacggactactatgattttgctaccggctacccagtccaggacccgcgggcagtggtaggggccttcgatatatggggacaaggtacaatggttactgtgtccccc

SEQ ID NO: 25230 - RNA, 432 nt, synthetic construct
  misc_feature 1..432: note = derived and/or modified sequence opt3 from anti-HIV_cap256-038-146372_VR-Chain
  source 1..432: mol_type = other RNA
caggtgcaactggtcgagagcggcgggggagttgtgcagcccggtagatccctcaggctttcttgcgccgcttcaggcttcacctttagtagcttcgggatgcactgggtacggcagtcccctggaaagggcctggaatgggtggcagtcatctcttacgacggtaacaataaatattacgccgattcggtgaaggggcgctttacaatttcacgagagaacagcaaaaatactttgtatttacagatgaacagtctgcgtacggacgataccgcggtttactattgtgctaaggacctaggagaatccgagacagaagagtgggccactgattactatgacttcgcaaccggctacccagtgcaagatccgagagccgtcgtgggcgcttttgacatatgggggcagggaacaatggtaaccgtttctccc

SEQ ID NO: 25231 - RNA, 432 nt, synthetic construct
  misc_feature 1..432: note = derived and/or modified sequence opt3 from anti-HIV_cap256-038-141868_VR-Chain
  source 1..432: mol_type = other RNA
gagctgagactcgtggaaagcggcgggaaccttgtccagcccggaggttccctgaccttgtcttgcgttgcctcaggcttcacatttgacagttacgggatgagctgggtgaggcaagctcctggaaagggcttagagtgggtagcactgatctcctatgatgaaaataaaaagtactatgccgactctgtgaaaggtcggttcactatttcgcgcgagaactcaaagaatacgctatacctccagatgaacagcctgcgagcggaagataccgctgtctattactgtgccaaagaccttggggagcgtgagaatgaagagtgggcaagtgattattacgactttggaagagattacccaggccaggacccgaggggcgtggttgggtccatagatacatggggacacggtactatggtgaccgtctctagc

SEQ ID NO: 25232 - RNA, 432 nt, synthetic construct
  misc_feature 1..432: note = derived and/or modified sequence opt3 from anti-HIV_cap256-038-141616_VR-Chain
  source 1..432: mol_type = other RNA
gaggtgcagctgctcgaaagcggcgggggacttgtccaacccggtggctccctgaggttgtcttgcgccgcttcagggttcacctttagtagctacgcaatgtcctgggttaggcaggcccctggaaagggcttagagtgggtggcggtaatctctaaagacggttcggataactcatatgtggacagcgtcaaggggcggttcacaattagtcgcgataattccaaaaacactctgtacctacagatgaactctctccgagctgaagacacggccgtgtattactgtgcacgtgatctgggagagagcgaaaatgaggagtggccatccgactattacgattttggcagagactatccgggccaggatcccagaggggttataggaaccttcgacgtgtggggtcaaggcacaatggtcactgtgtcaagt

SEQ ID NO: 25233 - RNA, 432 nt, synthetic construct
  misc_feature 1..432: note = derived and/or modified sequence opt3 from anti-HIV_cap256-038-127989_VR-Chain
  source 1..432: mol_type = other RNA
caggcccaactggtggagagcggcgggggagtcgttcagcccggtagatccctcaggctttcttgcgctgcatcaggcttcacctttagtaacttcgccatgcactgggtgcggcaggcgcctgggaagggactggaatgggtagctgtgatgagcgacgatggctccaataaatactatgccgactctgtcaagggtcgctttacaatctcgcgagataactcagagaatactttgtacttacagatgaacagcctgcgtgcagaagacacggccgtgtattactgtgctaaagatctaggggagagtgaaaccgaggagtgggcaacagactattacgatttcggaactggctatccaggccaagacccgagagccatgattgggacctttgatatatggggaaggggtacaatggttaccgtgtcctct

SEQ ID NO: 25234 - RNA, 432 nt, synthetic construct
  misc_feature 1..432: note = derived and/or modified sequence opt3 from anti-HIV_cap256-038-118109_VR-Chain
  source 1..432: mol_type = other RNA
caggtgcaactggtcgagagcggcgggggagttgtgcagcccggtggctccctcagactttcttgcaccgcctcagggttcacatttagtgcttacgacatgcactggatcaggcaggcacctggaaagggcctgggttgggtagccttcattactaacgaagggagctccaaaaattatgtggattctgtcaagggacggtttacgatatcgcgcgacaacagcaaaaataccttgtacttacagatgaactcactgcgagcggaggatacagctgtgtattactgtgccaaggacctaggcgaaagtgagaatgaagagtgggcaactgattattacgacttctccatcgcctatccaggccaagatccgcgtggggttgtgggaatttttgacatctggggtcagggcaccatggtcacagtgtctagc

SEQ ID NO: 25235 - RNA, 432 nt, synthetic construct
  misc_feature 1..432: note = derived and/or modified sequence opt3 from anti-HIV_cap256-038-112226_VR-Chain
  source 1..432: mol_type = other RNA
gaggtgcagctggtcgaaagcggcgggggactcgttcaacccggtggctcccttagactgtcttgcgccgcttcagggttcacctttagtagctactggatgacatgggtgaggcaggcacctggaaagggcttggagtgggtagccgtgatctccgacgatggtaacaataaatattacgcggactctgtcaaggggcggttcactatttcgcgcgataacagcaaaaatacgttatatctgcagatgaactcactacgagtggaagacaccgctgtttactattgtgtgaaggatgtcggagagagtgaaaatgaggagtgggcctccgactactatgattttggccgtgactacccaggccaggatacaagagcagtggtaggggccttcgacatatggggacaaggtactatggttaccgtgtctagc

SEQ ID NO: 25236 - RNA, 432 nt, synthetic construct
  misc_feature 1..432: note = derived and/or modified sequence opt3 from anti-HIV_cap256-038-105918_VR-Chain
  source 1..432: mol_type = other RNA
gaggtgcagctgctcgaaagcggcgggggacttgtccaacccggtggctccctgagattgtcttgcgccgcttcagggttcacctttaatatccaccctatgcattgggttaggcaggcaccaggaaagggcttagagtgggtggccgtaattagttacgacggtaataacaaatattacgcggatagcgtgaaggggcggttcacaatatcccgcgaaaattctaaaaacactctgtatctacagatgaactcgctccgaacggacgataccgctgtctactattgtgccaaggacctgggagagtcagaaacagaggagtggccgagcgattactatgactttggccgtgattaccccggccaggaccctagaggggtggttggaactttcgatatctggggtcacggcaccatggtgacagtcagttcc

SEQ ID NO: 25237 - RNA, 432 nt, synthetic construct
  misc_feature 1..432: note = derived and/or modified sequence opt3 from anti-HIV_cap256-038-104487_VR-Chain
  source 1..432: mol_type = other RNA
ctggtgcagctcgtcgagagcggcgggggagttgtgcaacccggtaagtcccttagactgtcttgcgccgcttcaggcttcacctttagtagctacgcaatgcactggatcaggcaggcccctgggaaaggattggaatgggtagcggtgatttccgacgatggctctataaagaactatgctgactcggtcaaaggtcggttcacaatctcacgcgataatagcaagaacactttatacctgcagatgaatagtctacgagccgaggacacggcagtgtattactgtgccaaagatctcggggaatccgagaacgaagagtgggctaccgactattacggattttctattggctatccaggccaggatccgcgtggggttgtgggaatcttcgacatttgggcacaaggtacaatggtcactgtgagctcc

SEQ ID NO: 25238 - RNA, 432 nt, synthetic construct
  misc_feature 1..432: note = derived and/or modified sequence opt3 from anti-HIV_cap256-038-102308_VR-Chain
  source 1..432: mol_type = other RNA
caggtgcaactggtcgagagcggcgggggagttgtgcagcccggtggctccctcagactttcttgcgccgctctggacttccctttttcaagtttcgggatgcactgggtaaggcagaccccaggacggggcttggaatgggtggcaatcatttggagcgatggttccaaccgctactatgtcgactctgtgaaggggcgatttacaatatcgcgtgataattcaaagaacactttatacctgcagatgaatagcctaagaccggacgatacggccgtttattactgtgtgaaagacctcggagagagtgaaaacgaggaatgggcgaccgattattacgacttctccgtcggctatcccggccaagggcctaggggagtggtaggtatctttgatatttggggccaggggacaatggttactgtgtctagc

SEQ ID NO: 25239 - RNA, 432 nt, synthetic construct
  misc_feature 1..432: note = derived and/or modified sequence opt3 from anti-HIV_cap256-038-091115_VR-Chain
  source 1..432: mol_type = other RNA
caggtgcaactggtcgagagcggcgggggagttgtgcagcccggtagatccctcaggctttcttgcgccgtatcaggcttcacctttagtagctacgggctgcactgggtgcggcaggctcctggaaagggcttggaatgggtcgcagtgatctcctatgacggttctaacaaatactatgccgattcggttaaggggcgcttcacaatttcacgagacaatagcaaaaacactttatacctgcagataaatagtctacgtgcggaggatacggctgtgtattactgtgccaaggacctcggagaatccgagaacgaagagtgggcaaccgattattacgacttttctatcggctacccaggccaagatccgagagccgtcgtgggggctttcgacatttggggacagggtacaatggtaactgttagctcc

SEQ ID NO: 25240 - RNA, 432 nt, synthetic construct
  misc_feature 1..432: note = derived and/or modified sequence opt3 from anti-HIV_cap256-038-090262_VR-Chain
  source 1..432: mol_type = other RNA
caggtgcaactggtcgagagcggcgggggagttgtgcaggccggtggctccctcagactttcttgcgctgcatcagggttcacctttaacaattacggaatgcactgggtaaggcaggcccccggcaagggtctggaatgggcggctttcatccggtatgacgggagtaacaaatactatgccgatagcgtgcgcggacgatttacaatttcccgtgacaattctaagaacactttgtacttacagatgaactcgctgagagcagaggatacggccgtctattactgtgtgaaagacgttggcgaatcagagaatgaagagtgggctagcgattattacgacttcggcagggattaccctgggcaagacacccgggcagtggtcggagcctttgatatatggggtcagggcacaatggtgactgtaagttcc

SEQ ID NO: 25241 - RNA, 432 nt, synthetic construct
  misc_feature 1..432: note = derived and/or modified sequence opt3 from anti-HIV_cap256-038-083260_VR-Chain
  source 1..432: mol_type = other RNA
caggtgcaactggtcgagagcggcgggggactcgttaagcccggtggctcccttagactgtcttgcgccgcttcagggttcacctttagtgactactatatgacatggatcaggcaggcacctggaaaaggcttggaatgggtggccgtaattagctacgatggtgggaacaagtattacgcggactccgtgaaaggacggttcactatatctcgcgataattcgaagaacacgttatatctgcagatgaactcactacgagctgaggacaccgccctctactattgtgcaaaagatctgggcgaaagcgagaatgaagagtgggccagtgactactacgattttggccgtgactatccagggcaggattccagaggagtcgtgggtacattcgacgtttggggccaagggactatggtgaccgtctctagc

SEQ ID NO: 25242 - RNA, 432 nt, synthetic construct
  misc_feature 1..432: note = derived and/or modified sequence opt3 from anti-HIV_cap256-038-080981_VR-Chain
  source 1..432: mol_type = other RNA
caggtgcaactggtcgagagcggcgggggagttgtgcagcccggtagatccctcaggctttcttgcgccgcttcaggcttcacctttagtagctacgggatgcactgggtacggcaggcacctggaaagggcatggaatgggtggccgtcatctcctatgacggttctaacaaatactatgcggattcggtgaaggggcgcttcacaatttcacgagacaatagcaaaaacactctgtacttgcagatgaatagtttacgtgctgttgatacggccgtgtattactgtgcaaaggacctgggagagggcgaaaacgaggaatgggccaccgattattacgacttttccataggctacccagggcaagatccgagaggagtcgtgggtgctttcgacatctggggccaggggacaatggtaactgtttctagc

SEQ ID NO: 25243 - RNA, 432 nt, synthetic construct
  misc_feature 1..432: note = derived and/or modified sequence opt3 from anti-HIV_cap256-038-080873_VR-Chain
  source 1..432: mol_type = other RNA
ctggtgcagctcgtcgagagcggcgggggagttgtgcaacccggtggctcccttagactgtcttgcgccgcttcagggttcaggtttagtagctacggaatgcactgggtacggcaggcacctggcaagggtttggaatgggtggccttcatccgctatgacgggtcctttaaagattacgcggactctgtccgaggacgtttcaccatttcgagagataactcaaagaatacagtgtatttacagatgaacagcctgagggctgaggacactgccgtttactattgtgtgaaagatctaggcgaaagtgagaaggaagagtggccatccgactactatgattttggccgggactacccggggcaggattctcgcggagtcgtgggtgtattcgacatatggggccaagggacgatggttaccgtgagctcc

SEQ ID NO: 25244 - RNA, 432 nt, synthetic construct
  misc_feature 1..432: note = derived and/or modified sequence opt3 from anti-HIV_cap256-038-074413_VR-Chain
  source 1..432: mol_type = other RNA
caggtgcaactggtcgagagcggcgggggagttgtgcagcccggtggctccctcagactttcttgcgccgcttcagggttcacctttagtacatacggaatgcactgggtaaggcagcctccaggcaagggtctggaatgggtggcattcatccggtatgacgggagcaacacttactatgccgattccgtcaaaggacgctttacgatttctcgagacaattcgaagaacaccttgtacttacagatgaactcactgcgtgcggaggatacagctgtgtattactgtgccaaagacctaggcgaaagcgagaatgaagagtgggcaagtgattattacgacttcggcagagattacccggggcaagaccccaggggagttgtgggtgtctttgatatatggggccaggggactatggtgaccgtatcctct

SEQ ID NO: 25245 - RNA, 432 nt, synthetic construct
  misc_feature 1..432: note = derived and/or modified sequence opt3 from anti-HIV_cap256-038-073153_VR-Chain
  source 1..432: mol_type = other RNA
caggtgcaactggtcgagagcggcgggggagttgtgcagcccggtaggtccctcaggctttcttgcgccgcttcaggcttcacctttagtagctacgggatgcactgggtacggcaggcacctggaaagggcctggaatgggtggccttgatctcctatgacggtacaaacaaatactatgcggattctgtcaaggggcgcttcactatttcgcgagacaattcaaagaacacgttatttctgcagatgaatagcctacgtgctgaggataccgccctctactattgtgcaaaagacctgggagaaagtgagaacgaagagtgggcctccgattactatgacttcggcagagattacccaggccaagacccgagaggggtggttggaacatttgatatatggggtcagggcactatggtgaccgtctctagc

SEQ ID NO: 25246 - RNA, 432 nt, synthetic construct
  misc_feature 1..432: note = derived and/or modified sequence opt3 from anti-HIV_cap256-038-064227_VR-Chain
  source 1..432: mol_type = other RNA
gaggtgcaggtcgttgaaagcggcgggggactggtgcaacccggtggctccctcagactttcttgcgccgcttcagggttcacctttagtaactactggatgagctgggtaaggcaggcacctggaaagggcctggagtgggtggccgtcatgtccttctctggttcggggtcatattacgcggacagcgtgaaaggacggtttacaatcagttccgatgactctatgaatactgtttatttgcagatgaacagcttacgcgctgaagatacggccgtgtactattgtgcaaaggacctgggcgagcgagaaaatgaggagtgggcctccgattactatgacttcggccgtgattacccagggcaggacccgagaggagtcgtgggttcaattgatacctggggccacgggacaatggtaactgttagtagc

SEQ ID NO: 25247 - RNA, 432 nt, synthetic construct
  misc_feature 1..432: note = derived and/or modified sequence opt3 from anti-HIV_cap256-038-061640_VR-Chain
  source 1..432: mol_type = other RNA
caggtgcaactggtcgagagcggcgggggagttgtgcagcccggtagatccctcaggctttcttgcaccgcctcacggttcagttttaacaattacgctatgcactgggtacgccaggcacctggcaaggggctggaatgggtggccatcattagcaaagacggatccgataactcttatgtcgactcggtgaagggccgattcacaatatcacgtgataatagcaaaaacactttgtacttacagatgaatagtctgagagcggaggacacggctgtttattactgtgccagggatctaggtgaatccgagaacgaagagtggccatctgactattacgattttgggcgggactatccgggacaagatccccgcggcgtgatcggcaccttcgacgtctgggggcagggaacaatggtgactgtaagctcc

SEQ ID NO: 25248 - RNA, 414 nt, synthetic construct
  misc_feature 1..414: note = derived and/or modified sequence opt3 from anti-HIV_cap256-038-059482_VR-Chain
  source 1..414: mol_type = other RNA
agaggcgtgcagtgccaagtccagctggttgagagcgggggaggtgtggtacagcccggcttcaccttttcctcttacgtgatgcactgggtcaggcaggcccctgggaagggactcgaatgggtggctgacatctcatatgatggcagtaataaatactatgcagacagcgttaagggtcggcttacaatttcccgcgataattctaaaaacactctgtacttgcaaatgaactcgttacgagccgaggacacggcggtgtattactgtgtcaaggatctgggggaatcagagaaagaagagtggccaagcgactattacgatttcgctaccggatacccggtgcaggacccccgtgccgtagttggcgcatttgatatatggggccaggggacaatggtgactgtcagtcct

SEQ ID NO: 25249 - RNA, 432 nt, synthetic construct
  misc_feature 1..432: note = derived and/or modified sequence opt3 from anti-HIV_cap256-038-054000_VR-Chain
  source 1..432: mol_type = other RNA
gaggtgcagctggtcgaaagcggcgggtccgttgtgagacccggaggttctctcaggctttcatgcgccgctagtggcttcacctttgacgatagcgggatgtcctgggtacggcaaggacctggcaagggtctggagtgggtggcagtcatctcttacgacgggggaaacaaatattacgccgattcggtgaagggccgcttcacaatttcacgagacaatagcaaaaacactttgtatttacagatgaatagtctgcgtgcggaagatacggctctatactattgtgccaaggacctcggcgagtccgaaaacgaggagtgggcatctgattactatgactttgggagagattacccaggacaggacagcaggggtgttgtgggcaccttcgatgtctgggggcagggaacaatggtgactgtatcctca

SEQ ID NO: 25250 - RNA, 432 nt, synthetic construct
  misc_feature 1..432: note = derived and/or modified sequence opt3 from anti-HIV_cap256-038-050554_VR-Chain
  source 1..432: mol_type = other RNA
gaggtgcagctgctcgaaagcggcggggaccttgtccaatccggaggttctctgagattgtcatgcgttgccagtggcttcacctttagcacacacgctatgacttgggtgaggcaggcacccgggaagggattagagtgggtagccgtgatctcctctgatggctcgaacaaaaatttcgcggactcagtcaagggtcggtttacgattagccgcgataacagtaaaaataccctgtacctacagatgaactccctccgacctgaagacacagctgtgtattactgtgccaaggatctgggggagtctgaaaatgaggagtgggcaactgactattacgatttcagcaccggatatccagttcaggacccgcgtgccgtggtcggcgcttttgatatatggggccaagggacaatggtgaccgtatcctca

SEQ ID NO: 25251 - RNA, 432 nt, synthetic construct
  misc_feature 1..432: note = derived and/or modified sequence opt3 from anti-HIV_cap256-038-044256_VR-Chain
  source 1..432: mol_type = other RNA
caggtgcaactggtcgagagcggcgggggagttgtgcagcccggtaggtccctcaggctttcttgcgccgcttcaggcttcacctttagtagctacgcaatgcactgggtacggcaggcccctgggaagggactggaatgggtggcggtcatctcctatgacggctctaacaaataccatgctggttcggtgaaggggcgcttcattatatcacgagataatagcaaaaacacattgtatttacagatgaatagtctgcgtgccgaggacactgcactatactattgtgccaaggatctcggagaatccgagaacgaagagtgggcttctgactactatgattttggcagagactacccaggccaagatccgagaggggttgtgggaacgttcgacatctggggtcagggcaccatggtcacagtgagctcc

SEQ ID NO: 25252 - RNA, 432 nt, synthetic construct
  misc_feature 1..432: note = derived and/or modified sequence opt3 from anti-HIV_cap256-038-040944_VR-Chain
  source 1..432: mol_type = other RNA
caggtgcaactggtcgagagcggcgggggagttgtgcagcccggtagatccctcaggctttcttgcgccgcttcaggcttcacctttagtaactacgcaatggactgggtacggcaggcccctgggaagggactggaatgggtggcggtcatcagctatgatggctccaataaatactatgctgactctgtgaagggtcgcttcacaatttcgcgagataacagcaaaaatactttgtacttacagatgaactcactgcgtgccgaggacacggcagtttattactgtgccaaggatctaggggaaagtgagaatgaagagtgggctaccgactattacgatttttccacaggatacccaggccaagacccgagagcagtggtcggcgccttcgatatatgggggcagggaactatggtgaccgtatctagc

SEQ ID NO: 25253 - RNA, 432 nt, synthetic construct
  misc_feature 1..432: note = derived and/or modified sequence opt3 from anti-HIV_cap256-038-040090_VR-Chain
  source 1..432: mol_type = other RNA
caggtgcaactggtcgagagcggcgggggagttgtgcagcccggtagatccctcaggctttcttgcgccgcttcaggcttcagttttagcaactacgcaatggactgggtacggcaggcccctgggaagggactggaatgggtggcggtcatctcctctgatggctcgaataaaaactatgctgactcagtgaagggtcgcttcaccattagccgagataatagtaaaaacacattgtacttacagatggactccctgcgtgccgatgacactgcagtttattactgtgccaaggatctaggggagtctgaaaatgaggaatgggctacggactattacgattttagcataggatatccagtgcaagacccgagaggcgtcgtgggcatcttcgatatttgggggcagggaaccatggtaacagtttcctca

SEQ ID NO: 25254 - RNA, 432 nt, synthetic construct
  misc_feature 1..432: note = derived and/or modified sequence opt3 from anti-HIV_cap256-038-032874_VR-Chain
  source 1..432: mol_type = other RNA
caggtgcaactggtcgagagcggcgggggagttgtgcagcccggtggctccctcagactttcttgcgccgcttcagggttcacctttagtagctacggaatgcactgggtaaggcaggcacctggcaagggtctggaatgggtggccttcatccggtatgacgggaacaataaatactatgcggattccgtcaagggacgctttacaatttctcgagagaactcgaaaaatactttgtacttacagatgaactcactgcgtgctgaagacacggccgtgtatcattgtgcaaaggatctaggcgagagcgaaaaagaggagtgggccagtgactactatgatttcggcagagactacccagggcaagatccgaggggagttgtgggtacctttgacatatggggccacgggacaatggtcactgtgtcctct

SEQ ID NO: 25255 - RNA, 432 nt, synthetic construct
  misc_feature 1..432: note = derived and/or modified sequence opt3 from anti-HIV_cap256-038-025899_VR-Chain
  source 1..432: mol_type = other RNA
caggtgcaactggtcgagagcggcgggggagttgtgcagcccggtagatccctcaggctttcttgcgtagcctcaggcttcacctttagtaactacgctatgtattgggtgcggcaggcacctgggaagggactggaatgggtcacaatcattagcttcgacggctccaatcagtactatgccgattctgtgaaaggtcgctttactatatcgcgagagaactcaaagaatacgttgtacttacaaatgaacagcctgcgtgcggaagacaccgctgtttattactgtgccaaagatctaggggagagagaaaatgaggagtgggcaagtgactattacgatttcggaagggactacccaggccaggatccgcggggcgtggtcgggtccatcgacacatggggacacggtactatggtgaccgtatctagc

SEQ ID NO: 25256 - RNA, 432 nt, synthetic construct
  misc_feature 1..432: note = derived and/or modified sequence opt3 from anti-HIV_cap256-038-024581_VR-Chain
  source 1..432: mol_type = other RNA
cacatccagctggtggagagcggcgggggagtcgttcaacccggtggctccctcagactttcttgcgccgcttcagggttcccttttagtagcttcggaatgcattgggtgaggcagaccccaggccggggtctggaatgggtagcaattatatggtccgacgggtctcacaaggagtacacagattcggtgaaaggacgctttactatctcacgagacaacagccgtagtacgatggatttgcagatgaataacttaagaccggaagacaccgccgtctattactgtgcgaaggatctgggcgagagggaaaatgaggagtgggcttccgactattacgatttcggccgggactatcccgggcaggatcctcgcggagtggttggttctattgacacatggggccatgggactatggtgaccgtcagctcc

SEQ ID NO: 25257 - RNA, 432 nt, synthetic construct
  misc_feature 1..432: note = derived and/or modified sequence opt3 from anti-HIV_cap256-038-013345_VR-Chain
  source 1..432: mol_type = other RNA
caggtgcaactggtcgagagcggcgggggagttgtgcagcccggtcggtccctcaggctttcttgcgccgtatcaggcttcacctttagtagctacgggatgcactgggtgcggcaggctcctggaaagggcctggaatgggtcgcagccatctcctatgacggttctaacaaatactatgtggattcggttaaggggcgcttcacaatttcacgagacaatagcaaaaacactttgtacttacagatgaatagtctgcgtgcggaggatacggctgtgtattactgtgccagagacctaggagaaagggagatagaagagtgggcaaccgattattacgacttttccatcggctacccaggccaagatccgagaggggtcgtgggagtattcgacatttggggtcagggcacaatggttactgtgtctagc

SEQ ID NO: 25258 - RNA, 438 nt, synthetic construct
  misc_feature 1..438: note = derived and/or modified sequence opt3 from anti-HIV_cap256-038-011559_VR-Chain
  source 1..438: mol_type = other RNA
caggtgcaactggtcgagagcggcgggggagttgtgcagcccggtcggtccctcaggctttcttgcgaagcctcaggcttcacctttagtagctacgggatggactgggtacggcaggctcctggaaagggcctggagtgggtggcattgatctcccacgatggttctaacaaacattatgccgactcggtcaaggggcgcttcacaatttcacgagataatagccgtaacactttatacctgcagatgaatagtctaagagcggaagacacggctctctattactgtgccaaagatctgggagagtccgaaaacgaggacgaggaatgggcatctgattattacgactttggcagggattatccaggccaagacagcagaggggtggttggaaccttcgatatgtggggtcagggcacaatggtgactgtctcctca

SEQ ID NO: 25259 - RNA, 432 nt, synthetic construct
  misc_feature 1..432: note = derived and/or modified sequence opt3 from anti-HIV_cap256-038-009634_VR-Chain
  source 1..432: mol_type = other RNA
caggtgcaactggtcgagagcggcgggggagttgtgcagcccggtaggtccctcaggctttcttgcgccgcttcaggcttcacctttacaagtttcgggatgcactgggtacggcaggcacctggaaagggcctggaatgggtggccgtcatcagctacgacggtaacaataaatattacgcggattccgtgaaggggcgctttactatttctcgagagaactcgaaaaatacgttgtatttacagatgaactcactgcgtgctgaagacaccgccgtttaccattgtgcaaaggatctaggagagagcgaaatagaggagtggacaagtgactattacgatttcggcagagactatccaggccaagatccgagaggggtgtttggaactttcgacatctggggtcacggcaccatggtcacagtgtcctct

SEQ ID NO: 25260 - RNA, 432 nt, synthetic construct
  misc_feature 1..432: note = derived and/or modified sequence opt3 from anti-HIV_cap256-038-006730_VR-Chain
  source 1..432: mol_type = other RNA
caggtgcaactggtcgagagcggcgggggagttgtgcagcccggtcggtccctcaggctttcttgcgccgcttcaggcttcacctttagtagcttcgggatgcactgggtacggcaggcacctggaaagggcctggaatgggtggccgtcatctccaaagacggttctgataactcgtacgtggactcagttaaggggcgctttacaattagccgagataatagtaaaaacactttgtatttacagatgaactccctgcgtgcggaggacacggctgtgtactattgtgccagagatctaggagaatctgagaatgaagagtggccaagcgactactatgatttcggcagggactacccgggccaagatcccagaggggtcataggaacctttgacgtgtggggtcagggcacaatggtaactgtttcctca

SEQ ID NO: 25261 - RNA, 432 nt, synthetic construct
  misc_feature 1..432: note = derived and/or modified sequence opt3 from anti-HIV_cap256-038-004887_VR-Chain
  source 1..432: mol_type = other RNA
caggtgcaactggtcgagagcggcgggggagttgtgcagcccggtagatccctcaggctttcttgcgccgcttcaggcttcagttttagcacctccgggatgcactgggtacggcaggcacctggaaagggcatggaatgggtggccgtcatctcttacgacggttcgaacaaatattacgcggattcagtgaaggggcgcttcacaattagccgagacaatagtaaaaacactctgtatttgcagatgaactccttacgtgctgttgatacggccgtgtactattgtgcaaaggacctgggagagggcgaaaatgaggaatgggccaccgattactatgacttttctataggctacccagtccaaaatccgagagggctagtgggagctttcgatatctggggtcagggcacaatggtaactgttagctcc

SEQ ID NO: 25262 - RNA, 432 nt, synthetic construct
  misc_feature 1..432: note = derived and/or modified sequence opt3 from anti-HIV_cap256-038-004840_VR-Chain
  source 1..432: mol_type = other RNA
caggtgcaactggtcgagagcggcgggggagttgtgcagcccggtaggtccctcaggctttcttgcgccgcttcaggcttcacctttagtagcttcgggatgcactgggtacggcagtcccctggaaagggcctggaatgggtggcagtcatctcttacgacggtaacaataaatattacgccgattcggtgaaggggcgctttacaatttcacgagagaacagcaaaaatactttgtatttacagatgaacagtctgcgtacggacgataccgcggtttactattgtgctaaggacctaggagaatccgagacagaagagtggccatctgattactatgacttcggcagagattacccgggccaagaccccagaggggtggtcggaacttttgatatatggggtcatggcaccatggtgacagtaagctcc

SEQ ID NO: 25263 - RNA, 432 nt, synthetic construct
  misc_feature 1..432: note = derived and/or modified sequence opt3 from anti-HIV_cap256-038-002181_VR-Chain
  source 1..432: mol_type = other RNA
gaggtgcagctggtcgaaagcggcgggggactcgttcaacccggtagatcccttaggctgtcttgcgccgcttcaggcttcacctttgaggactacgcaatgcactgggtgcggcaggcccctgggaagggattggaatgggtagcggtgatcagttatgatggcagcaacaaatactatgtcgactccgtgaagggtcgcttcacaatttctcgagataattcgaaaaacactttatacctgcagatgaactcactacgtgctgaggacacggccgtttattactgtgcaaaggatctcggggaaagcgagaatgaggaatgggccaccgactattacgattttagtataggatacccaggccaggacccgagaggcgtggtcgggatcttcgatatttggggacaaggtacaatggtgactgtatcctct

SEQ ID NO: 25264 - RNA, 432 nt, synthetic construct
  misc_feature 1..432: note = derived and/or modified sequence opt3 from anti-HIV_cap256-038-001902_VR-Chain
  source 1..432: mol_type = other RNA
caggtgcaactggtcgagagcggcgggggagttgtgcagcccggtaggtccctcaggctttcttgcgccgcttcaggcttcacctttagtagcttcgggatgcactgggtacggcaggcacctggaaagggcctggaatgggtggccgtcatctcctacgacggtaacaataaatattacgcggattctgtgaaggggcgctttacaatttcgcgagagaactcagaaaatactttgtatttacagatgaacagcctgcgtgctgacgatacggccgtttactattgtgcaaaagacctaggagagagtgaaaatgaggagtgggcctccgattactatgacttcggcagagattacccaggccaagacaccagaggggtggtcggaacatttgatatatggggtcatggcactatggtgaccgtatctagc

SEQ ID NO: 25265 - RNA, 432 nt, synthetic construct
  misc_feature 1..432: note = derived and/or modified sequence opt3 from anti-HIV_cap256-038-000976_VR-Chain
  source 1..432: mol_type = other RNA
caggtgcaactggtcgagagcggcgggggagttgtgcagcccggtagatccctcaggctttcttgcgccgcttcaggcttcacctttagtagcttcgggatgcactgggtacggcaggcacctggaaagggcctggaatgggtggccgtcatctccgacgatggtaacaataaatactatgcggactctgtgaaggggcgctttacaatttcgcgagataacagcaaaaatactttgtacttacagatgaactcactgcgtgttgaggacacggctgtgtattactgtgtcaaggatgtgggagaaagtgagaatgaagagtgggcctccgactattacgatttcggcagagactatccaggccaagataccagggcagtagttggggcctttgacatatggggacagggtacaatggtgactgtctctagc

SEQ ID NO: 25266 - RNA, 432 nt, synthetic construct
  misc_feature 1..432: note = derived and/or modified sequence opt3 from anti-HIV_cap256-038-000384_VR-Chain
  source 1..432: mol_type = other RNA
caggtgcaactggtcgagagcggcgggggagttgtgcagcccggtaagtccctcagactttcttgcgccgcttcaggcttcacctttagtagctacgtaatgcactgggtgaggcaggcacctgggaaaggactggaatgggtcgccgacatctcctatgatggctctaacaagtactatgcggactcggtgaaaggtcggttgacaatttcacgcgataatagcaagaacactttatacctgcagatgaatagtctacgagctgaggacacggccgtttattactgtgtgaaagatctcggggaatccgagaaggaagagtggccatctgactattacgatttcggacgtgactacccgggccaagatagcagaggcgtcgtgggggtatttgacatatggggacagggtaccatggttacagtgtcctca

SEQ ID NO: 25267 - RNA, 321 nt, synthetic construct
  misc_feature 1..321: note = derived and/or modified sequence opt3 from anti-HIV_206-314431_VR-Chain
  source 1..321: mol_type = other RNA
cagttcgtgctgacccaaccccctagcgtctccgccgctccaggccagaacgttacaatctcttgctcagggccgcccagtcacattgagaagaatgacgtgagctggtaccagagactccctggaatggcaccaaaaatggtaatatatgaatccaggcggcgcccccttggtatccctgtgcgatttactgcctctcgttcgggctcaagcgcgacgctggtcattaccgggttgcagacagctgatgaggccgactactattgtggaacttgggatggcagaatgaacttcggtaccgggacaaccgtgactgtttta

SEQ ID NO: 25268 - RNA, 321 nt, synthetic construct
  misc_feature 1..321: note = derived and/or modified sequence opt3 from anti-HIV_206-247594_VR-Chain
  source 1..321: mol_type = other RNA
cagagcatcctgacccaacccccttccgtgtctgccgctccaggccagaacgtcacaatttcatgcagtgggccgcccagccacatagagaagaatgacgtttcctggtaccagagattccctggaatggcaccaaaaatgatcatttatgaatctaagaggcggccctttggtgtgcctggccgcttctcggcctcacgaagcgggaaaagtgcgactctcgctatcacgggacttcagaccggcgatgaggccgactactattgtggtacatgggatgggcgtatgaactttggaactggcaccacagtaaccgtgctg

SEQ ID NO: 25269 - RNA, 321 nt, synthetic construct
  misc_feature 1..321: note = derived and/or modified sequence opt3 from anti-HIV_206-116890_VR-Chain
  source 1..321: mol_type = other RNA
cagagcgtgctgacccaacccccttccgtctctgccgctccaggccagaacgttacaatctcatgcagtgggccgcccagccacattgagaagaatgacgtgtcctggtaccagcatctccctggagaagcaccaaaaatgataatctatgagtcttggagaaggcccgccggtattcctgcgcggttctcggcttcacgcagcggcaagagtgggactcttgccatcacgggactgcagaccggcgatgaagcagactactattgtggtacatggaacgggcgaatgaattttggaactggcaccacagtaaccgtgttg

SEQ ID NO: 25270 - RNA, 333 nt, synthetic construct
  misc_feature 1..333: note = derived and/or modified sequence opt3 from anti-HIV_206-072383_VR-Chain
  source 1..333: mol_type = other RNA
cagagcgtgctgacccaacccccttccgtctctgccgctccaggccagagagttatcatttcatgcagtgggaacaatagcacaataggaaacaatttcgtgtcctggtaccagcaggtaccgggtactgcacccaagctccttatctatgagacgaacaggcggccttctggcattccagaccgcttttcggggtcaaaaagcggaaccagtgccacactggcgatctccggcttgcaaactggtgatgaagctgacttctactgtaccgtgtggggagtccgaaagggggtggccgcagtttttggcacaggcacccgtttaactgtgctg

SEQ ID NO: 25271 - RNA, 333 nt, synthetic construct
  misc_feature 1..333: note = derived and/or modified sequence opt3 from anti-HIV_206-037527_VR-Chain
  source 1..333: mol_type = other RNA
cagagcgtgctgacccaacccccttccgtctctgccgctccaggccagaaggttatcatttcatgcagtgggaacaatagcacaataggaaaaatcctcgtgtcctggtaccagcaggtaccgggtactgcacccaaacttgtgatttatgagacgaacagaaggccttctggcatcccagaccggttctcggggtcaaagagcggaaccagtgccacactggcgattactggcttgcaaaccggtgatgaagctgactacttttgtaaggtctggggagtgcgcaaaggggttgccgcagtgttcggcacaggcaccaaggtcactgtgtta

SEQ ID NO: 25272 - RNA, 333 nt, synthetic construct
  misc_feature 1..333: note = derived and/or modified sequence opt3 from anti-HIV_206-009095_VR-Chain
  source 1..333: mol_type = other RNA
cagagcgtgctgacccaacccccttccgtctctgccgctccagcacagagagttatcatttcatgcagtggcgacaacagcacaatagggaataacttcgtgtcctggtaccagcaggtaccgggagccgcgcccaagctccttatctatgagactaataggcggccttctggtattccagatcgcttttcgggctcaaaaagcgggacgaccgctacactggccatcagtggattgcaaactggcgacgaagcagattaccactgtaccgtgtggggtgtccgaaagggggtggccgctgttttcggaacaggcaccaaagtgactgtctta

SEQ ID NO: 25273 - RNA, 321 nt, synthetic construct
  misc_feature 1..321: note = derived and/or modified sequence opt3 from anti-HIV_176-503620_VR-Chain
  source 1..321: mol_type = other RNA
cagagcgtgctgacccaacccccttccgtctctacagccccaggccagactgttacggtgtcatgcagtgggggaaccagcaacacaggtaataacttcgtatcctggtaccagcacctcccgggcactgctcccaaacttctgatctatgagaataacaagagacctttgggggtgccagacaggttttctggagcaaagtcgggcacctcagccacattagcgctgaccggtctacagactggggatgaaggagactactattgtgctacatggagcggcagtctcaatattggcaccgggacgaaagtctccgtgctg

SEQ ID NO: 25274 - RNA, 321 nt, synthetic construct
  misc_feature 1..321: note = derived and/or modified sequence opt3 from anti-HIV_176-478726_VR-Chain
  source 1..321: mol_type = other RNA
cagagcgtgctgacccaacccccttccgtctctgccgctccaggccagaacgttaatatctcatgcagtgggccgcccagccacattgagagaaacgacgtgtcctggtaccagcatctccctggagcagccccaaagatgataatctatgaatcttggaggcggcccgcgggtattcctgatcgcttctcggcttcacgaagcggcgccagtgcaacacttgccatcactgggctgcagacgggagacgaggctgattactattgtggcacctggaatggtcgtatgaactttgggacaggaactaccgtaacagtgttg

SEQ ID NO: 25275 - RNA, 321 nt, synthetic construct
  misc_feature 1..321: note = derived and/or modified sequence opt3 from anti-HIV_176-245056_VR-Chain
  source 1..321: mol_type = other RNA
cagagcgtgctgacccaacccccttccgtctctgccgctccaggccagaacgttacaatctcatgcagtgggccgcccagccacattgagaagaatggagtgtcctggtaccagcagttccctggtatggcaccaaaaatggtaatatatgaatctaagagaaggccctttggcgtgcctgcccggttctcggcgtcacgcagcgggaaaagtgctactctcgccatcacgggacttcaaaccggcgacgaggcagattactattgtggtacatgggacgggcgaatgaactttggaactggcaccacagtcaccgtgctg

SEQ ID NO: 25276 - RNA, 321 nt, synthetic construct
  misc_feature 1..321: note = derived and/or modified sequence opt3 from anti-HIV_176-164413_VR-Chain
  source 1..321: mol_type = other RNA
cagagcgtgctgacccaacccccttccgtctctgccgctccaggccagaaggttacaatctcatgcagtgggggaactagcaacattggtaataactacgtgtcctggtatcagagactcccgggcacggcacccaaacttctgatatacgagaataacaagaggccttctgggatcccagaccggttctcgggacccaaatcaggcaccagcgccacattggcgattactggtttacagcctggggatgaagctgactattactgtgccacctggagtggatccctgaattttggcacaggcaccaaggtaactgtgcta

SEQ ID NO: 25277 - RNA, 333 nt, synthetic construct
  misc_feature 1..333: note = derived and/or modified sequence opt3 from anti-HIV_176-094308_VR-Chain
  source 1..333: mol_type = other RNA
cagagcgtgctgacccaacccccttccgtctctgccgctccaggccagaaggttatcatttcatgcagtgggaacaatagcacaataggaaacaatttcgtgtcctggtaccagcaggtaccgggtactgcacccaaactccttgtgtatgagacgtacagaaggccttctggcatcccagaccggtcgtcagggagcaagagtggaaccacagccactcaagcgatttccggcctgcagaccggtgatgaagctgactatcactgtacagtctggggagtgcgcaaaggggttgccgcagtgtttggcaccggcactaaggtcacagtgttg

SEQ ID NO: 25278 - RNA, 333 nt, synthetic construct
  misc_feature 1..333: note = derived and/or modified sequence opt3 from anti-HIV_176-065321_VR-Chain
  source 1..333: mol_type = other RNA
cagagcgtgctgacccaacccccttccgtctctgccgctccaggcagaagggttatcatttcatgcagtgggaacaatagcacaataggaaacaatttcgtgtcctggtaccagcaggtaccgggtactgcacccaagctccttgtgtatgagacgaaccggcgcccttctggcatcccagaccgattttcggggtcaaaaagcggaaccagtgccacactggcgatttccggcttgcagactggtgatgaagctgactactattgtaccgtctggggagtgcgtaagggggttgccgcagtgttcggcacaggcaccaaagtcactgtgtta

SEQ ID NO: 25279 - RNA, 324 nt, synthetic construct
  misc_feature 1..324: note = derived and/or modified sequence opt3 from anti-HIV_119-099719_VR-Chain
  source 1..324: mol_type = other RNA
cagagcgtgctgacccaacccccttccgtctctgccgctccaggccagaaggttacaatctcatgcagtgggagcaactcctacattggaaataaatatatatcttggtaccagcagttcccgggtactgcacccaagctccttatctatgagaacaataaaagaccttcgggcgtgccagacaggttttcagccagcaagagtgcgacgtccgctaccctggccattacagggttgcacactggagatgaagcagactactattgtgagacctgcgatggctctggtggggtattcggaacaggcaccaaagtgactgtctta

SEQ ID NO: 25280 - RNA, 327 nt, synthetic construct
  misc_feature 1..327: note = derived and/or modified sequence opt3 from anti-HIV_119-099536_VR-Chain
  source 1..327: mol_type = other RNA
gagctgacccagccccctagcgtgtccgccgcttctggccaaaacgtcaatatctcatgcagtgggggaagctccaacattggttctaattacgtttcgtggtatcagcagttcccaggcacagcaccgaagctccttatatacgaaactaacaaaagaccctcagggatccctgacaggtttagcggaagtaagtccggcgcctctgcgacgctggctattaccggtttgcagacaggggatgaggccgactattactgtgcaacttgggccgatagcttaaattccgctcgggtgttcggaaccggcacaaaagtaaccgtgctg

SEQ ID NO: 25281 - RNA, 333 nt, synthetic construct
  misc_feature 1..333: note = derived and/or modified sequence opt3 from anti-HIV_119-098907_VR-Chain
  source 1..333: mol_type = other RNA
cagagcgtgctgacccaacccccttccgtctctgccacaccaggccagaaggttactatctcatgcagtgggagcaactccaatattggagacaaatacgtgtcttggtatcagcacttcccgggtacggctcccaagctccttgtatacgagacctatagaaggccttcgggcataccagatcggttttcagggagcaaaagtggaacatccgcaactctggccatcaccggcttgcagacaggtgacgaagcggattactattgtaccatttggggagtgcgcaagggggtcggcgctgtgttcggcactgggacaaaagttatcgtgtta

SEQ ID NO: 25282 - RNA, 324 nt, synthetic construct
  misc_feature 1..324: note = derived and/or modified sequence opt3 from anti-HIV_119-098555_VR-Chain
  source 1..324: mol_type = other RNA
cagagcgtgctgacccaacccccttccgtctctgccgctccaggccagaacgttacaatctcatgcagtgggagcgcatccaatattggaaagaacttcgtgtcttggtaccagcagctcccgggtactgcccccaaacttctgatatatggctcgaataacagaccttcaggggtaccagacaggtttagcggaagtaagtccggcacgtctgcgagcttggctatcaccggtttacaaacaggggatgaggccgactactattgtgaaacttgggatggatccggcgcagtgttcggcaccgggacaaaagtcaccgtgctg

SEQ ID NO: 25283 - RNA, 324 nt, synthetic construct
  misc_feature 1..324: note = derived and/or modified sequence opt3 from anti-HIV_119-097828_VR-Chain
  source 1..324: mol_type = other RNA
cagagcgtgctgacccaacccccttccgtctctgccgctccaggccagaaggttacaatctcatgcagtgggagctcctctaacattggtaaaaattacgtgtcgtggtatcagctccttccgggaactgcacccagactggtaatatacgagaacgacgaaaggccttcaggcacgccagatcggttcagcgggagtaagtccggaacctctgccacattggcgatcactggcttacacaccggtgacgaggctgattattactgtgaaacatgggacgggagcggaggcgtgtttggcaccgggactaaagtcacagtgctg

SEQ ID NO: 25284 - RNA, 324 nt, synthetic construct
  misc_feature 1..324: note = derived and/or modified sequence opt3 from anti-HIV_119-096480_VR-Chain
  source 1..324: mol_type = other RNA
cagagcgtgctgacccaacccccttccgtctctggcgccccagggcagagaatcacaatttcatgcagtggaagcacttccaacataggtcagaattacgtttcttggtatcagcaactcccgggcacggctcccaaacttctgatctcggacaacaataggcggccttcatggaccccagatcgcttcagcgggagtaagtccggaacatctgcaactttggccattaccggcttacagacaggtgacgaggcggattactattgtgaaacctgggacgggagcggaggcgtgtttggccccgggactcgagtaacagtgctg

SEQ ID NO: 25285 - RNA, 324 nt, synthetic construct
  misc_feature 1..324: note = derived and/or modified sequence opt3 from anti-HIV_119-095664_VR-Chain
  source 1..324: mol_type = other RNA
cagagcgtgctgacccaacccccttccgtctctgccgctccaggccagaaggttacaatctcatgcagtgggggagcagccaacattggtaaaaatagcgtgtcctggtaccagcagctcccgggcactgcgcccaaacttctgatatatgacaacaatagaaggccttctgggacgccagatcggttctcgggatcaaagagcggcaccagtgctacattggccatctccggtttacaaactggggacgaggcagattactattgtgaaacctggcacggatctggcggcgtatttgggacaggaaccaaggtgactgtcctg

SEQ ID NO: 25286 - RNA, 321 nt, synthetic construct
  misc_feature 1..321: note = derived and/or modified sequence opt3 from anti-HIV_119-095212_VR-Chain
  source 1..321: mol_type = other RNA
cagagcgtgctgacccaacccccttccgtctctgccgctccaggccagaaggttacaatctcatgcagtgggagcacttccaacattggaaaatctgacgtgttctggtaccagcagctcccgggtacggcacccaaacttctgatatcggagacctcaagaaggcctagcggcatcccagatcggtttagtggggccaagtccggaacatctgcgactttggctattaccggcttacaaacaggtgacgaagccgattatttctgtagcacctggtccgggtcactgaattttggaactggcacacgcgtaaccgtgcta

SEQ ID NO: 25287 - RNA, 333 nt, synthetic construct
  misc_feature 1..333: note = derived and/or modified sequence opt3 from anti-HIV_119-094773_VR-Chain
  source 1..333: mol_type = other RNA
cagagcgtgctgacccaatcccccacagtctctgccgctcctggccagactgttacgatctcatgcagtgggggaaccagcaacgtgggtaagaatttcgtatcctggtaccagcagtttccaagaacagcaccgaaactccttatttatgagaacaataagaggccctctggcatacctgaccggttctcggggtcaaaaagcggaaccagtgccactctggtgatcacaggcttgcaaaccggtgatgaagcggacttttactgtgggacttgggatggatccttacgcacaggcggcgtcattgggaccggaacgcgagtgactgttctg

SEQ ID NO: 25288 - RNA, 324 nt, synthetic construct
  misc_feature 1..324: note = derived and/or modified sequence opt3 from anti-HIV_119-094508_VR-Chain
  source 1..324: mol_type = other RNA
cagagcgtgctgacccaacccccttccgtctctgccacaccaggccagagagttactgtgtcatgcagtgggagctcctctaacatcggaaatcactacgtatcgtggtatcaacaggtgccgggtacggctcccaagctccttatttcagagaacagcaggcggcctagtggcaccccagaccgcttctccgggtctaaaagcggaacatccgcaactctggccataaccggcttgcagacaggtgatgaagcggactactattgtgagacctgggatgggtcaggaggcgtctttggcactgggacaaaggtgaccgtttta

SEQ ID NO: 25289 - RNA, 324 nt, synthetic construct
  misc_feature 1..324: note = derived and/or modified sequence opt3 from anti-HIV_119-093795_VR-Chain
  source 1..324: mol_type = other RNA
cagagcgtgctgacccaacccccttccgtctctgccgctccaggccagaaggttacaatctcatgcagtgggagctcctctaacattggaaataactacgtgtcgtggtatcagtacctcccgggtactgcacccaaacttctgatatcagagaataacagaaggcctagcggcacgccagaccggttcagtgggtccaagtctggaaccagcgccacattggcgatcactggcttacagaccggtgatgaagctgactattactgtgagacatgggatgggtccggaggcgtatttggcaccgggactaaagtgacagtcctg

SEQ ID NO: 25290 - RNA, 321 nt, synthetic construct
  misc_feature 1..321: note = derived and/or modified sequence opt3 from anti-HIV_119-093732_VR-Chain
  source 1..321: mol_type = other RNA
cagagcgtgctgacccaacccccttccgtctctgccgctgcaggccagaacgttaatatctcatgcagtgggagaaagagcaacgtgggaggtaattacgtatcctggtatcagcagttcccaggcacagccccgaaactccttatttacgaggacaacaagaggccctcttggatacctgatcggtttactgcgtcgcgctcagggacgagcgctaccctgggaatcacaggcttgcaaactggtgacgaagccgattatttctgtagtacctggtccgggtctttaaattttggaacaggcacccgagtgactgtcctg

SEQ ID NO: 25291 - RNA, 333 nt, synthetic construct
  misc_feature 1..333: note = derived and/or modified sequence opt3 from anti-HIV_119-092903_VR-Chain
  source 1..333: mol_type = other RNA
cagagcgtgctgacccaacccccttccgtctctgccgctccaagacagaaggttacaatctcatgcagtggcagctcctctaacattgggaatcactacgtgtcgtggtatcagcagctcccgggaactgcacccaaacttctgatatacgagaacaataagaggccttcaggtatcccagaccggttcagcggcagtaaatccgggacgtctgccaccttggcgattacaggattacaaactggcgatgaagctgactattactgtgccacctgggcaccccgcctgaacagcgcccgagtatttggtaatgggacaatggtgaccgtccta

SEQ ID NO: 25292 - RNA, 333 nt, synthetic construct
  misc_feature 1..333: note = derived and/or modified sequence opt3 from anti-HIV_119-092284_VR-Chain
  source 1..333: mol_type = other RNA
cagagcgtgctgacccaacccccttccgtctctggcgccccagggcagagagttacaatctcatgcactggaagtagctccaacattggtggctacgacgtgcactggtatcagcaggtaccggggacggctcccaagctccttctgtacgagaatgataggcggccttctggaataccagaccgcttctcgggctcaaaaagcggtaccagtgcaacattggtgatcactgggttacaaaccggagatgaagccgacttttattgtggcacatgggatggctccctgcgaaccgggggagtcattggtactggcacacgtgtgaccgttcta

SEQ ID NO: 25293 - RNA, 333 nt, synthetic construct
  misc_feature 1..333: note = derived and/or modified sequence opt3 from anti-HIV_119-091586_VR-Chain
  source 1..333: mol_type = other RNA
cagagcgtgctgacccaacccccttccatgtctgccgctccaggccagagagtcacaatctcatgcagtgggactagctccgacattggaaggaactacgtttcttggtatcagcagttcccgggtgcagcccccaaggtgctcatatacgaaaattcgaaccggccttcaggcatcccagatcgctttagcgggagtaaatccggaacgtctgcgacccttgctattagcggcctgcaaacaggtgacgaggccgattattgttgcgcagtatggggagtgcgacgtggggccggcgctgtcttcggcgcagggactaaggtgaccgttttg

SEQ ID NO: 25294 - RNA, 333 nt, synthetic construct
  misc_feature 1..333: note = derived and/or modified sequence opt3 from anti-HIV_119-091023_VR-Chain
  source 1..333: mol_type = other RNA
cagagcgtgctgacccaacccccttccgtctctgccgctccaggccagagagttacaatctcatgcagtgggagcacttccaacattggaaataacttcgtgtcttggtaccaccatgtaccgggtacggcacccaagctccttatatatgacaatgtgaaaaggcctaccaacgtcccagatcggttttcgggctcaaagagcgggacaagtgccactctggcgatctccggattgcagaccggcgacgaggctgattactggtgtgccgtgtggggtgttcgccgaggggcaggagccgtgttcggcgctggcacaaaagtcaccgtgtta

SEQ ID NO: 25295 - RNA, 333 nt, synthetic construct
  misc_feature 1..333: note = derived and/or modified sequence opt3 from anti-HIV_119-090334_VR-Chain
  source 1..333: mol_type = other RNA
cagagcgtgctgacccaacccccttccgtctctggcgccccagggcagagagttacaatctcatgcactggaagtgctagcaacattggtgactccgatgtgcactggtaccagcagctcccgggcacggcacccaaacttctgatattcgacaatgataagaggccttctgggatcccagaccggttttcgggatcaaagagcggcaccagtgccacattggcgattactggtttacaatccggggatgaggctgactattactgtgccgtatggggagtgcgccagggcgcaggcgccgtcttcgggaccggaacaaaagtgaccgttctg

SEQ ID NO: 25296 - RNA, 333 nt, synthetic construct
  misc_feature 1..333: note = derived and/or modified sequence opt3 from anti-HIV_119-088694_VR-Chain
  source 1..333: mol_type = other RNA
cagagcgtgctgacccaacccccttccgtctctgccgctccaggccagaaggttacaatctcatgcagtgggagctcctctaacattccgataaatggagtgtcgtggtaccagcagttccccggtactgcacctaaactccttgtatatgagacgtacagaaggccatcaggcatccccgaccggtttagcgggagtaagtccggaacctctgccacactggcgattactggcttgcaaaccggtgatgaagctgactattactgtacagtgtggggagtccgcaaaggggtgggcgccgttttcggcaccgggactaaggtgacagtctta

SEQ ID NO: 25297 - RNA, 333 nt, synthetic construct
  misc_feature 1..333: note = derived and/or modified sequence opt3 from anti-HIV_119-088499_VR-Chain
  source 1..333: mol_type = other RNA
cagagcgtgctgacccaacccccttccgtctctgccgctccaggccagaaggttacaatctcatgcagtgggagcaactcctacattggaaataaatatgtgtcttggtaccagcagttcccgggtactgcacccaagctccttatatatgagacgaacaaaagaccttcgggcatcccagacaggttttcagggagcaagagtggaacctccgccacactggcgattactggcttgcaaaccggtgatgaagctgactactattgtgccacatgggcaccccggttaaattctgcccgcgtattcgggaacggaaccatggtgactgtcctg

SEQ ID NO: 25298 - RNA, 333 nt, synthetic construct
  misc_feature 1..333: note = derived and/or modified sequence opt3 from anti-HIV_119-088298_VR-Chain
  source 1..333: mol_type = other RNA
cagagcgtgctgacccaacccccttccgtctctgccgctccaaaggagaaagttacaatctcatgcagtggcgggactagcaacattggaagaaattacgtgtcctggtatcagcaggtaccgggtacggcacccaagctccttatatacgaaaacaataaaaggccttctggcatcccagaccggttctcggggtcaaagagcggaaccagtgccacactggtgattactggcttgcagaccggtgatgaggcggacttttattgtgggacatggggaggctccttacgcaccggcggggtcctgggaactggtacacgagtgaccgttcta

SEQ ID NO: 25299 - RNA, 324 nt, synthetic construct
  misc_feature 1..324: note = derived and/or modified sequence opt3 from anti-HIV_119-087488_VR-Chain
  source 1..324: mol_type = other RNA
cagagcgtgctgacccaacccccttccgtctctgccgctccaggccagaaggttacaatcttctgctcagggagatacagtaacattgagagcaattatgtgtcctggtaccagcagctcccgggaactgcacccaaacttctgatacacgaaaacaataggcggccttctggtacgccagaccgcttttcgggctcaaagagcgggaccagtgccacattggcgatcactggattacataccggcgatgaggctgactattactgtgaaacatgggatggttccgggggagtattcggcaccggcactaaagtgacagtcctg

SEQ ID NO: 25300 - RNA, 333 nt, synthetic construct
  misc_feature 1..333: note = derived and/or modified sequence opt3 from anti-HIV_119-087423_VR-Chain
  source 1..333: mol_type = other RNA
cagagcgtgctgacccaacccccttccgtctctgccgctccaggccagaaggttacaatctcatgcagtgcaagctcctctaacattgggaataactacgtgtcgtggtatcagcagctcccggccactgcgcccaaacttctgatatacgacacggataagagaccttcaggaatcccagacaggttcagcggtagtaaatccggcacctctgctacattggccattactgggttacaaaccggagatgaggcagactattactgtacagtatggggcgtgcggaagggtgtcggggccgtgtttggaaccggcactaaagttacagtgctg

SEQ ID NO: 25301 - RNA, 324 nt, synthetic construct
  misc_feature 1..324: note = derived and/or modified sequence opt3 from anti-HIV_119-087371_VR-Chain
  source 1..324: mol_type = other RNA
cagagcgtgctgacccaacccccttccctctctgccgctccaggccagagagtcacaatctcatgcagtgggggagcaagcaacattggtaagaactccgtttcttggtacgtgcaggtaccgggcactgcccccaaacttctgatatatgagaataatcagaggccttcggggatctcagaccggttcagcggaagtaagtccggctctagcgcgacgttgggtattaccgggttacaaacagctgatgaagccgactactattgtgagacttgggatggatccggcggcgtgtttgggaccggaacaaaagtcaccgtgctg

SEQ ID NO: 25302 - RNA, 321 nt, synthetic construct
  misc_feature 1..321: note = derived and/or modified sequence opt3 from anti-HIV_119-087279_VR-Chain
  source 1..321: mol_type = other RNA
cagagcgtgctgacccaacccccttccgtctctgccgctccaggccagaaggttacaatctcatgcagtgggagctcctctaacattggtaaaaattacgtgtcgtggtatcagcagttcccgggaactgcacccaagctccttatgtacgagaacaataaaagaccttcaggcgtaccagacaggtttagcgggagtaagtccggaacgtctgccaccctggatataagcggcttgcaaacaggtgacgaagcggattattactgttccacttggtcagggagtttaaacttcggaaccggcacacgggtgaccgtcctg

SEQ ID NO: 25303 - RNA, 324 nt, synthetic construct
  misc_feature 1..324: note = derived and/or modified sequence opt3 from anti-HIV_119-087146_VR-Chain
  source 1..324: mol_type = other RNA
cagagcgtgctgacccaacccccttccgtctctgccgctccaggccagaaggttacaatctcatgcagtgggagctcctctaacattggtaaaaattcggtgtcatggtaccagcagttcccgggaactgcacccaagctccttatatatgagaacaataaaagacctagcggcatcccagacaggtttagtgggtccaagtctggaacgagcgccaccctggcgattacaggcttgcacactggtgatgaagctgactactattgtgagacctgggatgggtccggaggcgtattcggcacagggaccaaagtgactgtctta

SEQ ID NO: 25304 - RNA, 324 nt, synthetic construct
  misc_feature 1..324: note = derived and/or modified sequence opt3 from anti-HIV_119-087048_VR-Chain
  source 1..324: mol_type = other RNA
cagttcgtgctgacccaaccccctagcgtctccgccgctccaagacagaaggttatcatttcttgctcaggcagtagctccaacatagggaaaaattacgtgtcttggtatcagcagctcccgggaacagcacccaaacttctgatctacgacaacgataagaggccttcgggtatttcagaccggtttagcgccagtaagtccggcacttctgcgacgttggctatcaccgggttacacacaggagatgaggccgactattactgtgaaacttgggatggcagcggtggggtattcggaaccggcacaaaagtgaccgtcctg

SEQ ID NO: 25305 - RNA, 321 nt, synthetic construct
  misc_feature 1..321: note = derived and/or modified sequence opt3 from anti-HIV_119-085802_VR-Chain
  source 1..321: mol_type = other RNA
cagagcatcctgacccaacccccttccgtgtctgccgctccaggccagagagtcacaattccgtgcttcgggggacactcaaacataggtagtaattacgttagctggtatcagcatctccccggcactgcacctaaacttctgatctttgagaacaataagaggccatccgggattcccgaccggttctctggagccaagtcgggcacgtcagcgaccttggctatcacaggtttacagactggggatgaagccgactacttttgtgcaacctggagcggaggcctgaacttcggcacagggaccaaagtgactgtacta

SEQ ID NO: 25306 - RNA, 324 nt, synthetic construct
  misc_feature 1..324: note = derived and/or modified sequence opt3 from anti-HIV_119-085784_VR-Chain
  source 1..324: mol_type = other RNA
cagagcttcctgacccaacccccttccgtgtctgccgctccaggccagaaggtcacaatctcatgcagtgggagcaactccaatattggaaacaattacgtttcttggtatcagtacctcccgggtactgcacccaaacttctgatatatgagaacgacagaaggccttcgggcacgccagatcggttttcagggagcaagagtggaacctccgccacattggcgatcactggcttacagaccggtgacgaagctgattactattgtgagacatgggacgggtctggaggcgtgttcggcaccgggactaaagtaacagtgctg

SEQ ID NO: 25307 - RNA, 333 nt, synthetic construct
  misc_feature 1..333: note = derived and/or modified sequence opt3 from anti-HIV_119-085370_VR-Chain
  source 1..333: mol_type = other RNA
cagagcgtgctgacccaacccccttccgtctctgccgctccaggccagacagttactatctcatgcagtgggagctcctctaacattggaaatacgtacgtgtcgtggtatcagcacctcccgggtaccgcacccaaacttctgatatacgacaacaatatcagaccttcaggcattccagataggttcagcgccagtaagtccgggacatctgcgactttggctatcaccggattacagacaggcgacgaggccgattattactgtgcaacctgggcccccagcctgaactccgctcgggtatttggttcagggactcgcgtggcagtccta

SEQ ID NO: 25308 - RNA, 321 nt, synthetic construct
  misc_feature 1..321: note = derived and/or modified sequence opt3 from anti-HIV_119-085276_VR-Chain
  source 1..321: mol_type = other RNA
cagagcatcctgacccaacccccttccgtgtctgccgctccaggccagagagtcacaatttcatgcagtgggagctcctctaacataggaaataactacgtttcgtggtatcagcacgtgccgggtactgcacccaagctccttatctacgagaataacaggcggccttcaggcacgccagaccgcttcagcggggccaaaagtggaacctccgcgacactggctattactggcttgcagaccggtgatgaagccgactatttttgttctacatggagcgggtccttaaatttcggaaccggcactaaggtaacagtgctg

SEQ ID NO: 25309 - RNA, 333 nt, synthetic construct
  misc_feature 1..333: note = derived and/or modified sequence opt3 from anti-HIV_119-084885_VR-Chain
  source 1..333: mol_type = other RNA
cagagcgtgctgacccaacccccttccgtctctgccgctccaggcgagaaggttacaatctcatgcagtgggagctcctctaaaattggaaacaatttcgtgtcgtggtaccagcaggtaccgggtactgcacccaagctccttgtgtatgaatcatacagaaggcctagcggcataccagaccggtttagtgggtccaaatctggaacgagcgccaccctggcgatcacaggcttgcagactggtgatgaggctgactattactgtaccgtctggggagtgcgcaagggggttggcgccgtgttcggcacagggaccaaagtcactgtgtta

SEQ ID NO: 25310 - RNA, 333 nt, synthetic construct
  misc_feature 1..333: note = derived and/or modified sequence opt3 from anti-HIV_119-084874_VR-Chain
  source 1..333: mol_type = other RNA
cagagcgtgctgacccaacccccttccgtctctggcgccccaagacagagggttacaatctcatgcagtgggagcgcttccaacattggaaagaatagcgtgtcgtggtaccagcaggtaccgggtactgcacccaaactccttatatatgagaacaataagcggccttcaggcatcccagaccgcttcagcgggagtaaatccggaacgtctgccaccctggtgattacaggcttgcaaactggtgatgaagcggacttttactgtgggacctgggatggatctttacgaacaggcggcgtcatcgggaccggaactcgtgtgacagttctg

SEQ ID NO: 25311 - RNA, 333 nt, synthetic construct
  misc_feature 1..333: note = derived and/or modified sequence opt3 from anti-HIV_119-084691_VR-Chain
  source 1..333: mol_type = other RNA
cagagcgtgctgacccaacccccttccgtctctgccgctccaggccagaaggttgtgatctcatgcagtgggagctcctctattatagagaaaaactcgatctcatggtaccagcagggaccgggtgcagcccccaagctccttatttatgaaaatgacaaaagacctagcggcatcccagataggttcagtgggtccaagtctgcgacaagcgctactctggccattgtaggattgcaaacgggcgacgaggcagattactgttgcgccgtgtggggtgtccggcgcggggctggagcagtgtttggcgccggcaccaaagttacagtgtta

SEQ ID NO: 25312 - RNA, 324 nt, synthetic construct
  misc_feature 1..324: note = derived and/or modified sequence opt3 from anti-HIV_119-083793_VR-Chain
  source 1..324: mol_type = other RNA
cagagcgtgctgacccaacccccttccgtctctgccgctccaggccagaaggttacaatctcatgcagtgggagctcctctaacattggtaaaaattcggtgtcatggtaccagcagctcccggcaactgcccccaaacttctgatatatgagagcaacaagagacctagtggaatcccagacaggttctccggctctaagagcgggacgtccgcgaccttggctattacaggattacaaactggcgatgaagccgactactattgtgcaacctgggatggtcgggtatcagtgatcgggacaggaaccaaagtcactgtgctg

SEQ ID NO: 25313 - RNA, 324 nt, synthetic construct
  misc_feature 1..324: note = derived and/or modified sequence opt3 from anti-HIV_119-083163_VR-Chain
  source 1..324: mol_type = other RNA
cagagcgtgctgacccaacccccttccgtctctggcgccccagggcagagagttatcatttcatgcacaggaagtagctccaacatatggggttacgacgtgcagtggtatcagcaactcccgggcactgctcccaaacttctgttgtacgagaatgataggcggccttctgggacgccagaccgcttctcgggatcaaagagcggcaccagtgcaacattagccatcactggtctgcacaccggggatgaagcggactattactgtgagacatgggatggatccggcggcgtatttgggaccggaactaaggtgacagtccta

SEQ ID NO: 25314 - RNA, 333 nt, synthetic construct
  misc_feature 1..333: note = derived and/or modified sequence opt3 from anti-HIV_119-082331_VR-Chain
  source 1..333: mol_type = other RNA
cagagcgtgctgacccaacccccttccatctctgccgctccaggccagaaggtcacaatttcatgcagtgggggaagctccaacataggtgcaaattacgtttcttggtatcagcacctcccgggcactgcccccaaacttctgatctacgagacgaacaagagaccttcggggattccagacaggttctcaggaagccagagtggcacctccgcgacattggtgatcactggtttacaaaccggggatgaagctgacttttattgtggaacatggggcggctctctgcgggccgggggagtaattggtaccggcactcgcgtgacagtccta

SEQ ID NO: 25315 - RNA, 324 nt, synthetic construct
  misc_feature 1..324: note = derived and/or modified sequence opt3 from anti-HIV_119-082070_VR-Chain
  source 1..324: mol_type = other RNA
cagagcgtgctgacccaacccccttccgtctctgccgctccaggccagaaggttgtgatctcatgcagtgggagctcctctattatagagaaaaactcgatctcatggtaccagcagggaccgggtgcagcccccaagctccttatttatgaaaatgacagaaggcctagcggcacaccagatcggttcagtgggtccaaatctggaactagcgcgacgctggctatcaccggcttgcaaacaggtgacgaggccgattactattgtgaaacttgggacgggtccggaggcgtatttggcaccgggacaaaggtgaccgtctta

SEQ ID NO: 25316 - RNA, 333 nt, synthetic construct
  misc_feature 1..333: note = derived and/or modified sequence opt3 from anti-HIV_119-081512_VR-Chain
  source 1..333: mol_type = other RNA
cagagcgtgctgacccaacccccttccgtctctgccgctccaggccagaacgttacattctcatgcagtgggagcaattccaacatcggagacaattacgtgtcttggtatcagcagattccgggtactgcacccaagctcgtaatatacgataacaataaaagaccttcgggcatcccagacaggttttcagggagcaagagtggaacgtccgccacccttgtgattacaggcctgcaaactggtgatgaggcggacttctattgtgggacctgggatggatctttgcggacaggcggcgtcatcgggaccggaactcgcgtgacagtttta

SEQ ID NO: 25317 - RNA, 333 nt, synthetic construct
  misc_feature 1..333: note = derived and/or modified sequence opt3 from anti-HIV_119-080816_VR-Chain
  source 1..333: mol_type = other RNA
cagctggtgctcacccaaccccctagcgcctccggcacaccagggcagagagtcactatctcttgctcaggaagtagctccaacattggttctaatttcgtttcgtggtaccagcagaggccgggcacggctcccaaacttctgatatatgagaccaacaagcggccttcagggatcccagaccgctttagcggaagtaagtccggcacatctgcaactttggccattaccggtttacaaacaggggatgaagcggactactattgtgctacctgggcaccccgactgaatagcgcccgtgtgttcggaaacggcactatggtaacagtgcta

SEQ ID NO: 25318 - RNA, 333 nt, synthetic construct
  misc_feature 1..333: note = derived and/or modified sequence opt3 from anti-HIV_119-079302_VR-Chain
  source 1..333: mol_type = other RNA
cagagcgtgctgacccaacccccttccgtctctgccgctccaggccagaaggttacaatctcatgcagtgggagctcctcttacattggaaacaaatatgtgtcgtggtaccagcagttcccgggtactgcacccaagctccttatatatgagaataacaaaagactgtcaggcatccctgacaggtttagcgccagtaagtccgcgacgtctgctaccttggccattagcgggttacaaacaggagatgaagcagacttctactgtggcacttgggatggttccctgcggaccgggggagtaatcggcacaggcacccgcgtgactgtccta

SEQ ID NO: 25319 - RNA, 327 nt, synthetic construct
  misc_feature 1..327: note = derived and/or modified sequence opt3 from anti-HIV_119-079292_VR-Chain
  source 1..327: mol_type = other RNA
cagagcgtgctgacccaacccccttccgtctctgccgctccaggccagaaggttacaatctcatgcagtgggagcaactccaatattggaaacaattacgtgtcttggtatcagcagctcccgggtactgcacccaaacttctgatatacgacaacaataagagaccttcgggcatcccagataggttctcagggagcaaaagtggaacgtccgccaccttgggcattacaggtttacaaactggggacgaggcgaactattactgtggaacctgggatacatctctgagcggcgtatttggcaccgggactgaagtgatcgtccta

SEQ ID NO: 25320 - RNA, 321 nt, synthetic construct
  misc_feature 1..321: note = derived and/or modified sequence opt3 from anti-HIV_119-079289_VR-Chain
  source 1..321: mol_type = other RNA
cagagcgccctgacccaacccccttccgtgtctgctgcaccaggccagagagtcacaatctcatgcagtgggaacaatagcaacattggaaataacttcgtttcctggtaccagctccttccgggtactgcccccaagctgttgatatatgagaataacaaaaggtcttcgggcatccctgaccggttttcagggagcaagagtggaacgtccgcgaccttaggcattacaggtctgcagactggggatgaagctgactacttctgttctacctggagcggatccctaaattttggcacaggcacccgcgtgactgtactc

SEQ ID NO: 25321 - RNA, 324 nt, synthetic construct
  misc_feature 1..324: note = derived and/or modified sequence opt3 from anti-HIV_119-078935_VR-Chain
  source 1..324: mol_type = other RNA
cagagcgtgctgacccaacccccttccgtctctgccgctccaggccagagagttacaatctcatgcagtgggactagcgcaaacattgagaattactatgtgtcctggtaccagcagctcccgggaacggcccccaaacttataatctatgacgataacaagaggccttctggtattccacaacggttctcgggctcaaagagcgggaccagtgcgacactgggaatcactggcttgcagaccggtgacgaagctgagtactattgtgaaacatgggatgggtccggaggcgtatttggcaccgggactaaagtgacagtctta

SEQ ID NO: 25322 - RNA, 324 nt, synthetic construct
  misc_feature 1..324: note = derived and/or modified sequence opt3 from anti-HIV_119-078702_VR-Chain
  source 1..324: mol_type = other RNA
cagagcgtgctgacccaacccccttccgtctctgccgctccaggccagaaggttacaatctcatgcagtgggagctcctctgtgttcggaaagaactacgtatcgtggtatcagcacctcccgggtactgcacccaaacttctgatttacgagaatacgaaaagaccttcaggcataccagacaggtttagcgggagtaagtccggaacctctgccacattggcgatcactggcttacagaccggtgatgaagctgactattactgtgagacatgggatgggagcggaggcgtgttcggctccgggaccaaagtcactgtgctg

SEQ ID NO: 25323 - RNA, 324 nt, synthetic construct
  misc_feature 1..324: note = derived and/or modified sequence opt3 from anti-HIV_119-078593_VR-Chain
  source 1..324: mol_type = other RNA
cagagcttcctgacccagcccccttccgtgtctgccgctccaggccagaaggtcacaatctcatgcagtgggagcaactccaatattggaaacaattacgtttcttggtatcaacaggtgccgggtactgcacccaaactccttatatacgagaacaataagagaccttcgggcatcccagacaggttttcagggagcaaaagtggaacgtccgccaccctggtaattacaggcttgcacactggtgatgaagcggactattactgtgagacctgggatgggtctggaggcgtgttcggcacagggagcaacgtcaccttactg

SEQ ID NO: 25324 - RNA, 333 nt, synthetic construct
  misc_feature 1..333: note = derived and/or modified sequence opt3 from anti-HIV_119-077708_VR-Chain
  source 1..333: mol_type = other RNA
cagagcgtgctgacccaacccccttccctctctgccgctccaggccagaaggtcacaatctcatgcagtgggactacgagcaacattggaaataactacgtttcctggtatcagcaccttccgggtaccgcacccaaactgttgatatacgagaatacaaagagaccttctggcatcccagacaggttctcggggtcaaaaagcggaaccagtgccactttaggcattacaggtctgcagaccggggatgaagcggactattactgtactgtgtggggagtacggaagggcgtgggcgctgtctttgggacaggaaccaaagtgacggttcta

SEQ ID NO: 25325 - RNA, 321 nt, synthetic construct
  misc_feature 1..321: note = derived and/or modified sequence opt3 from anti-HIV_119-076904_VR-Chain
  source 1..321: mol_type = other RNA
cagagcgtgctgacccaacccccttccgtctctgccgctccaggccagaaggttacaatctcatgcagtagaagctcctctcacattgagaactcgtacgtgtcatggtatcagcatctcccggggactgcacccaaacttctgatatacgaaaataacaagaggcctagcggaatcccagaccggttcagtggttccaaatctggcacgagcgccaccttggggatttccggattacagacaggcgatgaggcggactatttttgttcaacttggagtggtagcctgaatttcgggaccggaacacgcgtaaccgtgcta

SEQ ID NO: 25326 - RNA, 324 nt, synthetic construct
  misc_feature 1..324: note = derived and/or modified sequence opt3 from anti-HIV_119-075862_VR-Chain
  source 1..324: mol_type = other RNA
cagagcgtgctgacccaacccccttccatctctgccgctccaggccagaaggtcacaatttcatgcagtgggagcgcatccaacataggtaaaaattctgtttcgtggtaccagcagttcccgggaactgcccccaagctccttatctatgagaacaatagaaggccttcaggcacgccagaccggtttagcgggagtaaatccggaacctctgcgacactggctattactggcttgcaaaccggtgatgaagccgactactattgtgagacatgggatgggagcggaggcgtgttcggcaccgggactaaggtaacagtgtta

SEQ ID NO: 25327 - RNA, 333 nt, synthetic construct
  misc_feature 1..333: note = derived and/or modified sequence opt3 from anti-HIV_119-075465_VR-Chain
  source 1..333: mol_type = other RNA
cagagcgtgctgacccaacccccttccgtctctgccgctccaggccagaaggttgtgatctcatgcagtgggagctcctctattataggaaacaattacgtatcgtggtatcagcagctcccgggtacagcacccaaacttctgatctacgagaacaatagaaggccttcaggcattccagaccggttcagcgggagtaagtccggaacttctgccacgttggcgatcagcggcttacaaaccggtgatgaagctgactattgttgcgccgtgtggggagtccgccgaggggcaggcgccgtgtttggcgctgggacaaaagttactgtgctg

SEQ ID NO: 25328 - RNA, 330 nt, synthetic construct
  misc_feature 1..330: note = derived and/or modified sequence opt3 from anti-HIV_119-074822_VR-Chain
  source 1..330: mol_type = other RNA
agcgtgctgacccagcccccttccgtctctgccgctccaggccaaaacatcacaatttcatgcagtgggggaagctccaatatagcaaagaactacatctcttggtatcagcacctcccgggtactgcccccaaaattgttatctacgacaatgataagagacctcttggcattccagacaggttctcggcgtcaaaaagcgggacgagtgctaccctgggaatcacaggcttgcagactggtgatgaggccgactattactgtgcagtgtggggagtacggcgcggggtgggcgccgtctttggcgctgggaccaaggtgatagtttta

SEQ ID NO: 25329 - RNA, 333 nt, synthetic construct
  misc_feature 1..333: note = derived and/or modified sequence opt3 from anti-HIV_119-074629_VR-Chain
  source 1..333: mol_type = other RNA
cagagcgtgctgacccaacccccttccgagtctgccgctccaggccagaaggtcacaatctcatgcagtgggggaactagcaacattggtaataactacgtttcctggtatagaaggctcccgggcacggcacccaaacttctgatatacgaaaataaccggcgcccttctgggatcccagaccgattctcgggatcaaagagcggcaccagtgccacattggcgatttccggtttacagactggggatgaggctgactattgttgcgccgtgtggggagtacgtagaggcgcaggcgccgtgtttggggctggaaccaaagtcacagtgctg

SEQ ID NO: 25330 - RNA, 324 nt, synthetic construct
  misc_feature 1..324: note = derived and/or modified sequence opt3 from anti-HIV_119-074500_VR-Chain
  source 1..324: mol_type = other RNA
cagagcgtgctgacccaacccccttccgtctctgccgctccaggccagaaggttacaatgtcatgcagtgggagctcctctaacatcggaaataactacgtgtcgtggtatcagtacctcccgggtactgcacccaaacttctgatttatgagaatgacagaaggccttcaggcataccagatcggttcagcgccagtaagtccgggacgtctgcgaccttggctatcacaggattacagactggcgacgaagccgattactattgtgagacctgggacggtagcgggggagtatttggcacaggcaccaaagtgactgtcctg

SEQ ID NO: 25331 - RNA, 333 nt, synthetic construct
  misc_feature 1..333: note = derived and/or modified sequence opt3 from anti-HIV_119-073911_VR-Chain
  source 1..333: mol_type = other RNA
cagagcgtgctgacccaacccccttccgtctctgccgctccaggccagagagttacaatctcatgcagtgggagctcctctaacattgagaataactacgtgtcgtggtatcagcacctcccgggaactgcacccaaacttctggtatacgacgataataagaggccttcaggtataccacatcggttcagcgccagtaagtccggcacgtctgcgaccttggctatcacagggttacagactggagacgaagccgattattactgtaccctgtggggcgtgcgcaaaggtgtcggggcagtgtttggaacaggcaccaaggttactgtgcta

SEQ ID NO: 25332 - RNA, 324 nt, synthetic construct
  misc_feature 1..324: note = derived and/or modified sequence opt3 from anti-HIV_119-072765_VR-Chain
  source 1..324: mol_type = other RNA
cagagcgtgctgacccaacccccttccgtctctgccgctccaggccagaaggttacaatctcatgcagtgggaacagctccaatattggaaacaatttcgtgtcttggtaccagcaggtaccgggtactgcacccaaactccttgtgtatgagacgtacagaaggccttcgggcaccccagaccggttttcagggagcaagagtggaacatccgccactctggcgatatctggcttgcaaaccggtgatgaagctgactattactgtgggacatgggatggaagcggcggcgtcttcgggaccggaactaaagtgacagtttta

SEQ ID NO: 25333 - RNA, 333 nt, synthetic construct
  misc_feature 1..333: note = derived and/or modified sequence opt3 from anti-HIV_119-072313_VR-Chain
  source 1..333: mol_type = other RNA
cagttcgtgctgacccaaccccctagcgtctccgccgctccaggccagaaggttacaatctcttgctcagcaagtagctccattatagggaaaaactacgtgtcttggtatcagcagtttccgggaactgcccccaagctccttatctacgaggacaataaaagaccttcgggtattccagataggttctcaggcagcaagagtgggacgtccgcgaccctggctatcacaggattgcaaactggcgacgaagccgattattactgtaccgtatggggtgtgcggaaaggggtcggagcagtgtttggcacaggcaccaaggttactgtgtta

SEQ ID NO: 25334 - RNA, 333 nt, synthetic construct
  misc_feature 1..333: note = derived and/or modified sequence opt3 from anti-HIV_119-072280_VR-Chain
  source 1..333: mol_type = other RNA
cagagcgtgctgacccaacccccttccgtctctgccgctccaggccagaaggtttcaatcagttgcagcgggtccgactctaacctcggagataattacgtgtcgtggtatcagcagttcccgggtacagcacccaaacttctgattcacgacaacaataagagaccttcaggcactccagataggtttagcgggagtaaatccggaacgtctgccaccttggcgataacaggcttacaaactggtgacgaggctgattactattgtgccacctgggcaccccggctgaacagcgcccgcgtattcgggaatggaacaatggtgaccgtccta

SEQ ID NO: 25335 - RNA, 333 nt, synthetic construct
  misc_feature 1..333: note = derived and/or modified sequence opt3 from anti-HIV_119-071693_VR-Chain
  source 1..333: mol_type = other RNA
cagagcgtgctgacccaacccccttccgtctctgccgctccaggccagaaggttgtgatctcatgcagtgggagctcctctattatagagaaaaactcgatctcatggtaccagcagggaccgggtgcagcccccaagctccttatttatgaaaatgacaaaagacctagcggcatcccagataggttcagtgggtccaagtctggaacaagcgcgactctggctattacgggcttgcaaaccggtgacgaggccgattactattgtacaatctggggagtacggaaaggggtgggcgcagtctttggcactgggaccaaggtgacagtttta

SEQ ID NO: 25336 - RNA, 321 nt, synthetic construct
  misc_feature 1..321: note = derived and/or modified sequence opt3 from anti-HIV_119-071353_VR-Chain
  source 1..321: mol_type = other RNA
cagagcgtgctgacccaacccccttccgcctctgctgcaccaggccagaaggtcacaatctcatgcagtgggagcaactccaatattggaaacaatttcgtttcttggtaccagctctttccgggtactgcccccaaacttctgatattcgagaacaataagagaccttcgggcatcccagacaggttttcaggggcgaaaagcggaacgagtgctaccttggccattacaggcttacagactggtgatgaagcagactatttctgttccacctggtctgggagcctgaactttggaacaggcacccgggtgactgtacta

SEQ ID NO: 25337 - RNA, 324 nt, synthetic construct
  misc_feature 1..324: note = derived and/or modified sequence opt3 from anti-HIV_119-069711_VR-Chain
  source 1..324: mol_type = other RNA
cagagcgtgctgacccaacccccttccgtctctgccgctccaggccagaaggttacaatctcatgcagtgggagctcctctaacattggaaataactacgtgtcgtggtatcagcagctcccgggtactgcacccaaacttctgatatacgacaataacaatagaccttcaggcgtaccagataggttcagcgggagtaagtccggaacgtctgccaccttggcgatcacaggcttacaaactggtgacgaggctgattattactgtgaaacctgggacgatagcgggggagtgtttggcacaggcaccaaagtcactgtgctg

SEQ ID NO: 25338 - RNA, 333 nt, synthetic construct
  misc_feature 1..333: note = derived and/or modified sequence opt3 from anti-HIV_119-069061_VR-Chain
  source 1..333: mol_type = other RNA
cagagcgtgctgacccaacccccttccgtctctgccgctccaggccagaaggttacaatctcatgcagtgggagctcctctaacattggatcgaattacgtgtcatggtatcagcagctcccgggtactgcacccaaacttctggtatacgacaacaatgagagacctagcggcataccagataggttcagtgggtccaagtctggaacgagcgccaccttggcgatcacaggcttacaaactggtgacgaagctgattattactgtgccacctgggcaccccggctgaactccgcccgcgtgtttgggaatggaacaatggtcaccgtgcta

SEQ ID NO: 25339 - RNA, 324 nt, synthetic construct
  misc_feature 1..324: note = derived and/or modified sequence opt3 from anti-HIV_119-068202_VR-Chain
  source 1..324: mol_type = other RNA
cagagcgtgctgacccaagagccctccgtctctggcgcccctgggcagagagttacaatctcatgcactggaagtaacagcaatattggtggccacgacgtgcattggtaccagcagctcccagggacggctccgaaacttctgatatatgataacgacaagaggccctccggaatccctgatcggttctctggctcgaagtcagacaccagcgcaagtttgggtattacagggttacaaactggagatgaagccgactactattgtgagacctgggatggctccggcggggtatttggaacaggtaccaaagtgactgtcctg

SEQ ID NO: 25340 - RNA, 324 nt, synthetic construct
  misc_feature 1..324: note = derived and/or modified sequence opt3 from anti-HIV_119-068063_VR-Chain
  source 1..324: mol_type = other RNA
cagagcgccctgacccaacccccttccgcttctggctcactcgggcagagtgtgacaatcagctgcactggaacgagatccgacgtcggtaactactatgtttcttggtaccagcagcttccaggcaccgcaccgaagctgttgatttcggagaataacaggcggccctcagggacacctgatcgcttcagcggaagtaaatccggcacttctgccaccttagcgataagcggtctgcaaacaggggacgaagctgattattactgtggaacctgggacggctccggcggggtgtttggaactggtacaaaggtaaccgtgcta

SEQ ID NO: 25341 - RNA, 333 nt, synthetic construct
  misc_feature 1..333: note = derived and/or modified sequence opt3 from anti-HIV_119-067980_VR-Chain
  source 1..333: mol_type = other RNA
cagagcgtgctgacccaacccccttccgtctctgccgctccaggccagaaggttacaatctcatgcagtgggaacagctccaatattggaaacaatttcgtgtcttggtaccagcaggtaccgggtactgcacccaaactccttgtgtatgagacgtacagaaggccttcgggcataccagaccggttttcagggagcaagagtggaacctccgccacactggcgatcactggcttgcaaaccggtgatgaagctgactatcactgtgccatttggggagtccgcaaaggggtgggcgcagttttcggcacagggaccaaggtgactgtcgtg

SEQ ID NO: 25342 - RNA, 324 nt, synthetic construct
  misc_feature 1..324: note = derived and/or modified sequence opt3 from anti-HIV_119-067866_VR-Chain
  source 1..324: mol_type = other RNA
cagagcgtgctgacccaacccccttccgtctctgccgctccaggccagaaggttacaatctcatgcagtgggagcacttccacgattggaaacaattacgtgtcttggtatcagcacctcccgggtaccgcacccaaacttctgatatacgacaacaataagagacctgccggcatcccagataggttcacagcgtcgaaatcagggactagcgctaccttggccattacaggattacataccggcgacgaggcagattattactgtgaaacttgggacggtagtgggggagtatttggcacaggcaccaaggtgacggtcctg

SEQ ID NO: 25343 - RNA, 321 nt, synthetic construct
  misc_feature 1..321: note = derived and/or modified sequence opt3 from anti-HIV_119-067756_VR-Chain
  source 1..321: mol_type = other RNA
cagagcgtgctgacccaacccccttccgtctctgccgctccaggccagaaggttgtgatctcatgcagtgggagcacatccaacattggaaagaatttcgtatcttggtaccagcagctcccgggtactgcacccaaacttctgatatatgagaactcgagaaggccttcaggcatcccagaccggtttagcggggccaaaagtggaacgtccgcgaccttggctattacaggcttacaaactggtgatgaagccgactacttctgttctacctggagcgggtccctgaattttggaacaggcacccgcgtgactgtccta

SEQ ID NO: 25344 - RNA, 321 nt, synthetic construct
  misc_feature 1..321: note = derived and/or modified sequence opt3 from anti-HIV_119-066859_VR-Chain
  source 1..321: mol_type = other RNA
cagagcgtgctgacccaacccccttccgtctctgccgctccaggccagaaggttacaatcacttgctcagggagtgcaagcaacattgagaataactacgtgtcctggtatcagcagttcccgggacccgcccctaaactccttatatacgaaaatgacaagagaccatctggtatccccgataggttttcgggctcagcgagcgggacgagtgctaccctggccattacaggattgcaaactggcgacgaggcagattatttctgttccacctggtctggtagcttaaactttgggacaggaacccgggtaactgtgctg

SEQ ID NO: 25345 - RNA, 333 nt, synthetic construct
  misc_feature 1..333: note = derived and/or modified sequence opt3 from anti-HIV_119-065821_VR-Chain
  source 1..333: mol_type = other RNA
cagagcgtgctgacccaacccccttccgtctctgccacaccaggccagagagttactgtgtcatgcagtgggagctcctctaacatcggaaatcactacgtatcgtggtatcaacaggtgccgggtacggctcccaagctccttatttacgacaactcaaataggcctagcggcataccagatcggttcagtgggtccaaatctggaaccagcgcaacactgggcatcactggtttgcagaccggggacgaggccgattattactgtacagtctggggagtgcgcaagggcgttggcgcggtgtttgggaccggaactaaagtcacagtgtta

SEQ ID NO: 25346 - RNA, 333 nt, synthetic construct
  misc_feature 1..333: note = derived and/or modified sequence opt3 from anti-HIV_119-065191_VR-Chain
  source 1..333: mol_type = other RNA
cagagcgtgctgacccaacccccttccgtctctgccgctccaggccagaaggttacaatctcatgcagtgggaacaatagcaacattggaaataactacgtgtcctggtatcagcagctcccgggtactgcacccaaacttctgatattcgagaatcacaagagaccttctggcatcccagacaggttttcggggtcaaaaagcggaacgagtgccaccttgggcattacaggtttacaatccggggatgaagcggactactattgtgctacttgggcaccccggctgaactctgcccgcgtattcggaaccggcacaaaggtgaccgtccta

SEQ ID NO: 25347 - RNA, 333 nt, synthetic construct
  misc_feature 1..333: note = derived and/or modified sequence opt3 from anti-HIV_119-064667_VR-Chain
  source 1..333: mol_type = other RNA
cagagcgtgctgacccaacccccttccgtctctgccgctccaggccagaaggttacaatctcatgcagtgggagcaactcctacattggaaataaatatgtgtcttggtaccagcaggtaccgggtactgcacccaagctccttatatatgagaacaataaaagaccttcgggcatcccagacaggttctcagggagcaagagtggaacgtccgccaccctggtgattacaggcttgcaaactggtgatgaagcggacttttactgtgggacctgggatggatctttacggacaggcggcgtcatcgggaccggaactcgcgtgacagttctg

SEQ ID NO: 25348 - RNA, 324 nt, synthetic construct
  misc_feature 1..324: note = derived and/or modified sequence opt3 from anti-HIV_119-063791_VR-Chain
  source 1..324: mol_type = other RNA
cagagcgtgctgacccaacccccttccgtctctgccgctccaggccagaaggttccgatctcatgcagtgggaacagctccaatattggaaacaattacgtgtcttggtatcagcagctccccggtacagcacctaaacttctgatatacgagaacaataagagaccatcgggcatccccgacaggttctcagggagcaaaagtggaacttccgccacgttggcgattaccggcttacacacaggtgatgaagctgactattactgtgagacttgggatgggtctggaggcgtatttggcaccgggacaaaggtgaccgtcctg

SEQ ID NO: 25349 - RNA, 333 nt, synthetic construct
  misc_feature 1..333: note = derived and/or modified sequence opt3 from anti-HIV_119-062989_VR-Chain
  source 1..333: mol_type = other RNA
cagagcgtgctgacccaacccccttccgtctctgccgctccaggccagagagttacaatctcatgcagtgggagctcctctaacattggaaataacttcgtgtcgtggtaccagcagtttccgggtactgtacccaagctccttatatatgagaataacaggcggccttcaggcatcccagaccgcttcagcgggagtaaatccggaacgtctgcaaccctggccattacaggcttgcaaactggtgatgaagcggactactattgtgctgtgtggggagtccgacgtggggtgggcgccgtttttggcgcagggaccaaggtgatcgtctta

SEQ ID NO: 25350 - RNA, 321 nt, synthetic construct
  misc_feature 1..321: note = derived and/or modified sequence opt3 from anti-HIV_119-062286_VR-Chain
  source 1..321: mol_type = other RNA
cagagcgtgctgacccaacccccttccgtctctgccgctccaggccagaaggttacaatctcatgcagtgggagcgcatccaacattggaaagaatttcgtgtcttggtaccagcagctcccgggtactgcccccaaacttctgatatcggagaacaatagaaggccttcaggcacgccagaccggtttagcgggagtaaatccggagcgtctgctaccttggtaatcagcggcttacaaacaggtgatgaagccgactattactgtgcaacttggtccgggtcactgagtattggaaccggcacaaaggtgaccgtccta

SEQ ID NO: 25351 - RNA, 321 nt, synthetic construct
  misc_feature 1..321: note = derived and/or modified sequence opt3 from anti-HIV_119-061416_VR-Chain
  source 1..321: mol_type = other RNA
cagagcgtgctgacccaacccccttccgtctctgccgctccaggccagaaggttgtgatctcatgcagtgggagctcctctattttcgagaaaaactcgatatcatggtaccagcagggaccgggtgcagcccccaagctccttatctatgaaaatgacaaaagaaggagcggcattcctgatcggtttagtgggtccaagtctgcgacaagcactacgctggctatcgtaggattgcaaaccggcgacgaggccgattacttctgttccacatggtcaggtagtttaaactttgggactggaacccgcgtgacagtcctg

SEQ ID NO: 25352 - RNA, 321 nt, synthetic construct
  misc_feature 1..321: note = derived and/or modified sequence opt3 from anti-HIV_119-061344_VR-Chain
  source 1..321: mol_type = other RNA
cagagcgtgctgacccaacccccttccgtctctgccgctccaggccagaaggttacaatctcatgcagtgggagctcctctgtgttcggaaagaactacgtatcgtggtatcagcacctcccgggtactgcacccaaacttctgatttacgagaataacaaaagaccttcaggcataccagacaggtttagcggggccaagagtggaacggcggctaccttggccatcacaggcttacagactggtgatgaagcagactattactgtgccacctggtccgggtctctgaatttcggaacaggcaccaaagtgactgtccta

SEQ ID NO: 25353 - RNA, 324 nt, synthetic construct
  misc_feature 1..324: note = derived and/or modified sequence opt3 from anti-HIV_119-060240_VR-Chain
  source 1..324: mol_type = other RNA
cagagcgtgctgacccaacccccttccgagtacggcgccccagggcacaacgtcacagtttcttgctcaggaactacgagtaatatcgaaaacaatttcgtgagctggtatctcattgtaccgggtaccgctcccaaacttctgatatttgacaacgataagagaccttccggcatcccagacaggttctctgggtcgaagtcaggaacaagcgcaactttggccattaccggcttacagacaggtgatgaggcggactactattgtgctacctgggatgggcgggtgagtgtcatcggaactggcacaaaagtgaccgttctg

SEQ ID NO: 25354 - RNA, 333 nt, synthetic construct
  misc_feature 1..333: note = derived and/or modified sequence opt3 from anti-HIV_119-060184_VR-Chain
  source 1..333: mol_type = other RNA
cagagcgtgctgacccaacccccttccgtctctggcgccccagggcagagagttacaatctcatgcagtggaagctcctctaacattggttcgaatactgtgaactggtaccagcagctcccgggcacggctcccaaacttctgatatatgacaataacaagaggccttcagggatcccagatcggttcagcggaagtaagtccggcacctctgcaacattggtaattactggtttacaaaccggggacgaggccgatttttactgtggaacatgggacggcagcctgcgcaccggcggggtgatcggaactggtacacgagtcaccgtgcta

SEQ ID NO: 25355 - RNA, 321 nt, synthetic construct
  misc_feature 1..321: note = derived and/or modified sequence opt3 from anti-HIV_119-058035_VR-Chain
  source 1..321: mol_type = other RNA
cagagcgtgctgacccaacccccttccgtctctgccgctccaggccagaaggttacaatctcatgcagtgggagcgcatccaacattggaaagaatttcgtgtcttggtaccagcagctcccgggtactgcccccaaacttctgatatatgagaacaatagaaggccttcgggcacgccagaccggttttcaggggcgaaaagcggaaccagtgctacattggccatcactggcttacaaaccggtgatgaagcagactacttctgttccacatggtctgggagcctgaactttggaaccggcactcgcgtaacagtgcta

SEQ ID NO: 25356 - RNA, 321 nt, synthetic construct
  misc_feature 1..321: note = derived and/or modified sequence opt3 from anti-HIV_119-057858_VR-Chain
  source 1..321: mol_type = other RNA
cagagcgtgctgacccaacccccttccgtctctgccgctccaggccagaacgttaatatctcatgcagtgggggaagctccaacattggttctaattacgtgtcgtggtatcagcagttcccgggcacagcacccaagctccttatatacgagaacaataaaagaccttcagggatcccagacaggtttagcggagccaagagtggcacttccgcgacgctggctattaccggtttgcaaacaggggatgaagccgactatttctgttctacttggagcggatccttaaactttggcaccggcacacgggtaaccgtgctg

SEQ ID NO: 25357 - RNA, 324 nt, synthetic construct
  misc_feature 1..324: note = derived and/or modified sequence opt3 from anti-HIV_119-057473_VR-Chain
  source 1..324: mol_type = other RNA
cagagcgtgctgacccaacccccttccgtctctgccgctccaggccagaaggttacaatctcatgcagtgggagctcctctaacattggaaataactacgtgtcgtggtatcagcacctcccgggtactgcacccaaacttctgatatacgacacgtattcaagacctagcggcatcccagataggttcagtgggtccaagtctggaaccagcgccacattggcgattactggcttacagaccggtgacgaggctgattactattgtgggacatgggacggatccggcggcgtatttgggaccggaactaaagtgacagtcctg

SEQ ID NO: 25358 - RNA, 321 nt, synthetic construct
  misc_feature 1..321: note = derived and/or modified sequence opt3 from anti-HIV_119-057090_VR-Chain
  source 1..321: mol_type = other RNA
cagagcgtgctgacccaacccccttccgtctctgccgctccaggccagacagttactatctcatgcagtgggagcacgtccaacattggaaagaatgacgtgtcttggtaccagcagctcccgggtaccgcacccaaacttctgatatcggagaacaatagaaggccttcaggcacaccagatcggttcagcgccagtaagtccgggacttctgcgaccttggctatcacaggattacaaaccggcgacgaagccgattatttttgtagcacttggtccggttcactgaacttcgggacaggaacccgcgtaacggtgcta

SEQ ID NO: 25359 - RNA, 333 nt, synthetic construct
  misc_feature 1..333: note = derived and/or modified sequence opt3 from anti-HIV_119-055754_VR-Chain
  source 1..333: mol_type = other RNA
cagagcgtgctgacccaacccccttccgtctctgccgctccaggccagaaggttacaatctcatgcagtgggaacagctcctctattggaaataacttcgtgtcgtggtaccagcagctcccgggtactgcacccaaacttctggtatatgagaattacagaaggccttcaggcataccagaccggtttagcgggagtaagtccggaacgtctgccaccttggcgatcgatggcttacaaacatgggacgaagctgattatcactgtgccatttggggtgtgcgcaaaggggtcggagcagtgttcggcactggcaccaaggttacagtggtc

SEQ ID NO: 25360 - RNA, 324 nt, synthetic construct
  misc_feature 1..324: note = derived and/or modified sequence opt3 from anti-HIV_119-054899_VR-Chain
  source 1..324: mol_type = other RNA
cagagcgtgctgacccaacccccttccgtctctgccgctccaggccagaaggttacaatctcatgcagtgggagcaactcctacattggaaataaatatgtgtcttggtaccagcagttcccgggtactgcacccaagctccttatacacgagaacaatagaaggccttcgggcacgccagaccggttttcagggagcaaaagtggaacctccgccacactggcgatctctggcttgcaaactggtgatgaagctgactattactgtgagacctgggatgggagcggaggcgtattcggcacagggaccaaggtgactgtctta

SEQ ID NO: 25361 - RNA, 324 nt, synthetic construct
  misc_feature 1..324: note = derived and/or modified sequence opt3 from anti-HIV_119-054501_VR-Chain
  source 1..324: mol_type = other RNA
cagagcgtgctgacccaacccccttccgtctctgccgctccaggccagaaggttacaatctcatgcagtgggactagctccaacattggaaataactacgtgtcttggtatcagcacctcccgggtacggcacccaaacttctgatattcgagaccaataagagaccttcgggcatcccagacaggttttcagccagcaaaagtgggacatccgcgactttggctattaccggattacagacaggcgatgaagccgactactattgtgagacctgggatggttctgggggagtattcggccccggcactcgggtgacagtcctg

SEQ ID NO: 25362 - RNA, 324 nt, synthetic construct
  misc_feature 1..324: note = derived and/or modified sequence opt3 from anti-HIV_119-051867_VR-Chain
  source 1..324: mol_type = other RNA
cagagcgtgctgacccaacccccttccgtctctgccgctccaggccagaaggttacaatctcatgcagtgggaacagctccaatattggaaacaatttcatatcttggtaccagcagctcccgggtactgcacccaaacttctgatctatgagaacgacagaaggccttcgggcacgccagatcggttttcagggagcaagagtggaacctccgccacattggcgattactggcttacaaaccggtgacgaagctgattactattgtgagacatgggacgggtctggaggcgtgttcggcaccgggactaaagtaacagtgctg

SEQ ID NO: 25363 - RNA, 324 nt, synthetic construct
  misc_feature 1..324: note = derived and/or modified sequence opt3 from anti-HIV_119-051814_VR-Chain
  source 1..324: mol_type = other RNA
cagagcgtgctgacccaacccccttccgtctctgccgctccaggccagaaggttacaatctcatgcagtgggagcaactccaatattggaaacaaagacgtgtcttggtaccagcagataccggcaactgcccccaagctccttatctatgagaataacaaaagaccttcgggtattccagataggttctcaggcagcaagagtgggacgtccgcgaccctggctatcacaggattgcaaactggcgacgaagccgattactattgtgcaacctgggacggtcgggtatctgtgattgggacaggaaccaatgtcatcgtgtta

SEQ ID NO: 25364 - RNA, 321 nt, synthetic construct
  misc_feature 1..321: note = derived and/or modified sequence opt3 from anti-HIV_119-051567_VR-Chain
  source 1..321: mol_type = other RNA
cagagcgtgctgacccaacccccttccgtctctgccgctccaggccagaaggttacaatctactgctcagggagtagaagcaacattggaaggaattatgcatcctggtaccagcagctcccgggtactgcccccaaacttctgatattcgacaacaatcggcgcccttctggcatcccagatcgattttcgggggcgaagtcaggaacgagcgctaccttggccattacaggcttacaaactggtgacgaggcagattatttctgtagtacctggtccgggtctctgaactttggaacaggcacccgtgtgactgtacta

SEQ ID NO: 25365 - RNA, 324 nt, synthetic construct
  misc_feature 1..324: note = derived and/or modified sequence opt3 from anti-HIV_119-051483_VR-Chain
  source 1..324: mol_type = other RNA
cagagcgtgctgacccaacccccttccgtctctgccgctccaggccagaagctcacaatctcatgcagtgggactagctccaacattggaaataactacgtttcttggtatcagcaccttccgggtacggcacccaaactgttgatatacgagaataacagaaggccttcgggcatcccagaacggttctcagccagcaagagtgggacctccgcgacattaggaattactggcctgcagaccggtgacgaggctgattattactgtgaaacatgggacgattctgggggagtgtttggcaccggcactaaagtaacagtgcta

SEQ ID NO: 25366 - RNA, 333 nt, synthetic construct
  misc_feature 1..333: note = derived and/or modified sequence opt3 from anti-HIV_119-050913_VR-Chain
  source 1..333: mol_type = other RNA
cagagcgtgctgacccaacccccttccgtctctgccgctccaggccagaaggttacaatctcatgcagtgggggaactagcaacattggtaataactacgtgtcctggtatcagcagctcccgggcacggcacccagacttctgatatacgagaccaataaaaggccttctgggatcccagaccggttctttggatcgaagtcaggcacaagcgccactttggcgattagtggtttacaaaccggggatgaagctgactattactgtacagtatggggagtgcgcaaaggcgtcggcgccgtgttcgggaccggaactaaggttacagtgctg

SEQ ID NO: 25367 - RNA, 333 nt, synthetic construct
  misc_feature 1..333: note = derived and/or modified sequence opt3 from anti-HIV_119-050187_VR-Chain
  source 1..333: mol_type = other RNA
cagagcgtgctgacccaacccccttccgtctctgccgctccaggccagaaggttacaatctcatgcagtgggagctcctctaacattggtaaaaattcggtgtcatggtaccagcagttcccgggaactgcacccaagctccttatatatgagaacaataaaagacctagcggcatcccagacaggtttagtgattcccaatctgggacgagcgccaccctggcgattacaggattgcagactggcgacgaagctgattactcctgtgccacctgggcagcctcattaaacagtgctcgggtattcggtacagggacccgcgtgactgtcctg

SEQ ID NO: 25368 - RNA, 324 nt, synthetic construct
  misc_feature 1..324: note = derived and/or modified sequence opt3 from anti-HIV_119-049069_VR-Chain
  source 1..324: mol_type = other RNA
cagagcgtgctgacccaacccccttccgtctctgccgctccaggccagaaggttacaatctcatgcagtgggagcacttccaacattggaaaatctgacgtgttctggtaccagcagctcccgggtacggcacccaaacttctgatatcggagacctcaagaaggcctagcggcacaccagatcggtttagtgggtccaagtctggaactagcgccaccttgacaatcaccggcttacaaactggtgacgaagcggattattactgtgaggcttgggacgggtccggaggcgtattcggcacagggaccaaggtgacggtcctg

SEQ ID NO: 25369 - RNA, 333 nt, synthetic construct
  misc_feature 1..333: note = derived and/or modified sequence opt3 from anti-HIV_119-048517_VR-Chain
  source 1..333: mol_type = other RNA
cagagcgtgctgacccaacccccttccgtctctgccgctccaggccagaaggttacaatctcatgcagtgggagcaaattcaacattggaaataaggacgtgtcctggtaccagcactctccgggtactgcacccaaactccttatatatgagaacaataagagaccttcgggcatcccagataggttttcagggagcaaaagtggaacgtccgccaccctgggcatttctggtttgcagacaggggacgaagcggattactgttgcgctgtatggggagtgcggcgcggcgccggcgcagtcttcggggccggaactaaggtgaccgtttta

SEQ ID NO: 25370 - RNA, 333 nt, synthetic construct
  misc_feature 1..333: note = derived and/or modified sequence opt3 from anti-HIV_119-048470_VR-Chain
  source 1..333: mol_type = other RNA
cagagcgtgctgacccaacccccttccgtctctgccgctccaggccagaaggttacaatctcatgcagtgggagcacttccaacattggaaagaatctcgtgtcttggtaccagcagttcccgggtacggcacccaaacttctgatatatgagaacaatagaaggccttcgggcatcccagaccggttttcagggagcaaaagtggaacctccgccacattggtaattactggcttacaaaccggtgatgaagcggacttctactgtgggacatggggaggctctctgcgcgctggcggggtgatcggaaccggtactcgagtcacagtgcta

SEQ ID NO: 25371 - RNA, 282 nt, synthetic construct
  misc_feature 1..282: note = derived and/or modified sequence opt3 from anti-HIV_119-048303_VR-Chain
  source 1..282: mol_type = other RNA
agcgtgctgacccagcccccttccgtctctgccgctccaggccaaaacatcacaatttcatgcagtgggagcatatccaatatcgcatctaacttcatttcgtggtaccagcagctcccgggaactgcccccaagatcattatctatgacaatgatcagagacctcttggtataccagcgaggttttcaggcagcaaaagtggggcttccgccacgctggttatcaccggattgcaaacaggcgacgaggcagattactattgtggtacttgggacgggtct

SEQ ID NO: 25372 - RNA, 333 nt, synthetic construct
  misc_feature 1..333: note = derived and/or modified sequence opt3 from anti-HIV_119-048021_VR-Chain
  source 1..333: mol_type = other RNA
cagagcgtgctgacccaacccccttccgtctctgccgctccaggccagaaggttacaatctcatgcagtgggagctcctctaacattggaaataactacgtgtcgtggtatcagcagctcccgggtactgcacccaaacttctgatatacgacaataacaagagaccttcaggcatcccagataggttcagcgggagtaaatccggaacgtctgccaccttggtaattacaggcttacaaactggtgacgaggcggatttttattgtgggacctgggacggaagcctgtccggcggcggggtgatcggaacaggtacccgggtcactgtgcta

SEQ ID NO: 25373 - RNA, 324 nt, synthetic construct
  misc_feature 1..324: note = derived and/or modified sequence opt3 from anti-HIV_119-047928_VR-Chain
  source 1..324: mol_type = other RNA
cagagcgtgctgacccaacccccttccgtctctgccgctccaggccagaaggttacaatctcatgcagtgggagcaactccaatattggaaacaattgtgtgtcttggtaccagcaggtaccgggtactgcacccaaactccttatatatgagaacaatagaaggccttcgggcatcccagaccggttctcagggagcaagagtggaacgtccgccaccctggcgatttctggcttgcaaacaggtgatgaagctgactactattgcgggacttgggatggaagcggcggcgtgtttgggaccgccacaaaagtcaccgtgtta

SEQ ID NO: 25374 - RNA, 324 nt, synthetic construct
  misc_feature 1..324: note = derived and/or modified sequence opt3 from anti-HIV_119-047384_VR-Chain
  source 1..324: mol_type = other RNA
cagagcgtgctgacccaacccccttccgtctctgccgctccaggccagaaggttacaatctcatgcagtgggagcaactccaatattggaaacaaagacgtgtcttggtacagacaggtaccgcccactgcacctaagctccttatatatgagaataacaaaaggccatcgggtatccccgatcggttctcaggcagcaagagtgggacgtccgccaccctggcgattacaggattgcagactggcgacgaagctgattactattgtgccacctgggacggtcgcgtgtctgtctttgggacaggaaccaaagtggcagtttta

SEQ ID NO: 25375 - RNA, 333 nt, synthetic construct
  misc_feature 1..333: note = derived and/or modified sequence opt3 from anti-HIV_119-047145_VR-Chain
  source 1..333: mol_type = other RNA
cagagcgtgctgacccaacccccttccgtctctgccgctccaggccagacagttaacatctcatgcagtgggagcaattccaacattggatctaagtacgtgtcgtggtatcagcacttcccgggtactgcacccaaactccttatatacgagaataacaagagatcaagcggcatccctgacaggtttagtgggtccaaatctgccacgagcgcgaccctggctattacaggattgcagactggcgatgaagccgactattactgtgcaacctgggccccatccttaaattcagctcgggtattcggtacagggaccaaggtgactgtcctg

SEQ ID NO: 25376 - RNA, 333 nt, synthetic construct
  misc_feature 1..333: note = derived and/or modified sequence opt3 from anti-HIV_119-046752_VR-Chain
  source 1..333: mol_type = other RNA
cagagcgtgctgacccaacccccttccgtctctgccgctccaggccagaaggttacaatctcatgcagtgggaacagctcctctattggaaataacttcgtgtcgtggtaccagcagctcccgggtactgcacccaaacttctggtatatgagaattacagaaggccttcaggcataagcgaccggtttagtgggtccaagtctggaacgagcgccaccttggcgatcacaggcttacaaactggtgatgaagctgactattactgtaccgtgtggggagtccgcaaaggggtgggcgccgttttcggcacagggaccaaggtgactgtcctg

SEQ ID NO: 25377 - RNA, 324 nt, synthetic construct
  misc_feature 1..324: note = derived and/or modified sequence opt3 from anti-HIV_119-046660_VR-Chain
  source 1..324: mol_type = other RNA
cagagcgtgctgacccaacccccttccgtctctgccgctccaggccagaaggttacaatctcatgcagtgggagctcctctaacattggaaatcactacgtgtcgtggtatcagcagctcccgggtactgcacccaaacttctgatatacgacaacaataagagaccttcaggcatcccagataggttcagcgccagtaaatccgggacgtctgcgaccttgggaattacaggcttacaaactggtgacgaggctgattattactgtgccacctgggacgggcgggtaagcgtgatcggaacaggcaccaaggtcactgtggtt

SEQ ID NO: 25378 - RNA, 333 nt, synthetic construct
  misc_feature 1..333: note = derived and/or modified sequence opt3 from anti-HIV_119-046202_VR-Chain
  source 1..333: mol_type = other RNA
cagagcgtgctgacccaacccccttccgtctctgccgctccaggccagaaggttacaatctcatgcagtgggagctcctctaacattggaaataactacgtgtcgtggtatcagcagctcccgggtactgcacccaaacttctggtatacgagaattatagaaggccttcaggcataccagaccggttcagcgggagtaagtccggaacgtctgccaccttggcgatcacaggcttacaaactggtgatgaagctgactaccactgtgccatttggggagtgcgcaaaggggtcggcgcagtgtttggcaccgggacaaaggttaccgtggtc

SEQ ID NO: 25379 - RNA, 333 nt, synthetic construct
  misc_feature 1..333: note = derived and/or modified sequence opt3 from anti-HIV_119-045790_VR-Chain
  source 1..333: mol_type = other RNA
cagagcgtgctgacccaacccccttccgtctctgccgctccaggccagaaggttacaatctcatgcagtgggagctcctctaacattggaaataactacgtgtcgtggtatcagtacctcccgggtactgcacccaaacttctgttctatgaggacaatagaaggccttcaggcacgccagatcggtttagcgggagtaagtccggaacctctgccacattggcgataagcggcttacagactggtgacgaagctgattactattgtaccatctggggagtacgcaaaggggtgggcgccgtcttcggcacagggaccaaggtgactgttctg

SEQ ID NO: 25380 - RNA, 333 nt, synthetic construct
  misc_feature 1..333: note = derived and/or modified sequence opt3 from anti-HIV_119-044670_VR-Chain
  source 1..333: mol_type = other RNA
cagagcgtgctgacccaacccccttccgtctctggcgccccaggggagagagttacaatctcatgcactggaaacacgagtaatattggtacctacgacgtgcagtggtatcagcacctcccgggcacagctcccaggcttctgatataccataacgtaaatttgcctagcggggtgccagatcggttctccgcatctaagtcgggaacttcagccaccttagcgatcacaggcctgcagaccggtgacgaagctgattattactgtactatttggggagtccgcaaaggggtgggcgccgtttttggcacagggaccaaggtgacggtccta

SEQ ID NO: 25381 - RNA, 321 nt, synthetic construct
  misc_feature 1..321: note = derived and/or modified sequence opt3 from anti-HIV_119-044140_VR-Chain
  source 1..321: mol_type = other RNA
cagagcgtgctgacccaacccccttccgtctctgccgctccaggccagaaggttacaatctcatgcagtgggggaactagcaacattggtaatcacttcgtgtcctggtacagacatctcccgggcacggcacccaaacttctgatatatgagaacaataacaggccttctgggatcccagaccggttttcgggagccaagtcaggcaccagcgcgacattggctattactggtttacagaccggggatgaaggagactactattgtgccacatggagtggctccctgaatatcggcaccgggactaaagtaacagtgcta

SEQ ID NO: 25382 - RNA, 333 nt, synthetic construct
  misc_feature 1..333: note = derived and/or modified sequence opt3 from anti-HIV_119-042776_VR-Chain
  source 1..333: mol_type = other RNA
cagagcgtgctgacccaacccccttccgtctctgccgctccaggccagaaggttacaatctcatgcagtgggagctcctctaacattggaaataactacgtgtcgtggtatcagcacctcccgggtactgcacccaaacttctgatatacgagtcagccagaaggcctagcggcacgccagaccggttcagtgggtccaagtctggaaccagcgcgacattggctatcactggcttacagaccggtgatgaagccgactattactgtacactgtggggagtacgcaaaggggtgggcgcagtctttggcaccgggactcgagtgacagttcta

SEQ ID NO: 25383 - RNA, 333 nt, synthetic construct
  misc_feature 1..333: note = derived and/or modified sequence opt3 from anti-HIV_119-042581_VR-Chain
  source 1..333: mol_type = other RNA
cagagcgtgctgacccaacccccttccgtctctgccgctccaggccagaaggttacaatctcatgcagtgggagctcctctaacattggaaataacttcgtgtcgtggtaccagcagctcccgggtactgcacccaaacttctgatatttgagacgcacagaaggccttcaggcatcccagaccggttcagcgggagtaagtccggaacctctgccacattggcgattactggcttacaaagcggtgatgaagctgactattactgtgccgtatggggagtgcgccagggggcaggcgccgtctttggcaccgggacaaaagtgaccgttctg

SEQ ID NO: 25384 - RNA, 333 nt, synthetic construct
  misc_feature 1..333: note = derived and/or modified sequence opt3 from anti-HIV_119-040905_VR-Chain
  source 1..333: mol_type = other RNA
cagagcgtgctgacccaacccccttccgtctctgccgctccaggccagaaggttacaatctcatgcagtgggaacagctccaatattggagacaacttcgtgtcttggtaccagcagctcccgggtatagcacccaaacttctggtatatgagactaataagagaccttcgggcatcccagataggtttgccgggtcaaaaagcggaacgagtgcgaccttggtgattacaggcttacaaactggtgacgaagctgatttctactgtgggacctgggacggatccctgcggacaggcggcgtcatcgggaccggaactcgcgtgacagttcta

SEQ ID NO: 25385 - RNA, 321 nt, synthetic construct
  misc_feature 1..321: note = derived and/or modified sequence opt3 from anti-HIV_119-040322_VR-Chain
  source 1..321: mol_type = other RNA
cagagcgtgctgacccaacccccttccgtctctgccgctccaggccagaaggttgtgatctcatgcagtgggagctcctctattatagagaaaaactcgatctcatggtaccagcagggaccgggtgcagcccccaagctccttatttatgaaaatgacaaaagacctagcggcatcccagataggttcagtgggtccaagtctggaacaactggcacgctggcgattaccggtttgcaaacaggggacgaggctgattacttttgtgccacttggagcggacggttaaacatcggcaccggcacaaaagtaaccgtgctg

SEQ ID NO: 25386 - RNA, 324 nt, synthetic construct
  misc_feature 1..324: note = derived and/or modified sequence opt3 from anti-HIV_119-039892_VR-Chain
  source 1..324: mol_type = other RNA
cagagcgtgctgacccaacccccttccgtctctgccgctccaggccagaaggttacaatctcatgcagtgggagcaacgcaaatattggaaacaaagacgtgtcctggtaccagcagctcccggccactgcgcccaaacttctgatatatgagtctaataagagaccttcgggtatcccagataggttctcaggcagcaagagtgggacgtccgctaccttggccattacaggattacaaactggcgacgaagcagattactattgtgccacctgggacggtcgggtatctgggatcggaacaggcaccaaagtgactgtcctg

SEQ ID NO: 25387 - RNA, 324 nt, synthetic construct
  misc_feature 1..324: note = derived and/or modified sequence opt3 from anti-HIV_119-039764_VR-Chain
  source 1..324: mol_type = other RNA
cagagcgtgctgacccaacccccttccgtctctgccgctccaggccagaaggttacaatctcatgcagtgggagcgcatccaacattggtaaaaatttcgtgtcttggtaccagcaggtaccgggaactgcccccaagctccttatatatgagaacaatagaaggccttcgggcacgccagaccggttttcagggagcaaaagtggaacctccggcacactggcgatctctggtttgcaaactggggatgaagctgactactattgtgagacctgggatggaagcggcggcgtgttcgggacaggaaccaaggtcactgtgtta

SEQ ID NO: 25388 - RNA, 333 nt, synthetic construct
  misc_feature 1..333: note = derived and/or modified sequence opt3 from anti-HIV_119-039188_VR-Chain
  source 1..333: mol_type = other RNA
cagagcgtgctgacccaacccccttccctctctggcgccccagggcagacagtcactatctcatgcagtggaagctcctctaacattggtaataactacgtttcgtggtatcagcagcttccgggcacggctcccaagctgttgatatacgactcaaatagaaggcctagcgggatcccagatcggttcagtggatccaaatctggcaccagcgcaacattagccatttccggtctgcaaactggggacgaggcggattattgttgcgctgtgtggggagtacgccgaggcgccggcgcagtgtttggggccggaaccaaggtcacagtgcta

SEQ ID NO: 25389 - RNA, 321 nt, synthetic construct
  misc_feature 1..321: note = derived and/or modified sequence opt3 from anti-HIV_119-039058_VR-Chain
  source 1..321: mol_type = other RNA
cagagcgtgctgacccaacccccttccgtctctggcgccccagggcagagagttacaatctcatgcactggaagtagctccaacattggtaataactacgtgtcttggtataggcggctcccgggcacggctcccaaacttctgatatacgagaataacaagcgcccttcggggatcccagaccgattctcaggagcaaagagcggcaccagtgccacattggcgattactggtttacagaccggggatgaagctgactatttttgttccacatggtctggaagcctgaatttcggcaccggcactcgtgtaacagtgcta

SEQ ID NO: 25390 - RNA, 321 nt, synthetic construct
  misc_feature 1..321: note = derived and/or modified sequence opt3 from anti-HIV_119-038837_VR-Chain
  source 1..321: mol_type = other RNA
cagagcgtgctgacccaacccccttccgtctctgccgctccaggccagaaggttacaatctcatgcagtgggggaactagcaacattggtaataacttcgtgtcctggtaccagcacctcccgggcacggcacccaaacttctgatatttgagaataacaagagaccttctggggtaccagacaggttctcgggagccaaatcaggcaccagcgcgacattggctatcactggtttacagaccggggatgaaggagactattactgtgccacatggagtggctccctgaatattggcaccgggactaaggtgacagtccta

SEQ ID NO: 25391 - RNA, 321 nt, synthetic construct
  misc_feature 1..321: note = derived and/or modified sequence opt3 from anti-HIV_119-038396_VR-Chain
  source 1..321: mol_type = other RNA
cagagcgtgctgacccaacccccttccgtctctgccacaccaggccagaaggttactatctcatgcagtgggagcaactccaatattggaaacaaatacgtgtcttggtatcagcttttcccgggtacggctcccaagctcctgatatcggagaataacagaaggccttcaggcaccccagaccggtttagcgggagtaaatccggaacatctgcaactttggccatcaccggcttacagacaggtgatgaagcggactactattgtgctacctggagcgggtccctgaatattggaactggcacaaaggtaaccgtgcta

SEQ ID NO: 25392 - RNA, 321 nt, synthetic construct
  misc_feature 1..321: note = derived and/or modified sequence opt3 from anti-HIV_119-036918_VR-Chain
  source 1..321: mol_type = other RNA
cagagcgtgctgacccaacccccttccgtctctgccgctccaggccagaaggttacaatctcatgcagtggggcaactagcaacatttgggaccactacgtgtcctggtatctccaggtaccgggaacggcccccagacttctgatatacgataatgacaaaaggccttctggtatcccagatcggttctcgggctcaaagagcgggaccagtgcgacattggctattactggattacagaccggcgacgagggtgattattactgtgccacatggtccgggtctctgaacatcggaaccggcactaaagtgacagtccta

SEQ ID NO: 25393 - RNA, 324 nt, synthetic construct
  misc_feature 1..324: note = derived and/or modified sequence opt3 from anti-HIV_119-036592_VR-Chain
  source 1..324: mol_type = other RNA
cagagcgtgctgacccaacccccttccgtctctgccgctccaggccagaaggttacaatctcatgcagtgggagcaactccaatactggaaacaaagacgtgtcttggtaccagcaggtaccggcaacggcccccaagctccttatttatgagtcgaataaaagaccttcaggtataccagataggttcagcggcagtaagtccgggacctctgcgacactggctatcactggattgcaaaccggcgacgaagccgattactattgtgcaatttgggacggtcgggtgagcgtcatcgggacaggaaccaaagtgactgtttta

SEQ ID NO: 25394 - RNA, 324 nt, synthetic construct
  misc_feature 1..324: note = derived and/or modified sequence opt3 from anti-HIV_119-036310_VR-Chain
  source 1..324: mol_type = other RNA
cagagcgtgctgacccaacccccttccgtctctgccgctccaggccagaaggttacaatctcatgcagtgggagcacttccaacattggacagaattacgtgtcttggtatcagcaactcccgggtacggcacccaaacttctgatatacgagaacaatagaaggccttcgggctcaccagaccggttcagcgggagtaagtccggaacctctgccacattggcgatcactggcttacagaccggtgatgaagctgactattactgtgagacatgggatgggagcggaggcgtatttggcaccgggactaaagtgacagtcctg

SEQ ID NO: 25395 - RNA, 333 nt, synthetic construct
  misc_feature 1..333: note = derived and/or modified sequence opt3 from anti-HIV_119-035618_VR-Chain
  source 1..333: mol_type = other RNA
cagagcgtgctgacccaacccccttccgtctctgccgctccaggccagaaggttacaatctcatgcagtgggagctccttcactattggaaacaatcacgtgtcttggtaccagcagctcccgggtacggcacccaaacttctgatatttgagtcgcataagagaccttcaggcgtaccagacaggttcagcgggagtaaatccggaacctctgccacattggcgatcactggcttacaaaccggtgatgaagctgactattactgtacagtgtggggagtccggaagggggtgggcgccgtttttggcaccgggactaaagtgacagtcctg

SEQ ID NO: 25396 - RNA, 321 nt, synthetic construct
  misc_feature 1..321: note = derived and/or modified sequence opt3 from anti-HIV_119-035569_VR-Chain
  source 1..321: mol_type = other RNA
cagagcgtgctgacccaacccccttccgtctctggcgccccagggcagacagttactatctcatgcacgggaagtagctccaacattggtggctacgacgtgcactggtatcagcagctcccggggaccgctcccaaacttctgatatacgagaataacagaaggccttctggaacaccagatcggttctcgggcgcaaagtcaggtactagcgccaccttggcgatcacagggttacaaaccggagacgaaggcgattattactgtgctacttggagtggctccctgaatattgggacaggaaccaaggtaacggtgcta

SEQ ID NO: 25397 - RNA, 324 nt, synthetic construct
  misc_feature 1..324: note = derived and/or modified sequence opt3 from anti-HIV_119-035466_VR-Chain
  source 1..324: mol_type = other RNA
cagagcgtgctgacccaacccccttccgtctctgccgctgcaggccagaacgttaatatctcatgcagtgggaagaaaagcaacattggaaataactacgtgtcctggtatcagcagttcccaggtacagccccgaagctccttatatacggcaatactaacagaccctctgggatccctgacaggttttcgggatcaaaaagcggcacgagtgcgaccctggctattacaggtttgcaaactggggatgacgccgattattactgtgagacctgggacggatccggcggcgtattcgggacaggaaccaaggtgactgtctta

SEQ ID NO: 25398 - RNA, 333 nt, synthetic construct
  misc_feature 1..333: note = derived and/or modified sequence opt3 from anti-HIV_119-035157_VR-Chain
  source 1..333: mol_type = other RNA
cagagcgtgctgacccaacccccttccgtctctgccgctccaggccagaaggttacaatctcatgcagtgggagctcctctaacattggaaataacttcgtgtcgtggtaccagcagagaccgggtactgcacccaaactccttatatatgagacgaataagaggccttcaggcatcccagaccggtttagcgggagtaaatccggaacctctgccacactggcgattactggcttgcaaaccggtgatgaagctgactactattgtgccacatgggcaccccgcttaaacagcgcccgagtattcgggaatggaaccatggtgactgtcctg

SEQ ID NO: 25399 - RNA, 333 nt, synthetic construct
  misc_feature 1..333: note = derived and/or modified sequence opt3 from anti-HIV_119-035121_VR-Chain
  source 1..333: mol_type = other RNA
cagagcgtgctgacccaacccccttccgtctctgccgctccaggccagaaggttacaatctcatgcagtgggagcacttcctacattggaaacaaatatgtgtcttggtaccagcagttcccgggtgcagcccccaagctccttatatatgagaataacaaaagaccttcgggcatcccagacaggttttcagcgagcaagagtgctacgtccgccaccctggcaattacagggttgcaaactggagatgaagccgactactgttgcgctgtatggggcgtgcggcgcggtgcaggggccgtcttcggagctggcaccaaagtgacagtttta

SEQ ID NO: 25400 - RNA, 324 nt, synthetic construct
  misc_feature 1..324: note = derived and/or modified sequence opt3 from anti-HIV_119-035046_VR-Chain
  source 1..324: mol_type = other RNA
cagagcgccctgacccaacccgcttccgtgtctggctcacctgggcagagtatcacaattagctgcactggaacgtcctctgacgtcggttacgattatgtttcgtggtacagacaggtgccagcaaccacaccgaagctccttatatatgagaacaataaaaggccctcaggcatccctgaccggttcagcgggagtaagtccggaacttctgccaccctggcgattacaggcttgcagaccggtgatgaagctgactactattgtgccacttgggatgggcgcgtaagcgtgatcggaacaggcaccaaagtcacggtggtt

SEQ ID NO: 25401 - RNA, 324 nt, synthetic construct
  misc_feature 1..324: note = derived and/or modified sequence opt3 from anti-HIV_119-034754_VR-Chain
  source 1..324: mol_type = other RNA
cagagcgtgctgacccaacccccttccgtctctgccgctccaggcgagaaggttacaatctcatgcagtgggagctcctctaacattggaaataactacgtgtcgtggtatcagcagctcccgggtactgtacccaaacttctgatatacgacaataacaagagaccttcaggcacgccagataggttcagcgggagtaaatccggaacctctgcaacattggccatcactggcttacagaccggtgacgaagcggattattactgtgagacatgggacgggagcggaggcgtgtttggcaccgggactaaggtcacagtgctg

SEQ ID NO: 25402 - RNA, 324 nt, synthetic construct
  misc_feature 1..324: note = derived and/or modified sequence opt3 from anti-HIV_119-034318_VR-Chain
  source 1..324: mol_type = other RNA
cagagcgtgctgacccaacccccttccgtctctgccgctccaggccagaagatcacaatttcatgcagtgggagctcctctaacataggaaataacgacgtttcgtggtaccagcagctcccgggtactgcacccaaacttctgatctatgagaatgatagaaggccttcaggcacgccagaccggttcagcgggagtaagtccggaacctctgccacattggcgattactggcttacaaaccggtgatgaagctgactactattgtgagacatgggatgggagcggaggcgtgtttggcaccgggactaaagtaacagtgctg

SEQ ID NO: 25403 - RNA, 333 nt, synthetic construct
  misc_feature 1..333: note = derived and/or modified sequence opt3 from anti-HIV_119-033780_VR-Chain
  source 1..333: mol_type = other RNA
cagagcgtgctgacccaacccccttccgtctctgccgctccaggccagagagttacaatctcatgcagtgggactagctccaacattggagagaattacgtgtcttggtatcagcagataccgggtacggcacccaagctccttatctacgaaaacaataaaaggccttcgggcattccagaccggttctcagggagcaagagtggaacctccgccacactggtaatcactggcttgcaaaccggtgatgaggcggacttttattgtgggacatggggaggctctttacgcaccggcggggtgctgggaactggtacacgagtcaccgtgcta

SEQ ID NO: 25404 - RNA, 333 nt, synthetic construct
  misc_feature 1..333: note = derived and/or modified sequence opt3 from anti-HIV_119-033632_VR-Chain
  source 1..333: mol_type = other RNA
cagagcgtgctgacccaacccccttccgtctctgccgctccaggccagagagttacaatctcatgcagtgggggaagctccaacattggttctaattacgtgtcgtggtatcagcagctcccgggcactgcacccaaacttctgatataccaaaacaataagaggccttcagggatcccagaccggttcagcggaagtaagtccggcacgtctgccaccttgggtattacagggttacagactggagatgaggcggactattactgtaccgtatggggcgtgcgcaaaggcgtcggggctgtgtttggaacaggtaccaaggttactgtgctg

SEQ ID NO: 25405 - RNA, 333 nt, synthetic construct
  misc_feature 1..333: note = derived and/or modified sequence opt3 from anti-HIV_119-033183_VR-Chain
  source 1..333: mol_type = other RNA
cagagcgtgctgacccaacccccttccgtctctgccgctccaggccagatggttacaatctcatgcagtgggggagcaagcaacctcggtaaaaattccgtgtcttggtaccagcagcttccgggcactgcccccaagctgttgatttatgaggacaacagaaggccttcggggacgccagatcggttctcaggaagccgcagtggcacctccgcgacattagctataactggtctgcaaaccggggacgaagccgattactattgtacaatctggggagtacgaaagggcgtgggcgcagtctttgggaccggaactaaagtgacagttcta

SEQ ID NO: 25406 - RNA, 333 nt, synthetic construct
  misc_feature 1..333: note = derived and/or modified sequence opt3 from anti-HIV_119-030696_VR-Chain
  source 1..333: mol_type = other RNA
cagagcgtgctgacccaacccccttccgtctctggcgccccagggcagatcgttacactctcatgcactggagctatgacgaacattggtaataacgacgtgcactggtaccagcatcttccgggcaccgggcccaagctgttgatatatgagaataacaaaagacctagtggaatcccagataggttcagcggctccaagtctggtacatcggcaactttagtaattaccgggctgcagacaggagacgaagccgatttttactgtggcacctgggacggctcactacggactgggggagtgatcggtacaggcacccgcgtcacggtgctc

SEQ ID NO: 25407 - RNA, 324 nt, synthetic construct
  misc_feature 1..324: note = derived and/or modified sequence opt3 from anti-HIV_119-030059_VR-Chain
  source 1..324: mol_type = other RNA
cagagcgtgctgacccaacccccttccgtctctgccgctccaggccagaaggttgtgatctcatgcagtgggagctcctctattatagagaaaaactcgatctcatggtaccagcagggaccgggtgcagcccccaagctccttatttatgaaaatgacaaaagacctagcggcatcagtgataggttctccgggtctaagagcgcgacatccgctactctggccattacgggattgcacaccggcgacgaggcagattactattgtgaaacatgggacggttcagggggagtatttggcactggcaccaaagtgacagtctta

SEQ ID NO: 25408 - RNA, 333 nt, synthetic construct
  misc_feature 1..333: note = derived and/or modified sequence opt3 from anti-HIV_119-029589_VR-Chain
  source 1..333: mol_type = other RNA
cagagcgtgctgacccaacccccttccgtctctgccgctccaggccagaaggttacaatctcatgcagtgggactagctccaacattggaaataacttcgtgtcttggtaccagctccttccgggtacggcacccagactgttgatatatgacaataacaaaaggccttcgggcaccccagatcggttttcagggagcaagagtggaacatccgccactttaggcatcaccggtctgcagacaggggacgaggcggatttctactgtggaacctgggacggctctctacgcactggcggggtaattggaacaggtacccgagtgacggtcctc

SEQ ID NO: 25409 - RNA, 324 nt, synthetic construct
  misc_feature 1..324: note = derived and/or modified sequence opt3 from anti-HIV_119-029448_VR-Chain
  source 1..324: mol_type = other RNA
cagagcgtgctgacccaacccccttccgtctctgccgctccaggccagaaggttacaatctcatgcagtgggaacagctccaatattggaaagaactctgtgtcgtggtaccaccagctcccgggtactgcacccaaacttctgatatatgagaatgacagaaggccttcaggcacgccagatcggttcagcgggagtaaatccggaacctctgccacattggcgatcactggcttacagaccggtgacgaagctgattactattgtgagacatgggacgggagcggaggcgtatttggcaccgggactaaggtgacagtcctg

SEQ ID NO: 25410 - RNA, 333 nt, synthetic construct
  misc_feature 1..333: note = derived and/or modified sequence opt3 from anti-HIV_119-029220_VR-Chain
  source 1..333: mol_type = other RNA
cagagcgtgctgacccaacccccttccgtctctgccgctccaggccagaaggttacaatctcatgcagtgggagcacttccaacattggacagaattacgtgtcttggtatcagcaactcccgggtacggcacccaaacttctgatatacgagaacgacagaaggccttcgggcatcccagatcggttctcagggagcaagagtggaacctccgccacattggcgatttctggcttacagactggtgacgaagctgattattgttgcgccgtatggggagtgcgccgaggggcaggcgccgtctttggccccgggaccaaagtgacagttctg

SEQ ID NO: 25411 - RNA, 333 nt, synthetic construct
  misc_feature 1..333: note = derived and/or modified sequence opt3 from anti-HIV_119-028317_VR-Chain
  source 1..333: mol_type = other RNA
cagagcgtgctgacccaacccccttccgtctctgccgctccaggccagaaggttacaatctcatgcagtgggagctcctctaacattggaaatgactacgtgtcgtggtatcagcagctcccgggtactgcacccaaacttctgatatacgagaacaataagagaccttcaggcatcccagataggttcagcgggagtaaatccggaacgtctgccaccttggcgattacaggcttacaaactggtgacgaagctgattattactgtaccatctggggagtacggaagggggtgggcgccgtctttggcacagggaccaaagtgactgttctg

SEQ ID NO: 25412 - RNA, 324 nt, synthetic construct
  misc_feature 1..324: note = derived and/or modified sequence opt3 from anti-HIV_119-028165_VR-Chain
  source 1..324: mol_type = other RNA
cagagcgtgctgacccaacccccttccgtctctgccgctccaggccagacagttactatctcatgcagtgggattacgagcaacataggaaagaatgacgtgtcctggtaccagcagctcccgggtaccgcacccaaacttctgatctctgagaacaatagaaggccttcgggcattccagatcggttctcagggagcaagagtggaacatccgccactttggcgatcaccggcttacaaacaggtgacgaagctgattattactgtgccatttgggacgggcgcgtatctgtgatcggaaccggcactaaagtcacagtgctg

SEQ ID NO: 25413 - RNA, 324 nt, synthetic construct
  misc_feature 1..324: note = derived and/or modified sequence opt3 from anti-HIV_119-027147_VR-Chain
  source 1..324: mol_type = other RNA
cagagcgtgctgacccaacccccttccgtctctgccgctccaggccagacagttactatctcatgcagtgggagcacgtccgacattggaaagaacgatgtgtcttggtaccagcagctcccgggtatagcacccaaacttctgatctcggagaataacagaaggccttcaggcaccccagaccggttcagcgggagtaagtccggaacatctgccactttggcgattaccggcttacaaacaggtgatgaagctgactattactgtgagacctgggatgggagcggagccgtatttggcactggcacaaaagtgaccgtcctg

SEQ ID NO: 25414 - RNA, 333 nt, synthetic construct
  misc_feature 1..333: note = derived and/or modified sequence opt3 from anti-HIV_119-026743_VR-Chain
  source 1..333: mol_type = other RNA
cagagcgtgctgacccaacccccttccgtctctgccgctccaggccagaacgttacaatctcatgcagtgggagctcctctaatattggaaacaatttcgtgtcgtggtaccagcagagaccgggtactggccccaagctccttatatatgagacgaacaggcggccttcagggatcccagaccgctttagcggaagtaaatccggcacctctgcaacactggccattactggtttgcaaaccggggatgaagcggactactattgtgctacatgggcccccagcttaaattccgcacgagtattcggaaccggcactaaggtgacagtcctg

SEQ ID NO: 25415 - RNA, 333 nt, synthetic construct
  misc_feature 1..333: note = derived and/or modified sequence opt3 from anti-HIV_119-026508_VR-Chain
  source 1..333: mol_type = other RNA
cagagcgtgctgacccaacccccttccgtctctgccgctccaggccagaaggttacaatctcatgcagtgggagctcctctactattggaaacaattacatatcgtggtatcaggtgctcccgggtacggcacccaaacttgtaatcttcaagaacaatgagagaccttcaagggtgccagaccggtttagcggcagtaaatccgggacctctgccacactgggaattactggcttgcagttaggtgatgaaggggactactattgtggaacctgggagacaagcctgtccggcggcggggtcttcggaaccggtactaaggtgacagttcta

SEQ ID NO: 25416 - RNA, 324 nt, synthetic construct
  misc_feature 1..324: note = derived and/or modified sequence opt3 from anti-HIV_119-025683_VR-Chain
  source 1..324: mol_type = other RNA
cagagcgtgctgacccaacccccttccgtctctgccgctccaggccagaaggttacaatctcatgcagtgggagctcctctaacattggaaataactacgtgtcgtggtatcagcagctcccgggtactgcacccaaacttctgatatacgagaataacaagagaccttcaggcatcccagacaggttcagcgatagtcaatccgggacgtctgccaccttggcgattacaggattacagactggcgacgaagctgattattactgtgagacctgggacggtagcgggggagtatttggcacaggcaccaaagtgactgtcctg

SEQ ID NO: 25417 - RNA, 333 nt, synthetic construct
  misc_feature 1..333: note = derived and/or modified sequence opt3 from anti-HIV_119-025614_VR-Chain
  source 1..333: mol_type = other RNA
cagagcctgctcacccaacccccttccgtgtctgccgctccaggccagaacgtcatcatttcatgcagtgggagctcctctaatataggaaagaactacgttgcatggtatcaacaggtgccgggtacagcccccaaaatcgtagtgttcgagactacgaatagaccttcgggcattccagacaggttttcagggagcaagagtggaacctccgcgacacttgctatcactggcctgcagaccggtgatgaagccgactactattgtacagtctggggagtgcggaaaggggttggcgcagtgttcggcaccgggactaaggtcacagtgttg

SEQ ID NO: 25418 - RNA, 324 nt, synthetic construct
  misc_feature 1..324: note = derived and/or modified sequence opt3 from anti-HIV_119-025548_VR-Chain
  source 1..324: mol_type = other RNA
cagagcatcctgacccaacccccttccgtgtctgccgctccaggccagaaggtcacaatttcatgcagtgggagctcctctaacataggaaataactacgtttcgtggtatcagcacgtgccgggtactgcacccaaactccttatctacgagaataacagaaggccttcaggcacgccagaccggttcagcgggagtaagtccggaacctctgccacactggcgattactggcttgcagagcggtgatgaagctgactattactgtgggacctgggatggatccggcggcgtatttgggacaggaaccaaagtgactgtctta

SEQ ID NO: 25419 - RNA, 333 nt, synthetic construct
  misc_feature 1..333: note = derived and/or modified sequence opt3 from anti-HIV_119-025526_VR-Chain
  source 1..333: mol_type = other RNA
cagagcgtgctgacccaacccccttccgtctctgccgctccaggccagaaggttacaatctcatgcagtgggagcgcatccaacattgggaaaaatttcgtgtcttggtaccagcagctcccgggtactgcccccaaacttctgatatatgagaacaatagaaggccttcgggcacgccagaccggttttcagggagcaagagtggaacctccgcgacattggctatcactggcttacaaaccggtgatgaagccgactactattgtacagtatggggagtgcgcaagggagtcggcgcagtgttcggcaccgggactaaagttacagtgctg

SEQ ID NO: 25420 - RNA, 324 nt, synthetic construct
  misc_feature 1..324: note = derived and/or modified sequence opt3 from anti-HIV_119-023552_VR-Chain
  source 1..324: mol_type = other RNA
cagagcgtgctgacccaacccccttccgtctctgccgctccaggccagacagttactatctcatgcagtgggagcacgtccaacattggaaagaatgacgtgtcttggtaccagcagctcccgggtaccgcacccaaacttctgatatcggagaacaatagaaggccttcaggcacaccagatcggttcagcgccagtaagtccgggacttctgcgaccttggctatcacaggattacaaaccggcgacgaagccgattattactgtgagacttggcacggtagcgggggagtatttggcacaggcaccaaagtgacggtcctg

SEQ ID NO: 25421 - RNA, 321 nt, synthetic construct
  misc_feature 1..321: note = derived and/or modified sequence opt3 from anti-HIV_119-023092_VR-Chain
  source 1..321: mol_type = other RNA
cagagcgtgctgacccaacccccttccgtctctgccgctccaggccagaaggttacaatctcatgcagtgggagcacttccgacctcggacagacgagagtgtcttggtaccagcaacttccgaggtcggcacccgagctgttgattttcgaaaacaatcggcgcccttcaggtataccagatcgatttagcggcgccaaaagtgggacctccgcgacattagctatcactggactgcagaccggcgacgaggccgattatttctgttctacatggagcggttccctaaactttgggaccggaactcgtgtaacagtgctc

SEQ ID NO: 25422 - RNA, 324 nt, synthetic construct
  misc_feature 1..324: note = derived and/or modified sequence opt3 from anti-HIV_119-022793_VR-Chain
  source 1..324: mol_type = other RNA
cagagcgtgctgacccaacccccttccgtctctgccgctccaggccagaaggttacaatctcatgcagtgggggaactagcaacattggtaataactacgtgtcctggtatagaaggctcccgggcacggcacccaaacttctgatatacgagaataacaagcggccttctgggatcccagaccgcttctcgggagccaaatcaggcaccagcgcgacattgggtattactgggttacagaccggagatgaagctgactattactgtgagacatgggatgacagtggcggcgtatttgggaccggaactaaggtgacagtcctg

SEQ ID NO: 25423 - RNA, 324 nt, synthetic construct
  misc_feature 1..324: note = derived and/or modified sequence opt3 from anti-HIV_119-022395_VR-Chain
  source 1..324: mol_type = other RNA
cagagcgtgctgacccaacccccttccgtctctgccgctccaggccagacagttactatctcatgcagtgggagcacgtccaacattggaaagaatgacgtgtcttggtaccagcagctcccgggtaccgcacccaaacttctgatatcggataacaatagaaggccttcatggacaccagaccggttcagcggcagtaagtccgggacttctgccaccttggcgatcacaggattacaaaccggcgatgaggctgactattactgtgaaacttgggatggtagcgggggagtatttggccccggcacacgcgtgaccgtcctg

SEQ ID NO: 25424 - RNA, 333 nt, synthetic construct
  misc_feature 1..333: note = derived and/or modified sequence opt3 from anti-HIV_119-022334_VR-Chain
  source 1..333: mol_type = other RNA
cagagcgtgctgacccaacccccttccgtctctgccgctccaggccagaacgttaatatctcatgcagtgggggaagctccaacattggttctaattacgtgtcgtggtatcagcagttcccgggcacagcacccaagcacctcatatacgagaacaataaaagaccttcagggatcccagacaggtttagcgatagtcaatccggaacttctgccacgcttggcattaccggtctgcagacaggggacgaagcggattattactgtggaacttgggacggcagcttgcggaccggcggggtaatcggaacaggtacccgcgtgactgtctta

SEQ ID NO: 25425 - RNA, 321 nt, synthetic construct
  misc_feature 1..321: note = derived and/or modified sequence opt3 from anti-HIV_119-021866_VR-Chain
  source 1..321: mol_type = other RNA
cagagcgtgctgacccaacccccttccgtctctgccgctccaggccagagagttacaatctcatgcagtgggagcgcatccaacattggaaagaatttcgtgtcttggtaccagcagctcccgggtaaagcccccaaacttataatctatgaggtaactaagaggccttcgggcgtgccagcgcggttttcagggagcaagagtggaacgtccgctaccctggccattacaggcttgcaaactggtgacgaagcagattacttctgttctacctggagcgggtccttaaactttggaacaggcacccgcgtcactgtgctg

SEQ ID NO: 25426 - RNA, 324 nt, synthetic construct
  misc_feature 1..324: note = derived and/or modified sequence opt3 from anti-HIV_119-021278_VR-Chain
  source 1..324: mol_type = other RNA
cagagcgtgctgacccaacccccttccgtctctgccgctccaggccagaaggttacaatctcatgcagtgggagcgcatccaacattggaaagaatttcgtgtcttggtaccagcagctcccgggtactgcccccaaacttctgatatatgagaacaatagaaggccttcgggcacgccagaccggttttcagggagccgcagtggaacctccgcgacattgggcatcactggtttacaaaccggggatgaagctcactactattgtgagacatgggacgattctggaggcgtattcggcaccgggactaaagtgacagtcctg

SEQ ID NO: 25427 - RNA, 333 nt, synthetic construct
  misc_feature 1..333: note = derived and/or modified sequence opt3 from anti-HIV_119-021183_VR-Chain
  source 1..333: mol_type = other RNA
cagagcgtgctgacccaacccccttccgtctctgccgctccaggccagaaggttacaatctcatgcagtgggaacagctccaatattggaaacaatttcgtgtcttggtaccagcagtttccgggtactgcacccaaactccttgtattcgagacgcacagaaggccttcgggcataccagaccggttttcagggagcaagagtggaacctccgccacactggcgatcactggcttgcaaaccggtgatgaagctgactattactgtgccgtgtggggagtccgccgaggggtgggcgcagttttcggcgccgggacaaaagtgaccgtctta

SEQ ID NO: 25428 - RNA, 333 nt, synthetic construct
  misc_feature 1..333: note = derived and/or modified sequence opt3 from anti-HIV_119-019376_VR-Chain
  source 1..333: mol_type = other RNA
cagagcgtgctgacccaacccccttccgtctctgccgctccaggccagaaggttacaatctcatgcagtgggagctcctctaacattggaaataactacgtgtcgtggtatcagcaggtaccgggtactgcacccaaactccttgtgtacgagacgtatagaaggccttcaggcataccagaccggttcagcgggagtaagtccggaacctctgccacactggcgatcactggcttgcaaaccggtgatgaagctgactactattgtacaatttggggagtccgcaaaggggtgggcgccgtttttggcaccgggactaaggtgacagtctta

SEQ ID NO: 25429 - RNA, 321 nt, synthetic construct
  misc_feature 1..321: note = derived and/or modified sequence opt3 from anti-HIV_119-019238_VR-Chain
  source 1..321: mol_type = other RNA
cagagcgtgctgacccaacccccttccgtctctgccgctccaggccagaaggttacaatctcatgcagtgggactagctccaacattggaaataaccacgtgtcttggtaccagcaggtaccgggtacggcacccaaactccttatatatgagaataacaagagaccttcgggcatcccagccaggttctcagcggctaaaagcgggaccagtgccacactggcaattactggattgcaaaccggcgacgaagccgattacttttgtgctacatggtccggtcggttaaatatcgggaccggaactaaggtgacagtcctg

SEQ ID NO: 25430 - RNA, 333 nt, synthetic construct
  misc_feature 1..333: note = derived and/or modified sequence opt3 from anti-HIV_119-018500_VR-Chain
  source 1..333: mol_type = other RNA
cagagcgtgctgacccaacccccttccgtctctgccgctccaggccagaaggttaacatctcatgcagtgggagctcctctaatattggaaacaatttcgtgtcgtggtaccagcagagaccgggtacagcacccaaactccttatatatgagactaacaggcggccttcaggcatcccagaccgctttagcgggagtaagtccggaacgtctgccaccctggcgattacaggcttgcaaactggtgatgaagctgactactattgtgccacctgggcagccagcttaacatccgctcgagtattcgggatcggaaccaaagtgactgtcctg

SEQ ID NO: 25431 - RNA, 324 nt, synthetic construct
  misc_feature 1..324: note = derived and/or modified sequence opt3 from anti-HIV_119-018318_VR-Chain
  source 1..324: mol_type = other RNA
cagagcgtgctgacccaacccccttccgtctctgccgctccaggccagacagttatcatttcatgcagtgggagcacttccaacataggaaagaatgacgtgtcttggtaccagcagctcccgggtacggcacccaaacttctgatctcggagaacaatagaaggccttcaggcaccccagatcggttcagcgggagtaagtccggaacatctgccactttggcgattaccggcttacaaacaggtgacgatgctgactattactgtgaaacctgggatgggagcggaggcgtatttggcactgggacaaaagtgaccctggtc

SEQ ID NO: 25432 - RNA, 333 nt, synthetic construct
  misc_feature 1..333: note = derived and/or modified sequence opt3 from anti-HIV_119-018218_VR-Chain
  source 1..333: mol_type = other RNA
cagagcgtgctgacccaacccccttccgtctctgccgctccaggccagaaggttacaatctcatgcagtgggaacagctccaatattggaaacaatttcgtgtcttggtaccagcagctcccgggtactgcacccaaacttctgatatatgagaacaatagaaggccttcgggcatcccagaccggttttcagggagcaagagtggaacgtccgccaccttggcgatttctggcttacaaacaggtgatgaagctgactactggtgtgccgtatggggagtgcgccgaggggcaggcgccgtcttcggcgctgggactaaagtgaccgttctg

SEQ ID NO: 25433 - RNA, 324 nt, synthetic construct
  misc_feature 1..324: note = derived and/or modified sequence opt3 from anti-HIV_119-017876_VR-Chain
  source 1..324: mol_type = other RNA
cagagcgtgctgacccaacccccttccgtctctgccgctccaggccagaaggttacaatctcatgcagtgggagcacttccaaaattggacagaactctgtgtcgtggtaccagcaactcccgggtacggcacccaaacttctgatatatgagaatgacagaaggccttcaggcaccccagatcggttcagcgccagtaagtccgggacatctgcgactttggctatcaccggattacagacaggcgacgaagccgattactattgtgagacctgggacgatagcggtggggtatttggaactggcacaaaggtgaccgtcctg

SEQ ID NO: 25434 - RNA, 324 nt, synthetic construct
  misc_feature 1..324: note = derived and/or modified sequence opt3 from anti-HIV_119-017740_VR-Chain
  source 1..324: mol_type = other RNA
cagagcgtgctgacccaacccccttccgtctctgccgctccaggccagaaggttacaatctcatgcagtgggagcaactccaatattggaaacaaagacgtgtcttggtacagacaggtaccggcaactgcccccaagctccctatatatgagaataaaaacgaaccatcgggtgtgcccgataggttctcaggcagcaagagtgggacgtccgcgacccttgctatcacaggactgcagactggcgacgaggccgattactattgtgcaacctgggacggtcgggtctctgtgattgggacaggaaccaaagttactgtggtc

SEQ ID NO: 25435 - RNA, 321 nt, synthetic construct
  misc_feature 1..321: note = derived and/or modified sequence opt3 from anti-HIV_119-017128_VR-Chain
  source 1..321: mol_type = other RNA
cagagcgtgctgacccaacccccttccgtctctgccgctccaggccagaaggttacaatctcatgcagtgggagctcctctaacattggaaataactacgtgtcgtggtatcagcagctcccgggtactgcacccaaacttctgatatacgagaataacaagagaccttcaggcatcccagacaggttcagcggggccaaaagtggaacgtccgcgaccttggctattacaggcttacaaactggtgatgaagccgactatttttgttctacctggagcgggtccctgaatttcggaacaggcacccgggtaactgtgcta

SEQ ID NO: 25436 - RNA, 324 nt, synthetic construct
  misc_feature 1..324: note = derived and/or modified sequence opt3 from anti-HIV_119-017044_VR-Chain
  source 1..324: mol_type = other RNA
cagagcgtgctgacccaacccccttccgtctctgccgctccaggccagaaggttacaatctcatgcagtgggagcaactccaatattggaaacaattacgtgtcttggtatcaccatctcccgggtactgcacccagacttctgatatacgacaacaataaaaggccttcgggcatcccagatcggttctcagggagcaagagtggaacgtccgccaccttggcgattacaggcttacagactggtgacgaggctgattattactgtgccacctgggacgggcgcgtatctgtgatcggaacaggcacccaggtcactgtgctg

SEQ ID NO: 25437 - RNA, 321 nt, synthetic construct
  misc_feature 1..321: note = derived and/or modified sequence opt3 from anti-HIV_119-016644_VR-Chain
  source 1..321: mol_type = other RNA
cagagcgtgctgacccaacccccttccgtctctgccgctccaggccagaaggttacaatctcatgcagtgggggaactagcaacattggtaataactacgtgtcctggtatcagcagctcccgggcacggcacccaaacttctgatatacgagaataacaagagaccttctgggatcccagccaggttctcggcggctaaatcaggaaccagcgccacattggcaattactggcttacaaaccgaagacgaggccgattattactgtgctacatggagtggttccctgaatatcgggaccggaactaaggtaacagtgcta

SEQ ID NO: 25438 - RNA, 333 nt, synthetic construct
  misc_feature 1..333: note = derived and/or modified sequence opt3 from anti-HIV_119-015878_VR-Chain
  source 1..333: mol_type = other RNA
cagagcgccctgacccaacccccttccgcttctggctcaccagggcagagtgtgacaatcagctgctccggatcttcgtcaaacattggtaataacttcgtcagctggtaccagcagagaccgggcactgcacccaagctccttatatatgagacgaataaaaggcctagtgggatcccagaccggttttccggatctaagagcggcacctccgccacactggcgattactggtttgcaaaccggggatgaagctgactactattgtgccacatgggcaccccgcttaaactcagcccgagttttcggaaatggcaccatggtgactgtactg

SEQ ID NO: 25439 - RNA, 321 nt, synthetic construct
  misc_feature 1..321: note = derived and/or modified sequence opt3 from anti-HIV_119-015538_VR-Chain
  source 1..321: mol_type = other RNA
cagagcgtgctgacccaacccccttccgtctctgccacaccaggccagaaggttactatctcatgcagtgggagctcctctaacattggaaataactacgtgtcgtggtatagaaggctcccgggtacggctcccaaacaccttatatacgagaccaataaccggccttcaggcgtaccagcacgcctgagcgccgcgaagagtgggacatccgctactttggccatcaccggattacagacagaagacgaggcagattattactgtgccacctggtctggcagcctgaatattggtactgggacaaaagtgaccgtccta

SEQ ID NO: 25440 - RNA, 321 nt, synthetic construct
  misc_feature 1..321: note = derived and/or modified sequence opt3 from anti-HIV_119-015455_VR-Chain
  source 1..321: mol_type = other RNA
cagagcgtgctgacccaacccccttccgtctctgccacaccaggccagaaggttactatctcatgcagtgggagcaactccaatattggaaacaaagacgtgtcttggtaccagcacttcccgggtacggctcccaagctccttatatatgagaataacaaaagaccttcgggcatcccagataggttttcagggagcaagagtgcaacctccgccacactgactattaccggattgcagacagaagacgaggcggattactattgtgctacctggtctggcagcttaaatatcggtactgggacaaaagtaaccgtgctg

SEQ ID NO: 25441 - RNA, 321 nt, synthetic construct
  misc_feature 1..321: note = derived and/or modified sequence opt3 from anti-HIV_119-014425_VR-Chain
  source 1..321: mol_type = other RNA
cagagcgtgctgacccaacccccttccgtctctgccgctccaggccagaaggttacaatctcatgcagtgggggaactagcaacattggtaataactacgtgtcctggtatcagcacctcccgggcacggcacccaaacttctgatatacgagaataacaagagaccttctgggatcccagacaggttctcgggagccaaatcaggcaccagcgcgacattggctattactggtttacagaccggggatgaaggagactattactgtgccacatggagtggctccctgaatatcggcaccgggactaaggtaacagtgcta

SEQ ID NO: 25442 - RNA, 324 nt, synthetic construct
  misc_feature 1..324: note = derived and/or modified sequence opt3 from anti-HIV_119-013582_VR-Chain
  source 1..324: mol_type = other RNA
cagagcatggtgacccaatccccctctgtctcagccgctcctggccagaaggttacaatcagttgcagcgggacttcctctaacattggacagaattacgtgtcgtggtatcagcaactgccaggtacggcaccgaaactccttatatcagagaacaatagaaggcccagcggcacccctgaccggttcagtgggtccaagtctggaacaagcgccactctggcgatcaccggcttgcagacaggtgatgaagctgactactattgtgagacctgggatgggtccggaggcgtatttggcactgggacaaaagtgaccgtctta

SEQ ID NO: 25443 - RNA, 333 nt, synthetic construct
  misc_feature 1..333: note = derived and/or modified sequence opt3 from anti-HIV_119-013364_VR-Chain
  source 1..333: mol_type = other RNA
cagagcgtgctgacccaacccccttccgtctctgccgctccaggccagaaggttacaatctcatgcagtgggagctcctctaacattggaaataactacgtgtcgtggtatcagcagctcccgggtactgcacccaaacttctgatatacgacaataacaagagaccttcaggcatcccagataggttcagcgggagtaaatccggaacgtctgccaccttggcgattacaggcttacacactggtgacgaggctgattattactgtaccgtatggggagtgcggaagggggtcggcgccgtgtttggcacagggaccaaagttactgtgctg

SEQ ID NO: 25444 - RNA, 333 nt, synthetic construct
  misc_feature 1..333: note = derived and/or modified sequence opt3 from anti-HIV_119-012886_VR-Chain
  source 1..333: mol_type = other RNA
cagagcatcctgacccaacccccttccgtgtctgccgctccaggccagaaggtcacaatttcatgcagtgggagctcctctactataggaacgaactacgtttcgtggtatcagcagttcccgggtaccgcacccaaactccttgtgtttgagacacacagaaggccttcaggcatcccagaccggttcagcgggagtaagtccggaacttctgccaccctggcgattacaggcttgcaaaccggtgatgaagctgactactattgtgccgtatggggagtgcgccgaggggtcggcgcagtgtttggcgccgggactaaagttacagtgtta

SEQ ID NO: 25445 - RNA, 333 nt, synthetic construct
  misc_feature 1..333: note = derived and/or modified sequence opt3 from anti-HIV_119-012249_VR-Chain
  source 1..333: mol_type = other RNA
cagagcgtgctgacccaacccccttccgtctctggcgccccagggcagaaggttacaatctcatgcagtggaagctcctctaacattggtagaaattacgtgtcgtggtatcagcagctcccgggcactgctcccaaacttctgatatacgagaacaataagaggccttcagggatcccagaccggttcagcggaagtaaatccggcacgtctgcaaccttggtaattacaggtttacaaactggggatgaagccgacttttattgtggaacctgggatggcagcctgtccggcgggggagtgatcggtacaggcacccgcgtcactgtgcta

SEQ ID NO: 25446 - RNA, 324 nt, synthetic construct
  misc_feature 1..324: note = derived and/or modified sequence opt3 from anti-HIV_119-012161_VR-Chain
  source 1..324: mol_type = other RNA
cagagcttcctgacccaacccccttccgtgtctgccgctccaggccagaaggtcacaatctcatgcagtgggagcaactccaatattggaaagaactacgtttcttggtatcagtacctcccgggtactgtgcccaaacttctgatatatgagaatgacaaaagaccttcgggcatcccagggaggttttcagcaagcaagagtggaacgtccgccaccttggcgattacaggcttacagactggtgatgaagctgactactattgtgggacctgggatggatctggcggcgtattcgggacaggaaccaaagtgactgtcctg

SEQ ID NO: 25447 - RNA, 324 nt, synthetic construct
  misc_feature 1..324: note = derived and/or modified sequence opt3 from anti-HIV_119-012110_VR-Chain
  source 1..324: mol_type = other RNA
cagagcgtgctgacccaacccccttccgtctctgccgctccaggccagacagttactatctcatgcagtgggagcacgtccaacattggaaagaatgacgtgtcttggtaccagcagctcccgggtaccgcacccaaacttctgatatcggagaacaatagaaggccttcaggcacaccagatcggttcagcgggagtaagtccggaacttctgccaccttggcgatcagcggcttacaaacaggtgacgaagctgattattactgtgggacctgggacggatccggcggcgtatttgggactggaacaaaagtgaccgtcctg

SEQ ID NO: 25448 - RNA, 333 nt, synthetic construct
  misc_feature 1..333: note = derived and/or modified sequence opt3 from anti-HIV_119-012100_VR-Chain
  source 1..333: mol_type = other RNA
caggccgtgctgacccaaccccctagcgtctccgctgcaccaggccagaaggttgccatctcttgctcagggagtagctccaacattggaaataactacgtgtcttggtatcagcagctcccgggtacagtacccaaacttctgatatacgacactgataagagaccttcgggcatcccagacaggttctcagggagcaaaagtggaacgtccgcgaccttgggcattacacggttacaaactggtgatgaggctgactattactgtgccacctgggcaccccgcctaaattctgcccgagtgtttgggaacggaacaatggtcaccgtgctg

SEQ ID NO: 25449 - RNA, 324 nt, synthetic construct
  misc_feature 1..324: note = derived and/or modified sequence opt3 from anti-HIV_119-011651_VR-Chain
  source 1..324: mol_type = other RNA
cagagcgtgctgacccaacccccttccgtctctgccgctccaggccagaaggttacaatctcatgcagtgggaacagctccaatattggaaacaattacgtgtcttggtatcagcagctcccgggtactgcacccaaacttctgatatacgagaacaataagagaccttcgggcatcccagacaggttctcagggagcaaaagtggaacgtccgccaccttggcgattacaggcttacaaactggtgatgaagctgactattactgtgccacctgggatgggcgggtatctgtgtttggaacaggcaccaaggtcgcagtgctg

SEQ ID NO: 25450 - RNA, 333 nt, synthetic construct
  misc_feature 1..333: note = derived and/or modified sequence opt3 from anti-HIV_119-011479_VR-Chain
  source 1..333: mol_type = other RNA
cagagcgtgctgacccaacccccttccgtctctgccacaccaggccagaaggttactatctcatgcagtgggagcaactccaatattggaaacaaatacgtgtcttggtatcagcacttcccgggtacggctcccaagctccttatatacgagaataacagaaggccttcgggcatcccagaccggttttcagggagcaaaagtggaacctccgcaacactggccattactggcttgcagaccggtgatgaagcggactattactgtacaatctggggagtacgcaagggggtgggcgctgtcttcggcaccgggactaaagtgacagtttta

SEQ ID NO: 25451 - RNA, 333 nt, synthetic construct
  misc_feature 1..333: note = derived and/or modified sequence opt3 from anti-HIV_119-011232_VR-Chain
  source 1..333: mol_type = other RNA
cagagcgtgctgacccaacccccttccgtctctgccgctccaggccagaacgttaatatctcatgcagtgggggaagctccaacattggttctaattacgtgtcgtggtatcagcagttcccgggcacagcacccaagctccttatatacgacgatgacaaaagaccttcagggatcccacacaggtttagcgccagtaagtccggaacttctgcgacgctggctattagcggcttgcaaaccggtgatgaggccgactattgttgcgcagtatggggagtgcggcgcggggccggcgctgtcttcggcgcagggacaaaagtgactgtttta

SEQ ID NO: 25452 - RNA, 333 nt, synthetic construct
  misc_feature 1..333: note = derived and/or modified sequence opt3 from anti-HIV_119-011175_VR-Chain
  source 1..333: mol_type = other RNA
cagagcgtgctgacccaacccccttccgtctctgccgctccaggccagaaggttacaatctcatgcagtgggagcaactcctacattggaaataaatatgtgtcttggtaccagcagttcccgggtactgcacccaagctccttatatatgagaacaatagaaggccttcgggcatcccagaccggttttcagggagcaaaagtggaacgtccgccaccctggcgatttctggcttgcaaacaggtgatgaagctgactactgttgcgccgtatggggagtgcgccgaggggcaggcgccgtcttcggccccgggactaaggtgaccgtttta

SEQ ID NO: 25453 - RNA, 321 nt, synthetic construct
  misc_feature 1..321: note = derived and/or modified sequence opt3 from anti-HIV_119-008396_VR-Chain
  source 1..321: mol_type = other RNA
cagagcgtgctgacccaacccccttccgtctctgccgctccaggccagaaggttacaatctcatgcagtgggagctcctctaacattggaaataactacgtgtcgtggtatcagcaggtaccgggtactgcacccaaactccttgtgtacgagaatacgagaaggccttcaggcgtcccagaccggttcagcggggccaagagtggaacctccgcgacactggctataactggcttgcaaaccggtgatgaaggggactattactgtgccacatggtctggcagcttaaacatcggaaccggcactaaagtgacagttctg

SEQ ID NO: 25454 - RNA, 324 nt, synthetic construct
  misc_feature 1..324: note = derived and/or modified sequence opt3 from anti-HIV_119-007148_VR-Chain
  source 1..324: mol_type = other RNA
cagagcgtgctgacccaacccccttccgtctctgccgctccaggccagaaggttacaatctcatgcagtgggagcacttccaacattggaaagaattacgtgtcttggtatcagcacctcccgggtacggcacccaaacttctgttgtacgagaacgacagaaggccttcgggcaccccagatcggttctcagggagcaaaagtggaacatccgccactttagcgataaccggcctgcatacaggtgacgaagctgattattactgtgagacctgggacgggtctggaggcgtatttggcactgggacaaaggtgaccgtccta

SEQ ID NO: 25455 - RNA, 333 nt, synthetic construct
  misc_feature 1..333: note = derived and/or modified sequence opt3 from anti-HIV_119-007029_VR-Chain
  source 1..333: mol_type = other RNA
cagagcgtgctgacccaacccccttccgtctctgccgctccaggccagaaggttacaatctcatgcagtgggaacagctccaatattggaaacaatttcgtgtcttggtaccagcaggtaccgggtactgcacccaaactccttctgtatgagacgtacagaaggccttcgggcatatcagaccggtttagcgggagtaagtccggaacctctgccacattggcgatcactggcttacaaaccggtgatgaagctgactattactgtacagtgtggggagtccgcaaaggggtgggcgccgttttcggcaccgggactaaggtgacagtcctg

SEQ ID NO: 25456 - RNA, 324 nt, synthetic construct
  misc_feature 1..324: note = derived and/or modified sequence opt3 from anti-HIV_119-004707_VR-Chain
  source 1..324: mol_type = other RNA
cagagcgtgctgacccaacccccttccgtctctgccgctccaggccagaaggttacaatctcatgcagtgggagcacttccaacattggaaagaatgacgtgtcttggtaccagcagctcccgggtacggcacccaaacttctgatatcggagaacaatagaaggccttcaggcaccccagatcggttcagcgggagtaaatccggaacatctgccactttggcgatcaccggcttacaaacaggtgacgaagctgattattactgtgagacctgggacgggagcggaggcgtatttggcactgggacaaaggtgaccgtcctg

SEQ ID NO: 25457 - RNA, 333 nt, synthetic construct
  misc_feature 1..333: note = derived and/or modified sequence opt3 from anti-HIV_119-003910_VR-Chain
  source 1..333: mol_type = other RNA
cagagcgtgctgacccaacccccttccgtctctgccgctccaggccagaaggttgcaatctcatgcagtgggaacacaagctccattggaaataacttcgtgtcttggtaccagcaggtaccgggtactgcccccaaactccttgtgtatgagacgtacagaaggccttcgggcataccagaccggttttcagggagcaagagtggaacctccgcgacactggctatcactggcttgcaaaccggtgatgaagccgactattactgtacagtctggggagtgcgcaaaggggttggcgcagtgttcggcaccgggactaaggtcacagtgtta

SEQ ID NO: 25458 - RNA, 321 nt, synthetic construct
  misc_feature 1..321: note = derived and/or modified sequence opt3 from anti-HIV_119-002450_VR-Chain
  source 1..321: mol_type = other RNA
cagagcgtgctgacccaacccccttccgtctctggcgccccagggcagagagttacaatctcatgcactggaagtagctccaacattggtaataactacgtgtcttggtatcagggcctcccggggacggctcccaaacttctgatatacgagaataacaagaggccttcgggaatcccagaccggttctcaggcgcaaagagcggtaccgccgcgacattggctattactgggttacagaccggagatgaagccgactattactgtgcaacatggagtggctccctgaattttggcaccgggactaaagtaacagtgcta

SEQ ID NO: 25459 - RNA, 321 nt, synthetic construct
  misc_feature 1..321: note = derived and/or modified sequence opt3 from anti-HIV_119-001552_VR-Chain
  source 1..321: mol_type = other RNA
cagagcgtgctgacccaacccccttccgtctctgccgctccaggccagaaggttacaatctcatgcagtgggagcaactcctacctcggaaataaatatgtgtcttggtaccagcagttcccgggtactgcacccaaacttctgatttatgagaacaataagagaccttcgggcataccagacaggttttcagccagcaagagtgcggcttccgccacgttggcaatcaccgggttacaaacaggagatgaaggcgactactattgtgccacttggaccggttctctgaacattgggacaggaaccaaagtaactgtgcta

SEQ ID NO: 25460 - RNA, 333 nt, synthetic construct
  misc_feature 1..333: note = derived and/or modified sequence opt3 from anti-HIV_059-188169_VR-Chain
  source 1..333: mol_type = other RNA
cagagcgtgctgacccaacccccttccgtctctgccgctccaggccagaaggttacaatctcatgcagtgggagcacttccaacattggagacaattacgtgtcttggtatcagcaggtaccgggtacggcacccaaactccttatatacgagaacaatagaaggccttcgggcaccccagatcggttctcagggagcaagagtggaacatccgccactctggcgatcaccggcttgcaaacaggtgacgaagctgattattactgtgggacctgggacacttctttaagcacaggaggcgtgtttggcaccgggacgaaagtcactgtgctg

SEQ ID NO: 25461 - RNA, 333 nt, synthetic construct
  misc_feature 1..333: note = derived and/or modified sequence opt3 from anti-HIV_059-183739_VR-Chain
  source 1..333: mol_type = other RNA
cagagcgtgctgacccaacccccttccgtctctgccgctccaggccagaaggttacaatctcatgcagtgggagcacttccaacattggaaagaattacgtgtcttggtatcagcagctcccgggtacggcacccaaacttctgatatacgagaacaatagaaggccttcgggcaccccagaccggttctcagggagcaaaagtggaacatccgccactttgggcatctctggtttacaaaccggggatgaagcggactattactgtggaacatgggataccagcctgtccggcggcggggtatttggaactggtacaaaggtgaccgtccta

SEQ ID NO: 25462 - RNA, 333 nt, synthetic construct
  misc_feature 1..333: note = derived and/or modified sequence opt3 from anti-HIV_059-182376_VR-Chain
  source 1..333: mol_type = other RNA
cagagcgtgctgtcccaacccccttctgtctcagccgctccaggccagaaggttaccatcagttgcagcgggtcctcttcgaacattggaaattactatgtgtcatggtaccagcagttcccgggtacagcacccaaactccttatatataagaacgacaatagacctagcggcatcccagataggtttagtgggtccaaatctggaactagcgccacgctgggcatttccggtttgcaaaccggggacgaggcggattactattgtggaacatggggcacttcattaagtggcgggggagtattcggtaccggcacaaaggtgaccgtcctg

SEQ ID NO: 25463 - RNA, 333 nt, synthetic construct
  misc_feature 1..333: note = derived and/or modified sequence opt3 from anti-HIV_059-182199_VR-Chain
  source 1..333: mol_type = other RNA
cagagcgtgctgacccaacccccttccgtctctgccgctccaggccagaacatcacaatttcatgcagtgggagctcctctaatataggatcgcactcaatcagctggtaccagcatctcccgggtactgcacccaagattgttatctatgacaacgataaaagacctcttggcattccagacaggttcagtgggtccaagtctggaacgagcgccaccctgggcatcacaggtttgcagactggggatgaggcggactactattgtggaacctgggatacatccttatcaggcggcggggtgtttggacccggtaccaaagtaactgtgctg

SEQ ID NO: 25464 - RNA, 324 nt, synthetic construct
  misc_feature 1..324: note = derived and/or modified sequence opt3 from anti-HIV_059-169202_VR-Chain
  source 1..324: mol_type = other RNA
cacagcgtgctgacccagcccccttccgtctctgccgctccaggccaaaaggttacaatctcatgcagtgggagctcctctaaaattggaaacaatttcgtgtcgtggtaccagcagctcccgggtactgcacccaaacttctgatatatgagaacaataagagaccttcaggcatcccagacaggtttagcgggagtaagtccggaacgtctgccaccttggcgattacaggcttacagactggtgatgaagctgactactattgtgggacctgggatggacgggtaagcgtgatcggctccggcacaaaactgaccgtccta

SEQ ID NO: 25465 - RNA, 324 nt, synthetic construct
  misc_feature 1..324: note = derived and/or modified sequence opt3 from anti-HIV_059-155645_VR-Chain
  source 1..324: mol_type = other RNA
cagagcgccctgacccaacccgcttccgtgtctggctcacctgggcagagtatcacaattagctgcactggaacgtcctctgacgtcggttacaactatgtttcgtggtaccagcagctcccaggcaccgcaccgaaacttctgatatatgagaataacaagagaccctcagggatccctgataggttcagcggaagtaagtccggcacatctgccactttggcgattaccggtttacaaacaggggacgaagctgattactattgtggaacctgggacggccggctgagcgtgatcggcactgggacaaaagtaaccgtgcta

SEQ ID NO: 25466 - RNA, 333 nt, synthetic construct
  misc_feature 1..333: note = derived and/or modified sequence opt3 from anti-HIV_059-151619_VR-Chain
  source 1..333: mol_type = other RNA
cagagcgtgctgacccaacccccttccgtctctgccgctccaggccagaaggttacaatctcatgcagtgggagctcctctaacattggaaataacttcgtgtcgtggtaccagctccttccgggtactccccctaaactgttgatatttaagaataacgagagaccatcaggcatccccgacaggttcagcgggagtaaatccggaacgtctgcaaccttaggcattacaggtctgcagactggggatgaaggagactattactgtggcacctgggatacaagcctatccggcgggggagtatttggtaccggcactcgggtgacagtcctc

SEQ ID NO: 25467 - RNA, 333 nt, synthetic construct
  misc_feature 1..333: note = derived and/or modified sequence opt3 from anti-HIV_059-146503_VR-Chain
  source 1..333: mol_type = other RNA
cagagcgtgctgacccaacccccttccgtctctgccacaccaggccagaaggttactatctcatgcagtgggagcgcttccaacattggaaataactacgtgtcttggtatcagcagttcccgggtacggcacccaaactccttatatacgacaccaataagagaccttcgggcatcccagataggttttcagggagcaaaagtggaacatccgccattctgggcatcactggtttgcaaattggggacgaggcggattattactgtggaacctgggacacatctttaagcggcggcggggtattcggaaccggtactaaggtgacagtcctg

SEQ ID NO: 25468 - RNA, 324 nt, synthetic construct
  misc_feature 1..324: note = derived and/or modified sequence opt3 from anti-HIV_059-136098_VR-Chain
  source 1..324: mol_type = other RNA
cagagcgtgctgacccaacccccttccgtctctgccgctccaggccagagagttacaatctcatgcagtgggagctcctctaacattggaaataactacgtgtcgtggtatcagcagctcccgggtactgcacccaaacttctgatatacgagaataacaggcggccttcaggcatcccagaccgcttcagcgggagtaagtccggaacgtctgccaccttggcgattacaggcttacaaactggtgatgaaggggactattactgtgctcgatgggatggacgtctgagcgtaatcggctccggcaccaaggtgacagtccta

SEQ ID NO: 25469 - RNA, 333 nt, synthetic construct
  misc_feature 1..333: note = derived and/or modified sequence opt3 from anti-HIV_059-105516_VR-Chain
  source 1..333: mol_type = other RNA
cagagcgccctgacccaacccccttccgtgtctgctgcaccaggccagaaggtcacaatctcatgcagtgggagctcctctaacattggaaataactacgtttcgtggtatcagcagctcccgggtactgcccccaaacttctgatatacgacaataacaagagaccttcaggcatcccagataggttcagcgggagtaaatccggaacgtctgcgaccttggctattgccggcttacaaacaggtgacgaggcaaattattactgtgggacttgggatggaagcctgcggaccggcggcgtgtttgggacaggaaccaaggtaactgtgcta

SEQ ID NO: 25470 - RNA, 333 nt, synthetic construct
  misc_feature 1..333: note = derived and/or modified sequence opt3 from anti-HIV_059-095709_VR-Chain
  source 1..333: mol_type = other RNA
cagagcgtgctgacccaacccccttccgtctctgccgctccaggccagaaggttacaatctcatgcagtgggagaagctccaacattggaaataacttcgtgtcttggtaccagctccttccgggtactgcacccaaactgttgatatataagaataacgagaggccttcgggcatcccagaccggttttcagccagcaaaagtgggacgtccgcgaccttaggaattacaggcctgcagactggtgatgaagctgactactattgtgggacctgggatacatctctaagcggaggcggcgtattcgggaccggaactaaggtgacagtcctc

SEQ ID NO: 25471 - RNA, 333 nt, synthetic construct
  misc_feature 1..333: note = derived and/or modified sequence opt3 from anti-HIV_059-069468_VR-Chain
  source 1..333: mol_type = other RNA
cagagcgtgctgacccaacccccttccgtctctggcgccccaagacagtcagttatcattagttgcacagggagctcctctaacataggaggtttcgacgtgcactggtaccagcagctcccgggcactgctcccaaacttctgatctatgagaataacaggcggccttcggggacgccagatcgcttttcaggaagcaagagtggcacctccgcaacattggccattactggtttacaaaccggggacgaagcggattactattgtggaacatgggacggctctctgagcaccggcggggtaatcggaactggtacaaaggtgaccgtccta

SEQ ID NO: 25472 - RNA, 333 nt, synthetic construct
  misc_feature 1..333: note = derived and/or modified sequence opt3 from anti-HIV_059-060026_VR-Chain
  source 1..333: mol_type = other RNA
cagagcgtgctgacccaacccccttccgtctctgccgctccaggccagaaggttacaatctcatgcagtgggagctcctctaacattggaaataactacgtgtcgtggtatcagcagctcccgggtactgtacccaaacttctgatatacaagaatgacaaaagaccttcaggcatcccagataggttcagcgggagtaagtccgcaacgtctgccaccttgggaattacaggcttacaaactggtgacgaggcggattattactgtgggatctgggacaccagcctgtccgctggaggcgtgtttggcacagggacccgggtcactgtgcta

SEQ ID NO: 25473 - RNA, 333 nt, synthetic construct
  misc_feature 1..333: note = derived and/or modified sequence opt3 from anti-HIV_059-053668_VR-Chain
  source 1..333: mol_type = other RNA
cagagcgtgctgacccaacccccttccgtctctgccgctccaggccagaaggttacaatctcatgcagtgggagctcctctaacattggaaataactacgtgtcgtggtatcagcagctcccgggtactgcacccaaacttctgatatacgagaataacaagagatcaagcggcatccctgacaggttcagtgggtccaaatctggaacgagcgccaccttggcgattacaggcttacaaactggtgatgaagctgactattactgtgggacccgggattcctcactgagtggaggcggcgtaatcgggacaggaaccaaggtgactgtccta

SEQ ID NO: 25474 - RNA, 333 nt, synthetic construct
  misc_feature 1..333: note = derived and/or modified sequence opt3 from anti-HIV_059-052864_VR-Chain
  source 1..333: mol_type = other RNA
cagagcgtgctgacccaacccccttccctctctgccgctccaggccagagagtcacaatctcatgcagtgggagctcctctaacattggaaataactacgtttcgtggtatcagcagcttccgggtactgcacccaagctgttgatatacgagtcaaataaaaggcctagcggcacgccagaccggttcagtgggtccaagtctggaaccagcgccacattagcgatcactggcctgcaaaccggtgatgaagctgactattactgtgggacatgggatgcctccctatcaagtggaggcgtgatgggcaccgggactaaagtaacagtgctc

SEQ ID NO: 25475 - RNA, 333 nt, synthetic construct
  misc_feature 1..333: note = derived and/or modified sequence opt3 from anti-HIV_059-050968_VR-Chain
  source 1..333: mol_type = other RNA
cagagcgtgctgacccaagccccctccgtctctgctgcacctggcgagaaggttacaatctcatgcagtgggactagctccaacattggatactattacgtgtcttggtatcagcagttcccaggtacggccccgaaagtagtgatatacgaaaataacagaaggccctcgggcacccctgaccggttttcagggagcaagagtggaacatccgcgactctcgctatcaccggccttcagacaggtgatgaggccgactattactgtgggacctggggaggctctctgagcactggcggggtcattggaacaggtaccaaagtgacggttttg

SEQ ID NO: 25476 - RNA, 333 nt, synthetic construct
  misc_feature 1..333: note = derived and/or modified sequence opt3 from anti-HIV_059-046422_VR-Chain
  source 1..333: mol_type = other RNA
cagagcgtgctgacccaacccccttccgtctctgccgctccaggccagaaggttacaatctcatgcagtgggagctcctctactattggaaacaattacatatcgtggtatcagctccttccgggtacgccccctaactacctgatcttcaaaatttcagagagaccaagcggcgtgcccgacaggtttagtgggtccaagtctggaaccagcgcaacattgcacatcactggcttacagaccggtgatgaaggggactattactgtggaacatgggatacctccctgtcaggcggcggggtattcggaactggtacaaaagtgaccgtccta

SEQ ID NO: 25477 - RNA, 333 nt, synthetic construct
  misc_feature 1..333: note = derived and/or modified sequence opt3 from anti-HIV_059-045120_VR-Chain
  source 1..333: mol_type = other RNA
cagagcgtgctgacccaacccccttccgtctctgccgctccaggccagaaggttgcaatctcatgcagtgggagctcctctacaattggaaacaattacgtgtcgtggtatcagctccttccgggtactccccctaaactgttgatattcaagtcacacgagagaccaagcggcatccccgacaggtttagtgggtccaaatctggaacgagcgccaccttaggcattacaggtctgcagactggggatgaaggagactactattgtggcacctgggattcctcactaagtgtaggcggggtgttcggaacaggtaccaaggtcactgtgctc

SEQ ID NO: 25478 - RNA, 333 nt, synthetic construct
  misc_feature 1..333: note = derived and/or modified sequence opt3 from anti-HIV_059-039932_VR-Chain
  source 1..333: mol_type = other RNA
cagagcgtgctgacccaacccccttccgtctctgccgctccaggccagaaggttacaatctcatgcagtgggagctcctctattataggaaagaactacgtgtcgtggtatcagcacctcccgggtactgcacccaaacttctgatctacgagaataacaaaagaccttcaggcattccagacaggttcagcgggagtaagtccggaacgtctgccaccttggcgatcgctggcttacagacaggtgatgaagccaattattactgtgggacttggggaggcagcctgtccaccggcggggtatttggaacaggtaccaaagtgactgtccta

SEQ ID NO: 25479 - RNA, 333 nt, synthetic construct
  misc_feature 1..333: note = derived and/or modified sequence opt3 from anti-HIV_059-038595_VR-Chain
  source 1..333: mol_type = other RNA
cagagcgtgctgacccaacccccttccgtctctgccgctccaggccagaaggttacaatctcatgcagtgggagaagctccaacattggaaataacttcgtgtcttggtaccagcagctcccgggtactgcacccaaacttctgatatatgagaataacaagaggccttcgggcatcccagaccggttttcagggagcaaaagtggaacgtccgccaccttgggcattacaggtttacaaactggggatgaagcggactactattgtggaacctgggatacatctctgagcgctggcggcgtattcgggtccggaaccaaggtgatcgtccta

SEQ ID NO: 25480 - RNA, 333 nt, synthetic construct
  misc_feature 1..333: note = derived and/or modified sequence opt3 from anti-HIV_059-035082_VR-Chain
  source 1..333: mol_type = other RNA
cagagcgtgctgacccaacccccttccgtctctgccgctccaggccagaaggttacaatctcatgcagtgggagcacttccaacattggaaaatctttcgtgtcgtggtaccagcagctcccgggtacggcacccaaacttctgatatatgacaataacagaaggccttcaggcaccccagatcggtttagcgggagtaagtccggaacatctgccactttggcgatcaccggcttacaaacaggtgacgaggctgattactattgtgggacctggggaggcagcctgtccactggcggggtaattggaacaggtaccaaggtgacggtccta

SEQ ID NO: 25481 - RNA, 333 nt, synthetic construct
  misc_feature 1..333: note = derived and/or modified sequence opt3 from anti-HIV_059-029204_VR-Chain
  source 1..333: mol_type = other RNA
cagagcgtgctgacccaacccccttccgtctctgccgctccaggccagaaggttacaatctcatgcagtgggagcacttccaacattggaaaaatactcgtgtcttggtaccagcagcttccgggtacggcacccaagccttcgatctatgacaataacagaaggccatcaggcacccccgatcggttcagcgggagtaaatccggaacatctgccactctggcgattaccggcttgcaaacaggtgacgaggctgattactattgtgggacctgggacggcagcttatccactggaggcgtaatcgggacaggaaccaaggtgacggtccct

SEQ ID NO: 25482 - RNA, 324 nt, synthetic construct
  misc_feature 1..324: note = derived and/or modified sequence opt3 from anti-HIV_059-025235_VR-Chain
  source 1..324: mol_type = other RNA
cagagcgtgctgacccaacccccttccgtctctggcgccccagggcagaagatcacaatttcatgcagtggaagcacttccaacataggtaaatcttacgtttcgtggtatcagcagctcccgggcacggctcccaaacttctgatctacgagaataacagaaggccttcagggaccccagaccggttcagcggaagtaagtccggcacatctgcaactttggccattaccggtttacaaacaggggatgaagcggactattactgtggaacctgggatggcagcggcggggtgatcggaactggtacaaaggtaaccgtgctg

SEQ ID NO: 25483 - RNA, 333 nt, synthetic construct
  misc_feature 1..333: note = derived and/or modified sequence opt3 from anti-HIV_059-015192_VR-Chain
  source 1..333: mol_type = other RNA
cagagcgtgctgacccaacccccttccgtctctgccgctccaggccagaaggttacaatctcatgcagtgggagctcctctactattggagacaaatacgtgtcgtggtatcagctccttccgggtacggcacccaagctgttgatatacaaaaacaataagagaccttcaggcatcccagataggttcagcgggagtaaatccggaacctctgccacattaggcattactggtctgcagaccggggacgaggcggattattactgtggaacatgggacaccagcctatccgtaggcggcgtgtttgggactggaacaaaggtcaccgtgctc

SEQ ID NO: 25484 - RNA, 333 nt, synthetic construct
  misc_feature 1..333: note = derived and/or modified sequence opt3 from anti-HIV_059-007060_VR-Chain
  source 1..333: mol_type = other RNA
cagagcgtgctgacccaacccccttccgtctctgccgctccaggccagaaggttacaatctcatgcagtgggagctcctctaacattggaaataaatacgtgtcgtggtatcagcagctcccgggtactgcacccaaacttctgatatacgagaacaagaagagaccttcaggcatcccagacaggttcagcgggagtaaatccggaacgtctgccaccttgggcattacaggtttacaaactggggatgaagcggactatttttgtggaacctgggatacaagcctgtccggcggcggggtattcggatcaggtaccaaggtgactgtccta

SEQ ID NO: 25485 - RNA, 324 nt, synthetic construct
  misc_feature 1..324: note = derived and/or modified sequence opt3 from anti-HIV_059-006953_VR-Chain
  source 1..324: mol_type = other RNA
cagagcgtgctgacccaacccccttccgtctctgccgctccaggccagaaggttacaatctcatgcagtgggagctcctctaacattggagtgtcgtggtaccagcaggtaccgggtactgcacccaaactccttatatatgacaatgataagagacctacgggcatcccagacaggttctcagggagcaaaagtggaacctccgccattctggcgatcacaggcttgcaaactggtgatgagggggactactattgtggaacctgggaaacatctttaagcggcggcggggtgtttggaaccggtactaaggtcacagtgctg

SEQ ID NO: 25486 - RNA, 333 nt, synthetic construct
  misc_feature 1..333: note = derived and/or modified sequence opt3 from anti-HIV_059-005953_VR-Chain
  source 1..333: mol_type = other RNA
cacagcgtgctgacccagcccccttccgtctctgccgctccaggccaaaaggttacaatctcatgcagtgggactagctccaacattggaaagaattacgtgtcttggtatcagcagctcccgggtacggcacccaaacttctgatatacgagaacaatagaaggccttcgggcaccccagaccggttctcagggagcaaaagtggaacatccgccactttggcgatcaccggcttacagacaggtgatgaagctgactattactgtgggacctgggatacttctctgagcacaggaggcgtatttggcaccgggacgaaggtgactgtccta

SEQ ID NO: 25487 - RNA, 324 nt, synthetic construct
  misc_feature 1..324: note = derived and/or modified sequence opt3 from anti-HIV_059-003725_VR-Chain
  source 1..324: mol_type = other RNA
cagagcgtgctgacccaacccccttccgtctctgccgctccaggccagaagctcacaatctcatgcagtgggagcacttccaaaattggaaacaattacgtttcttggtatcagcaccttccgggtacggcacccaagctgttggtgtacgagaacaataaaagaccttcgggcataccagacaggttctcagggagcaagagtggaacctccgccacattagcgatcactggcctgcagaccggtgatgaagctgactattactgtgggacatgggatggacggctatctgtaattggcaccggcactaaagtgacagtcctc

SEQ ID NO: 25488 - RNA, 333 nt, synthetic construct
  misc_feature 1..333: note = derived and/or modified sequence opt3 from anti-HIV_059-002618_VR-Chain
  source 1..333: mol_type = other RNA
cagctggtgctcacccaaccccctagcgtctccgccgctccaggccagaaggttacaatctcttgctcagggagtagctccaacattggaaataacttcgtgtcttggtaccagcagcttccgggtactgcacccaaactgttgatatatgagaataacaagagaccttcgggcatcccagacaggttttcagggagcaaaagtggaacgtccgccaccttaggcattacaggtctgcaaactggggatgaagcggactactattgtggaacctgggatacacggctatctgctggcggcgtattcgggaccggaactaaggtgacagtcctc

SEQ ID NO: 25489 - RNA, 324 nt, synthetic construct
  misc_feature 1..324: note = derived and/or modified sequence opt3 from anti-HIV_059-001522_VR-Chain
  source 1..324: mol_type = other RNA
cagagcgtgctgacccaacccccttccgtctctgccgctccaggccagaaggttacaatctcatgcagtgggagcaactccaatattggaaacaattacgtgtcttggtatcagcagctcccgggtactgcacccaaacttctgatatacgagaacaataagagaccttcgggcatcccagacaggttctcagggagcaaaagtggaacgtccgccaccttggcgattacaggcttacaaactggtgatgaagctgactattactgtgggacctgggatggacggctgtctgtaatcggcgccggcacaaaggtgattgtcgtg

SEQ ID NO: 25490 - RNA, 333 nt, synthetic construct
  misc_feature 1..333: note = derived and/or modified sequence opt3 from anti-HIV_059-000731_VR-Chain
  source 1..333: mol_type = other RNA
cagagcgtgctgacccaacccccttccgtctctgccgctccaggccagaaggttacaatctcatgcagtgggagcacttccaacattggaaataaatacgtgtcttggtatcagcaggtaccgggtacggcacccaagctccttatatacgagaacaatagaaggccttcgggcatcccagaccggttctcagggagcaaaagtggaacctccgccacactggcgattactggcttgcaaaccggtgatgaagctgactattactgtgggacatgggatgcctctttacgcaccggaggcgtgatcggcactgggacaaaggtcaccgtgctg

SEQ ID NO: 25491 - RNA, 333 nt, synthetic construct
  misc_feature 1..333: note = derived and/or modified sequence opt3 from anti-HIV_059-000634_VR-Chain
  source 1..333: mol_type = other RNA
cagagcgtgctgacccaacccccttccgtctctgccgctccaggccagaaggttacaatctcatgcagtgggagctcctctactattggaaacaattacgtgtcgtggtatcaggtagtgccgggtacggcacccaaactccttatatacaagatcaacgagagaccttcaggcattccagacaggttcagcgggagtaaatccggaacctctgccacactgggcatcactggtttgcagaccggggatgaagcggactattactgtggaacatgggataccagcttatccggcggcggggtctttggacccggtactaaggtgacagttctg

SEQ ID NO: 25492 - RNA, 333 nt, synthetic construct
  misc_feature 1..333: note = derived and/or modified sequence opt3 from anti-HIV_048-250757_VR-Chain
  source 1..333: mol_type = other RNA
cagagcgtgctgacccaacccccttccgtctctggcgccccagggcagagagttacaatctcatgcactggaacgaccagtaacattggtagcaattacgtggcttggtatcagcagctcccgggcacagcacccaaacttctgatatacgacaacgataagaggccttccgggatcccagaccggttctctggatcgaagtcaggcactagcgccaccttgggtattacagggttacaaaccggagatgaggcggactattactgtggcacttgggatacaagtctgtccgctggcggggtatttggaaccggtacgaaagtgactgtccta

SEQ ID NO: 25493 - RNA, 333 nt, synthetic construct
  misc_feature 1..333: note = derived and/or modified sequence opt3 from anti-HIV_048-250716_VR-Chain
  source 1..333: mol_type = other RNA
cagagcgtgctgacccaacccccttccgtctctgccgctccaggccagaaggttacaatctcatgcagtgggagctcctctaacattggaaataaatacgtgtcgtggtatcagcagctcccgggtactgcacccaaacttctgatatacgagaactcaaagagacctagcggcatcccagacaggttcagtgggtccaagtctggaacgagcgccaccttgggcattacaggtttacaaactgggggacaggcggattattactgtggcacctgggacacatccctgtcagctggcggggtatttggaagtggtaccaaagtgactgtccta

SEQ ID NO: 25494 - RNA, 333 nt, synthetic construct
  misc_feature 1..333: note = derived and/or modified sequence opt3 from anti-HIV_048-250463_VR-Chain
  source 1..333: mol_type = other RNA
cagagcgtgctgacccaacccccttccgtctctgccgctccaggccagaaggttacaatctcatgcagtgggagcagatccaacaatggaaacaattacgtgtcttggtatcagcagctcccgggtactgcacccaaacttctgatttacgagaacaataagaggccttcgggcataccagaccggttctcagggagcaaaagtggaacgtccgccaccttggcgatcacaggcttacaaactggtgatgaagctgactattactgtgggacctgggattctagcctgtccggaggcggcgtaattgggacaggaaccaagctaactgtgctc

SEQ ID NO: 25495 - RNA, 333 nt, synthetic construct
  misc_feature 1..333: note = derived and/or modified sequence opt3 from anti-HIV_048-248153_VR-Chain
  source 1..333: mol_type = other RNA
cagagcgccctgacccaacccgcttccgtgtctgcatcattcggccagagtatcacaattagctgcactggggccgcgtccgacgtcggatacaactatgtttcttggtaccagcagctccctggtacgaccccaaaacttctgatatatagaaataaccaaaggccgtcgggcatccccgatcggttttcagggagcaagagtggaacatccgctactttgggcattaccggtttacagacaggggacgaggccgattactattgtggaacctgggacacttctctgagcgcaggcggcgtgttcgggacaggaaccaaggtaacggtgcta

SEQ ID NO: 25496 - RNA, 333 nt, synthetic construct
  misc_feature 1..333: note = derived and/or modified sequence opt3 from anti-HIV_048-247532_VR-Chain
  source 1..333: mol_type = other RNA
cagagcgtgctgacccaacccccttccgtctctgccgctccaggccagcaggttacaatctcatgcagtgggactacgagcaacattggaaccaattacgtgtcctggtatcagcaaatgccgcccgcagcccctaagctccttatatacgacaacaaaaagagaccatctgatatccccgacaggttctcgggttcaaaaagcggcacaagtgcgactctggggattaccggattgcagacaggcgatgaggctgactattactgtggtacctgggatacttccttatctgccgggggagtatttggcacaggcaccaaggtgacggtcctg

SEQ ID NO: 25497 - RNA, 333 nt, synthetic construct
  misc_feature 1..333: note = derived and/or modified sequence opt3 from anti-HIV_048-245846_VR-Chain
  source 1..333: mol_type = other RNA
cagagcgtgctgacccaacccccttccgtctctgccacaccaggccagagagttactatctcatgcacggggagtagctccaacattggaggttacgacgtgtcttggtatcaggtactcccgggcaccgctcccaaacttctgatatacgattcggacaagaggccttcagggatcccagatcggttcagcggaagtcagtccggcacatctgcaactttgggtattaccgggttacaaacaggagacgaggccgattattactgtggcacctgggacactagcctgtccggcgggggagtgtttggtacaggcaccaaggtcacggtgcta

SEQ ID NO: 25498 - RNA, 333 nt, synthetic construct
  misc_feature 1..333: note = derived and/or modified sequence opt3 from anti-HIV_048-244016_VR-Chain
  source 1..333: mol_type = other RNA
cagagcgtgctgacccaacccccttccgtctctggcgccccagggcagagagttacaatctcatgcactggaagtagctccaacattggtggctacgacgtgcactggtatcagcagctcccggggacggctcccaaacttctgatatacaagaatgataagaggccttctggaatcccagaccggttctcgggctcaaaaagcggtaccagtgcaattttggggatcacaggattacaaactggcgatgaggccgactattactgtggcgcgtgggatacctccctgtctgctgggggagtatttggtacaggcaccaaggtgactgtccta

SEQ ID NO: 25499 - RNA, 333 nt, synthetic construct
  misc_feature 1..333: note = derived and/or modified sequence opt3 from anti-HIV_048-243682_VR-Chain
  source 1..333: mol_type = other RNA
cagagcctgctcacccaacccccttccgtgtctgccgctccaggccagaaggtcacaatctcatgcactgggagtagctccaacattggaggttacgacgttcactggtatcagcagcttccgggcacggcacccaaactgttgatatacgagaataacaagagaccttctgggatcccagataggttctcgggatcaaaaagcggcaccagtgccacattaggtattactgggctgcaaaccggagacgaagcggattattactgtggcacatgggactcctctctaagcgctggcggggtgtttggaaccggtactaaggtaacagtgctc

SEQ ID NO: 25500 - RNA, 333 nt, synthetic construct
  misc_feature 1..333: note = derived and/or modified sequence opt3 from anti-HIV_048-243588_VR-Chain
  source 1..333: mol_type = other RNA
cagagcctgctcacccaacccccttccgtgtctgccccaccgggccagatggtctcaatcagttgcagcgggtcctctcacaacattggagacaattacgtttcgtggtatcagcatcttcccggtacagctcctaagctgttgatatacgataacaattcaagaccaagcggcatccccgacaggttcagtgggtccaaatctggaactagcgcaacgttaggcattaccggtctgcagacaggggatgaggccgactattactgtggaacttgggatacctccctatcaggcggcggggtgtttggaacaggtaccaaggtaactgtgctc

SEQ ID NO: 25501 - RNA, 333 nt, synthetic construct
  misc_feature 1..333: note = derived and/or modified sequence opt3 from anti-HIV_048-241775_VR-Chain
  source 1..333: mol_type = other RNA
cagagcgtgctggcccaacccccttccgtctctggcgctccagggcagagagttaccatctcatgcacaggaagtagctccaacattggtgagtacgacgtgcactggtatcagcagctcccgggcactgcacccaaacttctgatatacgaaaataacaagaggccttctgggatcccagatcggttctcgggatcaaagagcggcacgagtgccaccttgggtattacagggttacaaactggagacgaggcggattattactgtggcacctgggactcctctctgagcgctggcggggtatttggaacaggtaccaaagtgactgtccta

SEQ ID NO: 25502 - RNA, 333 nt, synthetic construct
  misc_feature 1..333: note = derived and/or modified sequence opt3 from anti-HIV_048-237996_VR-Chain
  source 1..333: mol_type = other RNA
cagagcgtgctgacccaacccccttccgtctctggcgcgccagggcagagagttacaatctcatgcactggaagtagctccaacattggtggctacgacgtgcactggtataggcagctcccggggacggctcccaaacttctgatatacgataccgtaaagcggccttctggaatcccagaccgcttctcgggctcaaagagcggtacaagtgcaactttggggattaccggattacagacaggcgatgaggccgactattactgtggcacctgggatacttccctgtctgccgggggagtgtttggtacaggcaccaaagtcacggtgcta

SEQ ID NO: 25503 - RNA, 330 nt, synthetic construct
  misc_feature 1..330: note = derived and/or modified sequence opt3 from anti-HIV_048-237730_VR-Chain
  source 1..330: mol_type = other RNA
agcgtgctgacccagcccccttccgtctctggcgccccagggcagagagttacaatctcatgcactggaacgaacagtaatttcggtagcaactacgctcactggtatcaacaggtgccgggcaccgcacccaagctccttatttactccaataacgccaggccttctgggataccagaccggttttcgggatcaaaaagcggcacaagtgcgactctgggtatcaccgggttgcagacaggagatgaggctgactattactgtggcacctgggatacttccttatctgccggcggggtattcggaacaggtaccaaggtgacggtcctg

SEQ ID NO: 25504 - RNA, 333 nt, synthetic construct
  misc_feature 1..333: note = derived and/or modified sequence opt3 from anti-HIV_048-237253_VR-Chain
  source 1..333: mol_type = other RNA
cagagcgtgctgacccaacccccttccgtctctgccgctccaggccagaaggttacagtgtcatgcagtgggagctcctctaacatcggatcgaatgacgtatcatggtaccagcagttcccgggtgcagcccccaaactccttatttataagaacaatgagagacctagcggcataccagataggtttagtgggtccaaatctggaactagcgcgacgctgggcatcaccggtttgcaaacaggggacgaagctgattactattgtggaacttgggacacctccttatcagccggcggcgtgttcgggacaggaaccaaggtcactgtgctg

SEQ ID NO: 25505 - RNA, 333 nt, synthetic construct
  misc_feature 1..333: note = derived and/or modified sequence opt3 from anti-HIV_048-234100_VR-Chain
  source 1..333: mol_type = other RNA
cagagcatgctgacccagcccccttccgtgtctgccgctccaggcgagaaggtcacaatctcatgcagtgggagctcctctaacattggaaaaactttcgtttcgtggtaccaacaggtgccgggtacggcacccaagctccttatatataaaaatgacaacagaccttcaggcatcccagataggtttagcgggagtaagtccggaacctctgccacactgggcattagcggtttgcagactggggacgaagcggattactattgtggaacctgggacacatccttatcaggcggcggggtattcggaaccggtactaaagtgacagtcctg

SEQ ID NO: 25506 - RNA, 333 nt, synthetic construct
  misc_feature 1..333: note = derived and/or modified sequence opt3 from anti-HIV_048-230882_VR-Chain
  source 1..333: mol_type = other RNA
cagagcgtgctgacccaacccccttccgtctctgccgctccaggccagaaggttacaatctcatgcagtgggaacagctccaatattggatctaacttcgtgtcgtggtaccagcagctcccgggtactgcacccaaacttctgatatatgagaataacaagagaccttcaggcatcccagacaggtttagcgggagtaaatccggaacgtctgccaccttgggcattacaggtttacaaactggggatgaagcggactactattgtggaacctgggatacaagcctgtcccccggcggcgtattcgggaccggaactaaggtgacagtccta

SEQ ID NO: 25507 - RNA, 333 nt, synthetic construct
  misc_feature 1..333: note = derived and/or modified sequence opt3 from anti-HIV_048-229473_VR-Chain
  source 1..333: mol_type = other RNA
cagagcgtgctgacccaacccccttccgtctctgccgctccaggccagaaggttacaatctcatgcagtgggagctcctctaacattggaaataactacgtgtcgtggtatcagcagttcccgggtactgcacccaaactccttatatacgagaataacaagagaccttcaggcatcccagacaggtttagcgggagtaaatccggaacgaccgccacactggcgattactcggttgcaaaccggcgatgaagctgactattactgtggtacatggggagggtctttaagcgccggcggcgtattcgggaccggaactaaggtgacagtcctg

SEQ ID NO: 25508 - RNA, 333 nt, synthetic construct
  misc_feature 1..333: note = derived and/or modified sequence opt3 from anti-HIV_048-228238_VR-Chain
  source 1..333: mol_type = other RNA
cagagcgtgctgacccaacccccttccgtctctgccgctccaggccagaaggttacaatctcatgcagtgggagctcctctaacattggaataaattacgtgtcgtggtatcagcagctcccgggtactgcacccaaacttctgatctacgacaacacgaagagacctcaaggcattccagataggttctcagggagcaaaagtggaacctccgccacattggcgatcactggcttacagaccggtgacgaggctgattattactgtgggacatgggacggatctctgagcaccggcggcgtaattgggactggaacaaaggtgaccgtccta

SEQ ID NO: 25509 - RNA, 333 nt, synthetic construct
  misc_feature 1..333: note = derived and/or modified sequence opt3 from anti-HIV_048-228027_VR-Chain
  source 1..333: mol_type = other RNA
cagagcctgctcacccaatccccctctgcctcaggccctccagggcagagagtgacaatcagttgcagcggatccaactctaatattggttcgaacactgtcaattggtaccaccatcttccgggcgctgcacccaagctgttgatatatgagaactcaaaaaggcctagcgggatcccagaccggttcagtggatccaagtctggcacgagcgccaccttaggtattacagggctgcagactggagatgaagcggactactattgtggcacctgggatacatccctatcagctggcggggtttttggaagtggtaccaaagtgactgtactc

SEQ ID NO: 25510 - RNA, 333 nt, synthetic construct
  misc_feature 1..333: note = derived and/or modified sequence opt3 from anti-HIV_048-227795_VR-Chain
  source 1..333: mol_type = other RNA
cagagcgtgctgacccaacccccttccgtctctgccgctccaggccagaaggttacaatctcatgcagtgggagctcctctaacattgagtcgagatcagtgcactggtaccagcagaaaccgggacaagcacccgtactcgtgatatattacgacagcgataggcctagtggtatcccagaccggttctccggctctaagagcgggactgccgcgacgcttggaattaccggcctgcagacaggtgatgaagctgactattactgtgggacttgggatacctccttgtcagccggaggcgtctttggcacagggaccaaagtgactgtttta

SEQ ID NO: 25511 - RNA, 333 nt, synthetic construct
  misc_feature 1..333: note = derived and/or modified sequence opt3 from anti-HIV_048-227770_VR-Chain
  source 1..333: mol_type = other RNA
cagagcgtgctgacccaacccccttccgtctctggcgccccagggcagagagttacaatctcatgcactggaagtagctccaacattggtccgagggacgtgcactggtaccagcagctccccggcacggtacctaaacttctgatatatgatacctacacacggccatctgggatccccgaccgcttctcgggatcaaagagcggcgctagtgcaactttggatattaccggtttacaaacaggggacgaggccgattattactgtggaatctgggacacctccctgtctgcgggcggcgtgtttgggactggaacaaaggtcaccgtgcta

SEQ ID NO: 25512 - RNA, 333 nt, synthetic construct
  misc_feature 1..333: note = derived and/or modified sequence opt3 from anti-HIV_048-225298_VR-Chain
  source 1..333: mol_type = other RNA
cagagcgccctgacccaacccagatccgtgtctggctcacctgggcagagtgtcacaatcagctgcactggaacgtccaacgacgttggttacgattatgtgtcttggtaccagcagctcccaggcaccgctccgaaacttctgatttatgacataaataagaggccctcggggatccctgatcggttctcaggaagcaagagtggcacatccgcaactttgggtattaccgggttacaaacaggagacgaggccgattactattgtggcacctgggacacttctctgagcgcgggcggggtatttggaacaggtaccaaagtgacggtccta

SEQ ID NO: 25513 - RNA, 327 nt, synthetic construct
  misc_feature 1..327: note = derived and/or modified sequence opt3 from anti-HIV_048-225090_VR-Chain
  source 1..327: mol_type = other RNA
gagctgacccagccccctagcgtgtccggcgccccagggcaaagagtcacaatctcttgcactggatcaagtagcaacattggtggctacgacgttcactggtatcagcagctcccggggacggctcccaaacttctgatatacgataataacaagaggccttccggaatcccagaccggttctctggctcgaagtcaggtaccagcgcaacattggggattactggattacagaccggcgatgaagccgactattactgtggcacatgggataccagtctgtccactgggggagtgtttggtacaggcaccaaagtaacggtgcta

SEQ ID NO: 25514 - RNA, 333 nt, synthetic construct
  misc_feature 1..333: note = derived and/or modified sequence opt3 from anti-HIV_048-224187_VR-Chain
  source 1..333: mol_type = other RNA
cagagcgtgctgacccaacccccttccgcctctggcacaccagggcagagagtcactatctcatgcagtggaagctccgctaacattggtacgaattacgttttctggtatcagcacctcccgggcaccacacccaggcttctgatatttcggaacaatgagcgcccttctgggatcccagaccgattctcgggatcaaagagcggcaccagtgcaactttgggtattacagggttacagaccggagatgaagccgactactattgtggcacttgggatacatccctgtctgcgggcggggtgtttggaaccggtacgaaagtaactgtgcta

SEQ ID NO: 25515 - RNA, 333 nt, synthetic construct
  misc_feature 1..333: note = derived and/or modified sequence opt3 from anti-HIV_048-223055_VR-Chain
  source 1..333: mol_type = other RNA
cagagcgtgctgacccaacccccttccgtctctgccgctccaggccagaaggttacaatctcatgcagtgggagctcctctaacattggaaataactacgtgtcgtggtatcagcagttcccgggtactgcacccaaagtactcatatacggcaattcaaagagacctagcgggatcccagacaggtttagtggatccaaatctggcacgagcgccacccttggtattacagggctgcaaactggagatgaggcggactattactgtggcacctgggatacatccttgtcagctggcggggtgttcggaagtggtaccaaggtcactgtgtta

SEQ ID NO: 25516 - RNA, 333 nt, synthetic construct
  misc_feature 1..333: note = derived and/or modified sequence opt3 from anti-HIV_048-222711_VR-Chain
  source 1..333: mol_type = other RNA
cagcccgtgctgacccaacctccaagcgtctccggcgccccggggcagagagttacaatctcttgcactggatcaagtagcaacattggtggctacgacgtgcactggtatcagcaggtacccgggacggctcctaagctccttatattcgagaataacaggcggccatccggaatccccgatcgcttttctggctcgaaatcaggtaccagcgcaacactggccattactgggttgcaaaccggagacgaagcggattactattgtggcacatgggacggcagtttatccaccgggggagtgatcggtactggcacaaaggtcaccgtgctg

SEQ ID NO: 25517 - RNA, 333 nt, synthetic construct
  misc_feature 1..333: note = derived and/or modified sequence opt3 from anti-HIV_048-221209_VR-Chain
  source 1..333: mol_type = other RNA
cagagcgtgctgacccaacccccttccgtctctggcgccccagggcagagagttacaatctcatgcactggaaacagtagcaatattggtgactacgatgtgcactggtatcagcaggtagctggcacggcaccgaagctccttatattcaaaaacaatgagaggccctccgggatccctgaccggttttctggatcgaagtcaggcaccagcgccacactgggtattactgggttgcaaaccggagatgaagcggactactattgtggcacatgggataccagtttatccgctggcggggtgttcggatctggtactaaagtcacagtgctg

SEQ ID NO: 25518 - RNA, 333 nt, synthetic construct
  misc_feature 1..333: note = derived and/or modified sequence opt3 from anti-HIV_048-220629_VR-Chain
  source 1..333: mol_type = other RNA
cagagcgccctgacccaacccgcttccgtgtctggctcactcgggcagagtatcacaattagctgcactggaacgtccagagacgtcggttactcttatgtttcgtggtaccagcaccttcctggcaccgcaccaaagctgttgatatatgagaacaataaaaggccgtcagggatccccgatcggttcagcggaagtaagtccggcacatctgccactttaggtattaccgggctgcagacaggagacgaagcggattactattgtggcacctgggacagctccctatcagctggcggggtgtttggaactggtacaaaagtaaccgtgctc

SEQ ID NO: 25519 - RNA, 333 nt, synthetic construct
  misc_feature 1..333: note = derived and/or modified sequence opt3 from anti-HIV_048-219430_VR-Chain
  source 1..333: mol_type = other RNA
cagagcgtgctgacccaacccccttccgtctctgccgctccaggccagatggttacaatctcatgcagtgggagcacttccaacattggaataaattacgtgtcttggtatcagcacgtaccgggtacggcacccaagctccttatctacgacaacaataaaagaccttcgggcattccagataggttctcagggagcaagagtggaacctccgccacactgggcatcactggtttgcataccggggacgaggcggattattactgtggaacatgggacacctctttaagcgctggcggcgtgtttgggactggaacaaaagtcaccgtgctg

SEQ ID NO: 25520 - RNA, 333 nt, synthetic construct
  misc_feature 1..333: note = derived and/or modified sequence opt3 from anti-HIV_048-216250_VR-Chain
  source 1..333: mol_type = other RNA
cagagcgtgctgacccaacccccttccgtctctgccgctccaggccagaaggttacaatctcatgcactgggacgaccagtgacttcggatacaactgtgtgagctggtatcagcagcacccgggtagagcacccaaagtaattatatccggcgtgaataagaggccttctgggatcccagatcggttttcgggatcaaaaagcggcacaagtgccactctcggtattaccgggcttcaaacaggagacgaggcggattactattgcggcacctgggactcctctctgagcgctggcggggtcttcggaactggtacaaaggtgaccgttttg

SEQ ID NO: 25521 - RNA, 321 nt, synthetic construct
  misc_feature 1..321: note = derived and/or modified sequence opt3 from anti-HIV_048-216133_VR-Chain
  source 1..321: mol_type = other RNA
acccagccccctagcctgtccgccacaccaggccaaagagtgtctatctcatgcagtgggggaggtagcaacattggcaataacgacgtcttctggtttcagcagttcccgggggctggacccaggctccttatatacgataatcacaagcggcattatggcactcctgaccgcttttccggttctaaatcggggacgtcagcaaccctggccatcacaggattgcagactggcgatgaggcggcttactattgtggcacctgggacgggagcttaagtacaggaggtgttattggcaccgggactaaggtgacagtactg

SEQ ID NO: 25522 - RNA, 333 nt, synthetic construct
  misc_feature 1..333: note = derived and/or modified sequence opt3 from anti-HIV_048-214886_VR-Chain
  source 1..333: mol_type = other RNA
cagagcgccctgacccaacccagatccgtgtctggctcacctgggcagagtgtcacaatcagctgcactggaacgtcctctgacgttggttacaactatgtgtcgtggtaccagcaccatccaggcaccgctccgaagctccttatttataaaaataacaataggccctcagggatacctgatcggttcagcggaagtaagtccggcacatctgcaactctgggtatcaccgggttgcagacaggagacgaggccgattactattgtggcacctgggacactagcttatccgcgggcggggtatttggaacaggtaccaaagtgacggtcctg

SEQ ID NO: 25523 - RNA, 333 nt, synthetic construct
  misc_feature 1..333: note = derived and/or modified sequence opt3 from anti-HIV_048-214709_VR-Chain
  source 1..333: mol_type = other RNA
cagagcgtgctgacccaacccccttccgtctctgccgctccaggccagaaggttacaatctcatgcagtgggagctcctctaacattggaaataactacgtgtcgtggtatcagcagctcccgggtactgcacccaaacttctgatatacgagaatgacagaaggccttcaggcatcccagatcggttcagcgggagtaagtccggaacgtctgccaccttgggcattacaggtttacaaactggggacgaagcggattattactgtggaacctgggacacaagcctgtccgctggcggcgtatttgggaccggaactaaagtgacagtccta

SEQ ID NO: 25524 - RNA, 333 nt, synthetic construct
  misc_feature 1..333: note = derived and/or modified sequence opt3 from anti-HIV_048-214001_VR-Chain
  source 1..333: mol_type = other RNA
cagagcgtgctgacccaacccccttccgtctctggcgccccagggcagacagttactatctcatgcagtggaagcaactccaatattggtaaccacgacgtgcattggtaccagcacgtaccgggcacggctcccaagctccttatatatgataataacaaaagaccttctgggatcccagacaggttctcgggatcaaagagcggcaccagtgcaacactgggtattactgggttgcagaccggagatgaggccgaatactattgtgcgacatgggacgcttccttatctggcggcggggtgtttcggaccggaactaaagtcacagtgctg

SEQ ID NO: 25525 - RNA, 333 nt, synthetic construct
  misc_feature 1..333: note = derived and/or modified sequence opt3 from anti-HIV_048-213230_VR-Chain
  source 1..333: mol_type = other RNA
cagagcgtgctgacccaacccccttccatgtctgccgctccaggccagaaggtcacaatctcatgcagtgggagctccaacaatattggtaaaaacgttgtgtcttggtaccagcagctcccgggaactgcacccaaggtacttatatatgagaataacaaaagactgtcgggcatccctgacaggttctcagggagcaagagtggaacgtccgccaccttggtgattacaggcttacaaactggtgatgaagcggactactattgtgggacctgggattctagcctgtccgctggaggcgtctttggcacagggaccaaagtgactgttcta

SEQ ID NO: 25526 - RNA, 333 nt, synthetic construct
  misc_feature 1..333: note = derived and/or modified sequence opt3 from anti-HIV_048-212574_VR-Chain
  source 1..333: mol_type = other RNA
cagagcgtgctgacccaacccccttccgtctctgccgctccaggccagagagttacagtgtcatgcagtgggagcacttccaacatcgagtctaattacgtatcgtggtatcaacaggtgccgggaacggcacccaagctccttatttacgaaaacaataaaaggccttcaggtataccagaccggttcagcggcagtaagtccgggacctctgccacactggcgatcactggattgcagaccggcgatgaggctgcctattactgtggtacatgggacgggagcttatccaccggaggcgtcattggcactgggacaaaagtgaccgttctg

SEQ ID NO: 25527 - RNA, 333 nt, synthetic construct
  misc_feature 1..333: note = derived and/or modified sequence opt3 from anti-HIV_048-212207_VR-Chain
  source 1..333: mol_type = other RNA
cagagcgtgctgacccaacccccttccctctctgccgctccaggccagaaggtcacaatctcatgcagtgggggaagctccaacattggtaataactacgtttcttggtatcagcaccttccgggcactgcacccaaactgttgatatacgacaattataagagaccttcggggatcccagataggttctcaggaagcaaaagtggcacgtccgccaccttagacattacaggtctgcagactggggatgaggcggactactattgtggaacctgggatacatctctaagcgctggcggcgtgtttgggaccggaactaaggtaacagtgctc

SEQ ID NO: 25528 - RNA, 333 nt, synthetic construct
  misc_feature 1..333: note = derived and/or modified sequence opt3 from anti-HIV_048-209146_VR-Chain
  source 1..333: mol_type = other RNA
cagagcgtgctgacccaacccccttccgtctctggcgccccagggcagaagatcacagtttcatgcactggaacgaccagtaacattggtccgcacgacgtgcattggtaccagctcgtacccggcagacctccaaaacttctgatattccacaataacatcaggcccagcgggattcctgatcggttttccggatctaagtcgggcatgtcagctacattgggtatcactgggttacagaccggagacgaggcagattattactgtggcacatgggacagcagtctgtccgccggcggggtgttcggaaccggtactaaagtcacagtgcta

SEQ ID NO: 25529 - RNA, 333 nt, synthetic construct
  misc_feature 1..333: note = derived and/or modified sequence opt3 from anti-HIV_048-208206_VR-Chain
  source 1..333: mol_type = other RNA
cagagcgtgctgacccaacccccttccgtctctgccgctccaggccagaaggttacaatctcatgcagtgggagctcctctaacattggatcgaattacgtgtcatggtatcagcagttcccgggtactgcacccagactccttatatacgagaacgacaaaaggcctagcgccatcccagatcggtttagtggctccaagtctgggacgagcgcgaccctgggaattacaggcttgcacactggtgacgaagctgattattactgtgggacctgggacggatccttatcaacaggcggcgtaatcgggaccggaactaaagtgacagtcctg

SEQ ID NO: 25530 - RNA, 333 nt, synthetic construct
  misc_feature 1..333: note = derived and/or modified sequence opt3 from anti-HIV_048-208194_VR-Chain
  source 1..333: mol_type = other RNA
cagagcgccctgacccaacccccttccgcttctggctcaccagggcagagtgtgacaatcagctgcactggaacgtcctctgacattggttacaagtatgtctcgtggtaccagctccttccgggcacaccccctaaactgttgatattcaagaacaatgagagaccatcagggatccccgataggtttagcggaagtaaatccggcacctctgcaactttaggtattaccgggctgcagacaggagacgaagccgattattactgtggcgcgtgggacaccagcctatccgctggcggggttttcggaactggtacaaaggtgaccgtactc

SEQ ID NO: 25531 - RNA, 333 nt, synthetic construct
  misc_feature 1..333: note = derived and/or modified sequence opt3 from anti-HIV_048-207744_VR-Chain
  source 1..333: mol_type = other RNA
cagagcgccctgacccaacccgcttccgtgtctgcatcattcggccagagtatcacaattagctgcactggggccgcgtccacgataggaaacaatctcgtctcttggtacagacttctgcctggtaccgctccaaagttgttaatctataaaaacgacaataggccgtcgggcattcccgatcggttttcagggagcaagagtggaacatccgccactctgggcatctctggtctacagaccggggacgaggcagattactattgtggaacatgggacaccagcctctccggcggcggggttttcggaactggtacaaaagtgaccgtactg

SEQ ID NO: 25532 - RNA, 333 nt, synthetic construct
  misc_feature 1..333: note = derived and/or modified sequence opt3 from anti-HIV_048-206501_VR-Chain
  source 1..333: mol_type = other RNA
cagagcgtgctgacccaacccccttccgtctctggcgccccagggcagagagttacaatctcatgcagtggaagctcctctaacattggtaataacgctgtgaattggtaccagcagctcccgggcaaggcacccaaacttctgatatatgagaacaataagaggccttcggggatcccagaccggttctcaggaagcaaaagtggcacttccgccacgttgggtattaccgggttacaaacaggagatgaagcggactactattgtggcacttgggattctagcctgtccgctggcggggtatttggaaccggtacaaaggtgaccgtccta

SEQ ID NO: 25533 - RNA, 333 nt, synthetic construct
  misc_feature 1..333: note = derived and/or modified sequence opt3 from anti-HIV_048-204221_VR-Chain
  source 1..333: mol_type = other RNA
cagagcgtgctgacccaacccccttccgcctctggcacaccagggcagagagtcactatctcatgcttcggaagtagctccaacattgcttcttcggcagttaattggtaccagcagctcccgggtacggcccccaaacttctgatatataagaacgacaagaggccttcaggcatcccagatcggtttagcgggagtaaatccggaacctctgcgacattgggcattactggtttacaaaccggggacgaggctgattactattgtggaacatgggacaccagcctgtccgccggcggcgtgttcgggactggaacaaaggtaaccgtgcta

SEQ ID NO: 25534 - RNA, 333 nt, synthetic construct
  misc_feature 1..333: note = derived and/or modified sequence opt3 from anti-HIV_048-204015_VR-Chain
  source 1..333: mol_type = other RNA
cagagcgtgctgacccaacccccttccgcctctggcacaccagggcagagagtcactatctcatgcagtggaagctcctctaacattggttcgaagtacgtttattggtaccagcagctcccgggcacggctcccaaacttctgatatataagaatgacaacaggccttcagggatcccagatcggttcagcggaagtaaatccggcacctctgcaacattgggtattagcgggttacaaactggagacgaggccgattactattgtggcacctgggacacatccctgtcaggcgggggagtgtttggtaccggcactaaggtaacagtgcta

SEQ ID NO: 25535 - RNA, 333 nt, synthetic construct
  misc_feature 1..333: note = derived and/or modified sequence opt3 from anti-HIV_048-201240_VR-Chain
  source 1..333: mol_type = other RNA
cagagcgtgctgacccaacccccttccgtctctgccgctccaggccagaaggttacaatctcatgcagtgggagctcctctaacattggaaataactacgtggcatggtatcagcagctcccgggtactgcccccaaacttctgataaaggaaaattcgcaaagaccttcaggcatcccagacaggttcagcgggagtaaatccggaacgtctgcgaccttggctattacaggcttacagactggtgatgaggccgactactattgtgggacctgggatacaagcctgtccaccggaggcgtatttggcactgggacaaaggtgaccgtccta

SEQ ID NO: 25536 - RNA, 333 nt, synthetic construct
  misc_feature 1..333: note = derived and/or modified sequence opt3 from anti-HIV_048-200455_VR-Chain
  source 1..333: mol_type = other RNA
cagagcgccctgacccaacccgcttccgtgtctggctcacctgggcagagtatcacaattagctgcactggaacgtcctctgacgtcggttacaactatgtttcgtggtaccaggtgctcccaggcaccgcaccgaaacttctgatatataagaatacagagagaccctcagggatccctgataggttcagcggaagtaagtccggcacttctgccaccttggacattacaggtttacagaccggggatgaagcggactactattgtggaacttgggatacaagcctgtccgctggcggcgtatttgggaccggaacgaaagtgactgtccta

SEQ ID NO: 25537 - RNA, 333 nt, synthetic construct
  misc_feature 1..333: note = derived and/or modified sequence opt3 from anti-HIV_048-200319_VR-Chain
  source 1..333: mol_type = other RNA
cagagcgtggtcacccaacccccttccgcctctggcacaccagggcagagagttactatctcatgcagtggaagctcctctaacattggttcgaagtacgtgtattggtaccaccagcatccgggcacggctcccaaactgctcatatatgacaataacaataggccttcagggatcccagatcggttcagcggaagtaagtccggcacctctgcaacacttggtattactgggctgcagaccggagacgaggccgattactattgtggcacatgggacaccagcttgtcccgcggcggggtatttggaactggtacaaaagtgaccgtctta

SEQ ID NO: 25538 - RNA, 333 nt, synthetic construct
  misc_feature 1..333: note = derived and/or modified sequence opt3 from anti-HIV_048-197896_VR-Chain
  source 1..333: mol_type = other RNA
cagagcgtgctgacccaacccccttccgtctctgccgctccaggccagaaggttacaatctcatgcagtggggcaagctacaacattggtaaaaattccgtgtcttggtatcagcagctcccgggaactccccctaaacttctgatattcaagaacaatgagagaccatcgggcatccccgacaggttttcagggagcaagagtggaacgtccgccaccttgggcattacaggtttacaaactggggatgaagcggactactattgtgctacctgggatacatctctgagcgccggaggcgtattcggcaccgggactaaagtgacagtccta

SEQ ID NO: 25539 - RNA, 333 nt, synthetic construct
  misc_feature 1..333: note = derived and/or modified sequence opt3 from anti-HIV_048-193813_VR-Chain
  source 1..333: mol_type = other RNA
cagagcgtgctgacccaatccccctctgtctcagccgctcctggccagaaggttacaatcagttgcagcgggtccaactctaatgtgggaaactactatgtatcgtggtaccagcacctcccaggtactgcaccgaaagtgcttatttatgagggcaataagagaccctcaggggtccctgacaggttcagcggaagtaaatccggcacgtctgccagcctggcgataaccggtttgcagacaggggatgaagctgactactattgtggaacttgggatacctccttatcagccggcggcgtgtttgggagtggaacaaaggttaccgtgctg

SEQ ID NO: 25540 - RNA, 333 nt, synthetic construct
  misc_feature 1..333: note = derived and/or modified sequence opt3 from anti-HIV_048-192098_VR-Chain
  source 1..333: mol_type = other RNA
cagagcgtgctgacccaacccccttccgcctctggcacaccagggcagagagtcactatctcatgcagtggaagcacgtccaacattggttctaattacgtttattggtaccagcagctcccgggcaccacacccaaacttctgatatatgagaacaataagaggccttcggggatcactgaccggttctttggatcaaagagcggcccaagtgctaccttggatattacaggtttacaaaccggggacgaagcagattactattgtggaacttgggacgcctccctgtctgcgggcggcgtgttcgggacaggaaccaaagtaacggtgcta

SEQ ID NO: 25541 - RNA, 333 nt, synthetic construct
  misc_feature 1..333: note = derived and/or modified sequence opt3 from anti-HIV_048-191786_VR-Chain
  source 1..333: mol_type = other RNA
cagagcgtgctgacccaacccccttccgtctctgccgctccaggccagaacgttaatatctcatgcagtgggagctcctctaacattgagaataacttcgtgtcgtggtaccagaagctcccgggaacagcacccaaacttctgatatatgacaataacaagagaccttcaggtatcagggatcggtttagcggcagtaaatccgggacttctgccacgttgggaattaccggcttacagacaggtgacgaagcggattactattgtgggacttgggacaccagcctgtccgctggaggcgtattcggctcagggacaaaggtgaccgtccta

SEQ ID NO: 25542 - RNA, 333 nt, synthetic construct
  misc_feature 1..333: note = derived and/or modified sequence opt3 from anti-HIV_048-188746_VR-Chain
  source 1..333: mol_type = other RNA
cagagcgtgctgacccaacccccttccgcctctggcacaccagggcagaaggtcactatctcatgcagtggaagcaactccaatattggttctaacttcgtttcgtggtaccagctccttccgggcacgacccccaaactgttgatatatagaaataaccagaggccttcaggggtgccagaccggtttagcggaagtaagtccggcacatctgctactttaggtatcaccgggctgcaaacaggagatgaggcagactactattgtggcacctgggatagctccctatcagccggcggggtattcggaactggtacaaaagtgaccgtcctc

SEQ ID NO: 25543 - RNA, 333 nt, synthetic construct
  misc_feature 1..333: note = derived and/or modified sequence opt3 from anti-HIV_048-185937_VR-Chain
  source 1..333: mol_type = other RNA
cagagcgtgctgacccaacccccttccgtctctgccgctccaggccagaaggttacaatctcatgcagtgggagctcctctaacattggaaataactacgtgtcgtggtatcagcagctcccgggtactgcacccaaacttctgatatacgagaataacaagagaccttcaggcatcccatatcccattagcgggagtaaatccggaacgtctgccaccttgggcatcacaggtttacaaactggggacgaagcggattactattgtggaacctgggacagctccctgtcagctggcggcgtattcgggacaggaaccaaggtgactgtccta

SEQ ID NO: 25544 - RNA, 333 nt, synthetic construct
  misc_feature 1..333: note = derived and/or modified sequence opt3 from anti-HIV_048-184849_VR-Chain
  source 1..333: mol_type = other RNA
cagagcgtgctgacccaagccccctccgcttctggcacacctgggcagactgtcacgatctcatgcagtggaagctcctctaacattggtaccaagtacgtttattggtaccagcagctcccaggcacagcaccgaaacttctgatatataagaataacgagagaccctcggggatccctgacaggttctcaggaagcaaaagtggcacttccgccaccttgggtattacagggttacaaaccggagatgaagcggactactattgtggcacttgggatacatctctgagcccaggcggggtgtttggaaccggtacgaaggtaactgtgcta

SEQ ID NO: 25545 - RNA, 333 nt, synthetic construct
  misc_feature 1..333: note = derived and/or modified sequence opt3 from anti-HIV_048-183089_VR-Chain
  source 1..333: mol_type = other RNA
cagagcgtgctgacccaacccccttccgcctctggcacaccagggcagagagtcactatctcatgcagtggaagctcctctaacattggttcgtcatacgtttattggtaccagctccttccgggcacgccccctaagctgttgatattcaaaaataacgagaggccaagcgggatccccgaccggtttagtggatccaagtctggcaccagcgctacattaggtattactgggctgcagaccggagatgaagcagactattactgtggcacatgggatacctccctatcagccggcggggtgttcggaactggtacaaaagtaaccgtgctc

SEQ ID NO: 25546 - RNA, 333 nt, synthetic construct
  misc_feature 1..333: note = derived and/or modified sequence opt3 from anti-HIV_048-181509_VR-Chain
  source 1..333: mol_type = other RNA
cagagcgtgctgacccaacccccttccgtctctggcgccccagggcagagagttacaatctcatgcactggaagtagctccaacattggtggctacgacgtgcactggtatcatcagctcccgggggctgcacccaaacttctgatatacaagaatgataacaggccttctggaatcccagaccggttctcgggctcaaagagcggtacgagtgccaccttggggatttccggattacagacaggcgatgaggcggactattactgtggcacttgggatacctctctgagcgggggaggtgtatttggcacagggaccaaagtgactgtccta

SEQ ID NO: 25547 - RNA, 333 nt, synthetic construct
  misc_feature 1..333: note = derived and/or modified sequence opt3 from anti-HIV_048-180990_VR-Chain
  source 1..333: mol_type = other RNA
cagagcgtgctgacccaacccccttccgtctctgccgctccaggccagagagttacaatctcatgcagtgggagcacttccaacattggaaataactacgtgtcttggtatcagcacttcccgggtaaggtacccaaagtggtcatatcggagacgaccaagaggccttcaggcatcccagaccggtttagcgggagtaaatccggaacatctgcaactctcggcattaccggtcttcagacaggggatgaagccgactactattgtggaacctgggatagctccctgtcagcgggcggcgtgttcgggactggaacaaaggttaccgtgttg

SEQ ID NO: 25548 - RNA, 333 nt, synthetic construct
  misc_feature 1..333: note = derived and/or modified sequence opt3 from anti-HIV_048-177532_VR-Chain
  source 1..333: mol_type = other RNA
cagagcgccctgacccaacccccttccgcttctggctcactcgggcagagtgtgacaatcagctgcactggaacgtcctctgacgtcggtaacaatttcgtttcgtggtaccagaagaaaccaggcaaggcaccgaaacttattgtgtatgaggtaaacaagagaccctcagggatacctgataggtttagcggaagtaaatccggcacctctgccacactgggtatcactgggttgcagaccggagacgaagcggattactattgtggcacatgggacaccagcttatccactggcggggtgttcggaacaggtaccaaggtcacggtgctg

SEQ ID NO: 25549 - RNA, 324 nt, synthetic construct
  misc_feature 1..324: note = derived and/or modified sequence opt3 from anti-HIV_048-177426_VR-Chain
  source 1..324: mol_type = other RNA
ctgacccagccccacagcgtgtccgagtctcctggcaagacagtcactatctcatgcacggggaccagtagcgacgttggatacaactatgtgtcctggtaccaacatcacccaggtaaagccccgaagctccttatttatgaagtaacaaaaagaccctctggcatacctgataggttctcggggtcaaagagcggaaccagtgctactctgggcatcacaggtttgcagaccggggacgaggcagattactattgtggaacttgggactcctctttaagcgccggcggcgtgtttgggacaggaaccaaagtcacggtgctg

SEQ ID NO: 25550 - RNA, 333 nt, synthetic construct
  misc_feature 1..333: note = derived and/or modified sequence opt3 from anti-HIV_048-177389_VR-Chain
  source 1..333: mol_type = other RNA
cagagcgtgctgacccaacccccttccatgtctgccgctccaggcgagagagtcacaatctcatgcagtgggagctcctctaacattggaaatcaccatgtttcgtggtaccagcagaggccgggtactgcacccaagctccttatatatgaaaacaatgagcggccttcaggcatcccagaccgcttcagcgggagtaaatccggaacgtctgccaccctgggcattacaggtttgcagactggggatgaagcggactactattgtggaacctgggataccagcttatccgctggcggcgtgtttgggtcaggaacaaaggtaactgtgctg

SEQ ID NO: 25551 - RNA, 333 nt, synthetic construct
  misc_feature 1..333: note = derived and/or modified sequence opt3 from anti-HIV_048-174266_VR-Chain
  source 1..333: mol_type = other RNA
cagagcgtgctgacccaacccccttccgtctctggcgccccagggcagagagttacaatctcatgcagtggaagctcctctaacattggttcgcactacgtgtcatggtatcagcaggtaccgggcactgctcccaggctcgtgatatacgacacgatcaagcggcatagcgggattcctgatcgcttcagtggatccaaatctggcaccagcgcaacacttggtatcactgggctgcaaaccggagacgaggccgattattactgtggcacatgggacacctccttgtcagcgggcggggtctttggaactggtacaaaggtgaccgtttta

SEQ ID NO: 25552 - RNA, 333 nt, synthetic construct
  misc_feature 1..333: note = derived and/or modified sequence opt3 from anti-HIV_048-172847_VR-Chain
  source 1..333: mol_type = other RNA
cagagcgtgctgacccaacccccttccgtctctgccgctccaggccagagagttacagtgtcatgcagtgggagcacttccaacatcgagtctaattacgtatcgtggtatcaacaggtgccgggaacggcacccaagctccttatttacgaaaacaataaaaggccttcaggtataccagaccggttcagcggcagtaagtccgggacctctgccacactgggaatcactggcttgcagaccggtgatgaggcggactattactgtgggacatgggataccagcttatccgctggaggcgtctttggcactgggacaaaagtgaccgttctg

SEQ ID NO: 25553 - RNA, 333 nt, synthetic construct
  misc_feature 1..333: note = derived and/or modified sequence opt3 from anti-HIV_048-172845_VR-Chain
  source 1..333: mol_type = other RNA
cagagcgccctgacccaacccccttccgcttctggctcaccagggcagagtgtgacaatcagctgcactggaacgtcctctgacgtcggttacaactatgtttcgtggtaccagcagctcccgggcaccgcacccaaacttctgatttatagaaataaccaaaggccttcaggggtgccagatcggttcagcggaagtaagtccggcacatctgccactttgggtataaccgggttacagacaggagacgaggcggattactattgtgctacctgggacactagcctgtccgccggcggcgtatttgggacaggaaccaaggtgacggtccta

SEQ ID NO: 25554 - RNA, 333 nt, synthetic construct
  misc_feature 1..333: note = derived and/or modified sequence opt3 from anti-HIV_048-172363_VR-Chain
  source 1..333: mol_type = other RNA
cagagcgtgctgacccaacccccttccgtctctgccgctccaggccagaaggttacaatctcatgcagtgggagcggatccaacattggtaatacttacgtgtcttggtatcagcagctcccgggcacggcacccaaacttctgatattcgaggacaacaagagaccttcggggatcccagataggttttcaggaagcaaaagtggcacctccgccacattggcgattactggtttacaaaccggggacgaagctgattactattgtggaacatgggactctagcctgtccggcggcggggtaatcggaaccggtactaagctaacagtgctc

SEQ ID NO: 25555 - RNA, 333 nt, synthetic construct
  misc_feature 1..333: note = derived and/or modified sequence opt3 from anti-HIV_048-171609_VR-Chain
  source 1..333: mol_type = other RNA
cagagcgtgctgacccaacccccttccgtctctgccgctccaggccaggaggttacaatctcatgcagtgcaagctcctcttcgattgggaacgacttcgtgtcatggtaccagcagctcccgggaactgcccccaaacttctgatatatggtaatagcaacagacctagtggcatcccagataggttttccgggtctaagagcggaacgtccgcgaccttgggcattacaggtttacaaactggggacgaagctgattactattgtggaacctgggacacatcactgagtaccggcggcgtattcgggactggaacaaaggtgaccgtccta

SEQ ID NO: 25556 - RNA, 333 nt, synthetic construct
  misc_feature 1..333: note = derived and/or modified sequence opt3 from anti-HIV_048-170705_VR-Chain
  source 1..333: mol_type = other RNA
cagagcgtgctgacccaacccccttccgtctctgccgctccaggccagatggttacaatctcatgcagtgggagcacttccaacattggaataaattacgtgtcttggtatcagcacgtaccgggtacggcacccaagctccttatctacgagaacgtggaaagaaggtcgggcattcctgaccggttctcagccagcaaaagtgcgacctccgctacactggggatcactggattgcagaccggcgatgaggccgactattactgtggtacatgggatacctctttaagcgcagggggagtctttggctccggcactaaggtgacagttctg

SEQ ID NO: 25557 - RNA, 333 nt, synthetic construct
  misc_feature 1..333: note = derived and/or modified sequence opt3 from anti-HIV_048-168381_VR-Chain
  source 1..333: mol_type = other RNA
cagagcgccctgacccaacccgcttccgtgtctggctcacctgggcagagtatcacaattagctgcactggaacgtcctctaacataggttcgaattacgtctcatggtatcagcagctcccaggcaccgcaccgaaacttctgatctacgagaacaatcaaagacccagcgggattcctgacaggttcagtggatccaagtctggcacaagcgccactttgggtatcaccgggttacagacaggagatgaagcggactattactgtggcacctgggatacttccctgtcagctggcggggtttttggaagtggtacaaaggtgaccgtacta

SEQ ID NO: 25558 - RNA, 333 nt, synthetic construct
  misc_feature 1..333: note = derived and/or modified sequence opt3 from anti-HIV_048-166619_VR-Chain
  source 1..333: mol_type = other RNA
cagagcgtgctgacccaacccccttccgtctctggcgcgccagggcagagagttacaatctcatgcactggaagtagctccaacattggtggctaccacacgcattggtatcagcagctcccggggaccgctcccaaacttctgatatacgaaaattctaagaggccttcgggaatcccagaccggttctcaggcagcaagagtggtacatccgcaactttggggattaccggattacaaacaggcgatgaggccgactattactgtggcacctgggatacttctctgagcgccgggggagtgtttggttccggcacaaaagtaaccgtgcta

SEQ ID NO: 25559 - RNA, 333 nt, synthetic construct
  misc_feature 1..333: note = derived and/or modified sequence opt3 from anti-HIV_048-162036_VR-Chain
  source 1..333: mol_type = other RNA
cagagcgtgctggcccaacccccttccgtctctggcgctccagggcagaccgttacaatctcatgcactggaagtagctccaacattggtggctacgacgtgcactggtatcagcagctcccggggacggcacccaaacttctgatatacaaggatgacaagcggccttctggaatcccagataggttctcgggctcaaaaagcggtaccagtgccacattggggattactggattacaaaccggcgacgaggcggattattactgtggcacatgggacacctccctgaatagagggggagtatttggtactggcacaaaggtgaccgtccta

SEQ ID NO: 25560 - RNA, 333 nt, synthetic construct
  misc_feature 1..333: note = derived and/or modified sequence opt3 from anti-HIV_048-160042_VR-Chain
  source 1..333: mol_type = other RNA
cagagcgtgctgacccaacccccttccgtctctgccgctccaggccagaaggttacaatctcatgcagtgggagctcctctaacattggaataaattacatctcgtggtatcagcagctcccgggtactgcacccaaaattcttatctacgacaacgataagagacctctgggcattccagacaggttctcagggagcaaaagtggaacgtccgccaccttgggcatcacaggtttacaaactggggatgaggcggactattactgtggaacctgggatgcttctctgagcgccggcggcgtgtttgggacaggaaccaaggtaactgtgcta

SEQ ID NO: 25561 - RNA, 333 nt, synthetic construct
  misc_feature 1..333: note = derived and/or modified sequence opt3 from anti-HIV_048-159676_VR-Chain
  source 1..333: mol_type = other RNA
cagagcgtgctgacccaacccccttccgtctctgcctcaccaggccagaaggttacaatcagttgcagcgggtcctcttcggacattggatcaaactacgtgagctggtatgtacagctcccgggtactgctcccaaacttctgatatacaagaataacgagagacctagtggcatcccagataggttctccgggtctaaaagcggaacgtccgcaaccttgggcattacaggtttacagactggggacgaagccgattattactgtggaacctgggacacatcactgagtgcgggcggcgtgtttgggaccggaactaaggtcacagtgcta

SEQ ID NO: 25562 - RNA, 333 nt, synthetic construct
  misc_feature 1..333: note = derived and/or modified sequence opt3 from anti-HIV_048-159500_VR-Chain
  source 1..333: mol_type = other RNA
cagagcgtgctgacccaacccccttccgtctctgccgctccaggccagaacgttacaatctcatgcagtgggagctggtccaatattggagcaaactacgtgtcttggtatcagcagctcccgggtactgcccccaaacttctgatatacgagaataacaagagaccttcgggcatcccagacaggttctcagggagcaagagtggaacgtccgcgaccttgggctttacaggtttacaaactggggatgaagctgactattactgtggaacctgggatacatctctgagcgccggcggcgtattcgggaccggaactaaagtgacagtccta

SEQ ID NO: 25563 - RNA, 333 nt, synthetic construct
  misc_feature 1..333: note = derived and/or modified sequence opt3 from anti-HIV_048-159421_VR-Chain
  source 1..333: mol_type = other RNA
cagagcctgctcacccaagccccctccgtgtctgctgcacctggccagacagtcactatctcatgcagtgggagcaacgccgacattggaaagaatttcgtttcctggtaccagcagtctccaggtgcggctccgaaacttctgatatatgagaacgatagaaggccctcgggcatccctgaccggttttcagggagcaagagtggaacgtccgccaccttgggcattacaggtttacaaactggggatgaagcagagtactattgtgccacctgggacgcttctctgagcggaggcggcgtgttcgggacaggaaccaaagtaactgtgcta

SEQ ID NO: 25564 - RNA, 333 nt, synthetic construct
  misc_feature 1..333: note = derived and/or modified sequence opt3 from anti-HIV_048-159333_VR-Chain
  source 1..333: mol_type = other RNA
cagagcgtgctgacccaacccccttccgcctctggcacaccagggcagagagtcactatctcatgcagtggaagcaactccaatattggttctgactcggtttactggtatcagcagctcccgggcaggtcacccaaacttctgatataccggaacaatgagcgccctagcgggatcccagatcgattcagtggatccaagtctggcacgagcgctaccttgggtattacagggttacaaactggagacgaagcagattattactgtggcacctgggacacatccctgtcagccggcggggtgtttggaaccggtactaaggtaacagtgcta

SEQ ID NO: 25565 - RNA, 333 nt, synthetic construct
  misc_feature 1..333: note = derived and/or modified sequence opt3 from anti-HIV_048-158932_VR-Chain
  source 1..333: mol_type = other RNA
cagagcgtgctgacccaacccgcctccgtctctggctcacctgggcagagtatcacaattagctgctccggatcttcgtcaaacataggtgacatcttcgttagctggtaccaacaggtgccaggcgctgcaccgaagctccttatttatgataatgacaaaagacccagtgggatccctgataggttttccggatctaagagcggcacttccgccacgctggacattaccggtttgcagacaggggatgaggcggactactattgtggaacttgggatacctcattaagtgctggcggcgtattcgggacaggaaccaaagtgactgtcctg

SEQ ID NO: 25566 - RNA, 333 nt, synthetic construct
  misc_feature 1..333: note = derived and/or modified sequence opt3 from anti-HIV_048-155811_VR-Chain
  source 1..333: mol_type = other RNA
cagagcgccctgacccaacccgcttccgtgtctggctcacctgggcagagtatcacaattagctgcactggaacgtcctctgacgtcggttacgattatgtttcgtggtaccagctccttccaggcaccccgcccaagctgttgatattcaaaaacaatgagagaccttcagggatcccagacaggtttagcggaagtaagtccggcacatctgcaactttaggtattaccgggctgcagacaggagatgaagccgactattactgtgcgacctgggatactagcctatccgctggcggcgtgttcgggacaggaaccaaagtaacggtgctc

SEQ ID NO: 25567 - RNA, 333 nt, synthetic construct
  misc_feature 1..333: note = derived and/or modified sequence opt3 from anti-HIV_048-155464_VR-Chain
  source 1..333: mol_type = other RNA
cagagcgccctgacccaacccgcttccgtgtctggctcacctgggcagagtatcacaattagctgcactggagcaacgggtgactccggccacacctacgtctcttggtatcagcagctcccagggacagccccgaaacttctgatatactcgaacaatgagagaccctcaggagttcctgataggttcagcggcagtaagtccggtacttctgcgaccttggggatcacaggattacaaaccggcgacgaagctgattattactgtggcacttgggacacaagcctgtccgccgggggagtgtttggttcaggcaccaaggtaacggtgcta

SEQ ID NO: 25568 - RNA, 333 nt, synthetic construct
  misc_feature 1..333: note = derived and/or modified sequence opt3 from anti-HIV_048-155392_VR-Chain
  source 1..333: mol_type = other RNA
cagagcgtgctgacccaacccccttccgtctctgccgctccaggccagatggttacaatctcatgcagtgggagctcctctaacattggagacaattacgtgtcgtggtatcagcagctcccgggtagaggccccaaacttctggtatacgatacttataagaggtacttggagacgcctgaccggttctcagggagcaagagtggaacctccgcaacattaggcataactggtctgcaaaccggggatgaagccgactattactgtggaacatgggatacctctctaagcgcgggcggcgtgtttgggactggaacaaaagtcaccgtgctc

SEQ ID NO: 25569 - RNA, 333 nt, synthetic construct
  misc_feature 1..333: note = derived and/or modified sequence opt3 from anti-HIV_048-155389_VR-Chain
  source 1..333: mol_type = other RNA
cagagcgtgctgacccaacccccttccgtctctgccgctccaggccagaaggttacaatctcatgcagtgggattagctccaacataggaaataacccggtgtcttggtaccagcagttccccggtactgcacctaaactccttatctataagaatgacaaaagaccatcgggcattcccgataggttttcagggagcaagagtggaacgtccgccaccctgggcatcacaggtttgcaaactggggacgaggcggattactattgtggaacctgggacacatctttaagcaccggcggcgtattcgggactggaacaaaagtgaccgtcctg

SEQ ID NO: 25570 - RNA, 333 nt, synthetic construct
  misc_feature 1..333: note = derived and/or modified sequence opt3 from anti-HIV_048-154449_VR-Chain
  source 1..333: mol_type = other RNA
cagagcgtgctgaagcaacccccttccgtctctggcgccccagggctcagagttaccatctcatgcacaggaggtagtagcaacattggcgggttcgacgtgcactggtaccagcattttccgggaactgctcccaaacttctgatatatgataatgaccagaggccttccggcatcccagatcggttctctggttcgaagtcagggacgagcgcaaccttgggaattacaggcttacagactggcgacgaggccgattactattgtgggacctgggacagttccctgtctgcgggaggtgtatttggcacagggaccaaagtgactgtccta

SEQ ID NO: 25571 - RNA, 333 nt, synthetic construct
  misc_feature 1..333: note = derived and/or modified sequence opt3 from anti-HIV_048-153379_VR-Chain
  source 1..333: mol_type = other RNA
cagagcgtgctgacccaacccccttccgtctctgccacaccaggccagaaggttactatctcatgcagtgggagcagatccaacattggatctcactacgtgtcgtggtatcagcagttcccggagtcagctcccaaactccttatatacaagaatgacaacaggcctagcggtatcccagatcggtttagtggctccaaatctgggacgagcgcaaccctgggaatttccggcttgcaaacaggtgacgaagccgattattactgtgggacttgggacacctcattaagtggaggcggcgtattcgggacaggaaccaaggtgactgtcctg

SEQ ID NO: 25572 - RNA, 333 nt, synthetic construct
  misc_feature 1..333: note = derived and/or modified sequence opt3 from anti-HIV_048-153171_VR-Chain
  source 1..333: mol_type = other RNA
cagagcgtgctgacccaacccccttccgtctctgccgctccaggccagaaggttacaatctcatgcagtgggagcacttccaacattgaggacatatacgtgtcttggtatcagcacctcccgggaacggcacccaaacttctgatctacgataataacaagagaccttcgggtattccagacaggttctcaggcagcaaaagtgggacctccgccacattggcgatcactggattacagaccggcgatgaagctgactattactgtggtacatgggatacctctctgagcgccgggggagtatttggcactggcacaaaggtgaccgtccta

SEQ ID NO: 25573 - RNA, 333 nt, synthetic construct
  misc_feature 1..333: note = derived and/or modified sequence opt3 from anti-HIV_048-152324_VR-Chain
  source 1..333: mol_type = other RNA
cagagcatggtgacccaatccccctctgtctcagccgctcctggccagaaggttacaatcagttgcagcgggacttcctctaacattggacagaattacgtgtcgtggtatcagcaactgccaggtacggcaccgaaactccttatatacgagaactcaaagagacccagcggcatccctgacaggttcagtgggtccaaatctggaaccagcgccacactgggcattactggtttgcagaccggggatgaagcggactattactgtggaacatgggatacctccttatcagctggcggcgtatttgggagtggaactaaggtgacagtcctg

SEQ ID NO: 25574 - RNA, 333 nt, synthetic construct
  misc_feature 1..333: note = derived and/or modified sequence opt3 from anti-HIV_048-146102_VR-Chain
  source 1..333: mol_type = other RNA
cagagcgtgctgacccaacccccttccgtctctgccgctccaggccagaaggttacaatctcatgcagtgggagctcctctactattggaaacaattacatatcgtggtatcagctccttccgggtacgccccctaaactgttgatctacaagaacaatgagagaccatcaggcattcccgacaggttcagcgggagtaaatccggaacctctgcaacattaggcatcactggtctgcagaccggggatgaagccgactattactgtggaacatgggataccagcctatccgcgggcggcgtgtttgggactggaacaaaggtaaccgtgctc

SEQ ID NO: 25575 - RNA, 333 nt, synthetic construct
  misc_feature 1..333: note = derived and/or modified sequence opt3 from anti-HIV_048-145984_VR-Chain
  source 1..333: mol_type = other RNA
cagagcgtgctgacccaacccctctccgtctctggcgcccctgggcagagagttacaatctcatgcactggaagtagctccaacattggttctaatttcgtgtcgtggtaccaggtacttccaggcacgaccccgaagctgttgatatttaaaaacaatgagaggccctcagggatccctgaccggttcagcggaagtaagtccggcacatctgctactttaggtattaccgggctgcagacaggagatgaagcagactattactgtggcgcctgggataccagcctatccgcgggcggggtgtttggaactggtacaaaagtcaccgtgctc

SEQ ID NO: 25576 - RNA, 333 nt, synthetic construct
  misc_feature 1..333: note = derived and/or modified sequence opt3 from anti-HIV_048-145371_VR-Chain
  source 1..333: mol_type = other RNA
cagagcgtgctgacccaacccccttccgtctctgccgcttcaggccagaaggttagtatcccatgcagcgggggaacatccaacattggtgacaattacgtgtcttggttccagcagtttccgggctcggcacccaaaatactcatctatgattcagacaagagacctagcaggattagtgatcggttctccgcctctaaaagcgggacttccgcgacgcttgacatcacccgcctgcaaacaggagatgaggctgactactattgtggcacttgggatacctcattgagtgccggtggggtatttggaacaggcaccaaggtgactgtctta

SEQ ID NO: 25577 - RNA, 333 nt, synthetic construct
  misc_feature 1..333: note = derived and/or modified sequence opt3 from anti-HIV_048-144907_VR-Chain
  source 1..333: mol_type = other RNA
cagagcgccctgacccaacccgcttccgtgtctggctcacctgggcagagtatcacaattagctgcactggaacgagaagggacgtcggtttcaactacgtttcctggtatcagcagcacccaggcaccgcaccgaagctccttatatacgagaataacaaacggccctctgggatccctgatcgcttttcgggatcaaagagcggcacaagtgccactctgggtattaccgggttgcaaacaggagacgaagcggattattactgtggcacctgggactcctctttaagcgctggcggggtgttcggaactggtacaaaagtaaccgtgctg

SEQ ID NO: 25578 - RNA, 333 nt, synthetic construct
  misc_feature 1..333: note = derived and/or modified sequence opt3 from anti-HIV_048-142298_VR-Chain
  source 1..333: mol_type = other RNA
cagagcgtgctgacccaacccccttccgcctctggcacaccagggcagagagtcactatctcatgcagtggaagctcctctacgattggtaacaattacatatcgtggtatcagctccttccgggcacaccccctaagctgttgatcttcaaaaacaatgagaggccatcagggattcccgaccggtttagcgctagtaagtccggaacctctgcaactttaggcatcaccggtctgcagacaggggatgaagccgactactattgtggaacctgggatactagcctatccgcgggcggcgttttcgggacaggaaccaaagtgacggtactc

SEQ ID NO: 25579 - RNA, 333 nt, synthetic construct
  misc_feature 1..333: note = derived and/or modified sequence opt3 from anti-HIV_048-142277_VR-Chain
  source 1..333: mol_type = other RNA
cagagcgtgctgacccaacccccttccgtctctggcgccccagggcagagaatcacaatttcatgcactggaagtagctccaacataggtgcttacgacgttcagtggtatcagcacctcccgggcacggcacccaaacttctgatctacaagaataccgagaggccttctgggattccagatcggttctcgggatcaaagagcggcacaagtgccactttggacatcaccggtttacaaacaggggatgaagcggactattactgtggaacctgggatacttccctgtctgctggcggcgtgtttgggacaggaaccaaagtaacggtgcta

SEQ ID NO: 25580 - RNA, 333 nt, synthetic construct
  misc_feature 1..333: note = derived and/or modified sequence opt3 from anti-HIV_048-141934_VR-Chain
  source 1..333: mol_type = other RNA
cagagcgtgctgacccaacccccttccgtctctggcgccccagggcagagagttacaatctcatgcactggaaacagtagcaatattggtgcttacgacgtgcactggtatcagcagctcccgggcacggcacccaaacttatgatatacgaggtatccaagaggccttctgggatcccagatcggttctcgggatcaaagagcggcaccagtgccacactgggtattactgggttgcaaaccggagacgaagcggattattactgtggcacatgggacacctccttatctgctggcggggtgtttggaagcggtactaaagtcacagtgctg

SEQ ID NO: 25581 - RNA, 333 nt, synthetic construct
  misc_feature 1..333: note = derived and/or modified sequence opt3 from anti-HIV_048-141207_VR-Chain
  source 1..333: mol_type = other RNA
cagagcgtgctgacccaacccccttccgtctctgccgctccaggccagaaggttacaatcgcatgctcagggagtagctccaacattggaaataactacgtgtcttggtatcagcagctcccgggtactgcccccaaacttctgatatacgcgaataacagaaggccttcgggcatcccagaccggttctcagctagcaagagtgggacgtccgccaccttgggaattacaggcttacaaactggtgatgaggcagactattactgtgggacctgggatacatctctgagcgccggaggcgtatttggcaccgggactaaagtgacagtccta

SEQ ID NO: 25582 - RNA, 333 nt, synthetic construct
  misc_feature 1..333: note = derived and/or modified sequence opt3 from anti-HIV_048-140796_VR-Chain
  source 1..333: mol_type = other RNA
cagagcgtgctgacccaacccccttccgtctctgccacaccaggccagaaggttactatctcatgcagtgggacgagaagcaacattggaaataactacgtgtcctggtataggcagttcccgggtaccgctcccaaactccttatatacgaggacaataagcggccttctggcatcccagcacgcttttcggggtcaaaaagcggaacaagtgccactctgggcattaccggtttgcagacaggggatgaagcggactattactgtggaacctgggatacttccttatctgctggcggcgtattcgggacaggaaccaaggtgacggtcctg

SEQ ID NO: 25583 - RNA, 333 nt, synthetic construct
  misc_feature 1..333: note = derived and/or modified sequence opt3 from anti-HIV_048-139893_VR-Chain
  source 1..333: mol_type = other RNA
cagagcgtgctgacccaacccccttccgtctctgccacaccaggccagaaggttactttctcatgcagtgggagctcctctacgatcggaaagaactacgtgtcgtggtatcaggtactcccgggtaccgctcccaaacttctgatttacaaaaataacaagagaccttcaggcataccagacaggtttagcgggagtaaatccggaacatctgcaactttgggcatcaccggtttacagacaggggatgaggccgactattactgtggaacctgggatagctccctgtcagcgggcggcgtgttcgggactggaacaaaggtcaccgtgcta

SEQ ID NO: 25584 - RNA, 333 nt, synthetic construct
  misc_feature 1..333: note = derived and/or modified sequence opt3 from anti-HIV_048-138820_VR-Chain
  source 1..333: mol_type = other RNA
cagagcgtgctgacccaacccccttccgtctctggcgccccagggcagaaggttacaatctcatgcagtggaagcggttccaacattggcaatacttacgtgtcttggtatcagcacctcccggggacggctcccaaacttctgatatacgagaacaataagagaccttcgggaatcccagacaggttctcaggcagcaaaagtgcaacctccgccacattgggtattactgggttacagaccggagatgaagcggactattactgtggcacatgggatacctctctgagcgctggcggggtatttggaactggtacaaaggtgaccgtccta

SEQ ID NO: 25585 - RNA, 333 nt, synthetic construct
  misc_feature 1..333: note = derived and/or modified sequence opt3 from anti-HIV_048-135858_VR-Chain
  source 1..333: mol_type = other RNA
cagagcgtgctgacccaacccccttccgcctctggcacaccagggcagagagtcactatctcatgcagtggaagctcctctaacattggttcgtcatacgtttattggtaccagcagttcccgggcaggagcccccggctccttatatatcgcaataacgagcgacctagtgggatcccagaccgtttttccggatctaagagcggcacgtccgctaccctgggtattacagggttgcaaactggagatgaagcagactactattgtggcacctgggatacatcattaagtgccggcggggtgttcggaaccggtactaaagtaacagtgctg

SEQ ID NO: 25586 - RNA, 333 nt, synthetic construct
  misc_feature 1..333: note = derived and/or modified sequence opt3 from anti-HIV_048-134968_VR-Chain
  source 1..333: mol_type = other RNA
cagagcgtgctgacccaacccccttccgtctctgccgctccaggccagaaggttacaatcttctgctcagggagtagctccaacattggaaagaattacgtgtcttggtatcagcagctcccgggtactgcacccaaacttctgatatacgagaactcgaaaagaccttcaggcatcccagacaggtttagcgggagtaagtccggaacgtctgccaccttgggcattacaggtttacaaactggggatgaagcggactattactgtggaacctgggatacaagcctgtccgctggcggcgtattcgggtcaggaaccaaagtgactgtccta

SEQ ID NO: 25587 - RNA, 333 nt, synthetic construct
  misc_feature 1..333: note = derived and/or modified sequence opt3 from anti-HIV_048-134312_VR-Chain
  source 1..333: mol_type = other RNA
cagagcgtgctgacccaacccccttccgcctctggcacaccagggcagagagtcactatctcatgcagtggaagctcctctaacattggtaataactacgtttcgtggtataggctccttccgggcacggctcccaagctgttgatatacaaaaatgacaaccggccttcagggatcccagatcgcttcagcggaagtaagtccggcacctctgcaacattaggtattagcgggctgcagactggagacgaggccgattattactgtggcacctgggacacatccctatcaggcgggggagtgtttggtaccggcactaaagtaacagtgctc

SEQ ID NO: 25588 - RNA, 330 nt, synthetic construct
  misc_feature 1..330: note = derived and/or modified sequence opt3 from anti-HIV_048-132253_VR-Chain
  source 1..330: mol_type = other RNA
agcgccctgacccagcccgcttccgtgtctggctcacctgggcaaagtatcgcaattagctgcacaggaacttcctctgacgtcggttacgatctcgtttcgtggtatcagcagcacccaggcacggccccgaaacttctgatatacgacaacaataagagaccctcagggatccctgataggttcagcggaagtaagtccggcacctctgcgacattgggtattactgggttacagaccggagacgaggctgattattactgtggcacatgggacaccagcctgtccgccggcggggtgtttggatcaggtactaaagtaacagtgcta

SEQ ID NO: 25589 - RNA, 333 nt, synthetic construct
  misc_feature 1..333: note = derived and/or modified sequence opt3 from anti-HIV_048-130710_VR-Chain
  source 1..333: mol_type = other RNA
cagagcgtgctgacccaacccccttccgtcgcgggcgctccagggcagagagttacaatctcttgcactggaaacacgtcaaatattggtggctacgacgtgcactggtatcagcagctcccggggacaccccctaaacttctgatattcaagaacaatgagaggccaagtggaatccccgatcggtttagcggctccaagtctggtacctcggcaactttggggattaccggattacaaacaggcgacgaagccgattactattgtggcacctgggacacttcactgagcgccgggggagtattcggtacaggcaccaaagtgacggtccta

SEQ ID NO: 25590 - RNA, 333 nt, synthetic construct
  misc_feature 1..333: note = derived and/or modified sequence opt3 from anti-HIV_048-128564_VR-Chain
  source 1..333: mol_type = other RNA
cagagcgtgctgacccaacccccttccgcctctggcacaccagggcagagagtcactatctcatgcagtggaagctcctctaacattggttcgaatacggttaactggtaccagcagctcccgggcaccgctcccaaacttctgatatataagaatacagagaggccttcagggatcccagaccggttcagcggaagtaagtccggcacttctgcaaccttggatattacaggtttacaaaccggggacgaagccgattactattgtggaacttgggacacaagcctgtccgcgggcggcgtgtttgggaccggaacgaaagtaactgtgcta

SEQ ID NO: 25591 - RNA, 333 nt, synthetic construct
  misc_feature 1..333: note = derived and/or modified sequence opt3 from anti-HIV_048-126702_VR-Chain
  source 1..333: mol_type = other RNA
cagagcgtgctgacccaacccccttccgcctctgctgcaccaggccagagagtcacaatctcatgcagtgggagcaactccaatattggaaacaattacgtttcttggtatcagcagctcccgggtactgcccccaaacttctgatatacgacaactcgaagaggccttcaggcatcccagatcggttcagcgcgagtaagtccgggacgtctgctaccttgggaattacaggcttacaaactggtgacgaggccgattattactgtgggacctgggacacaagcctgtccgcaggaggcgtgtttggcaccgggactaaagtaacagtgcta

SEQ ID NO: 25592 - RNA, 333 nt, synthetic construct
  misc_feature 1..333: note = derived and/or modified sequence opt3 from anti-HIV_048-124521_VR-Chain
  source 1..333: mol_type = other RNA
cagagcgtgctgacccaacccccttccgtctctggcgccccagggcagagagttacaatctcatgcactggaagtagctccacgttcggtggctacgacgtgtattggtaccagcagattccggggaccgctcccaagctccttatatatgagaacaataaaaggccttctggaatcccagatcggttttcgggctcaaagagcggtacaagtgcaactctggccattaccgggttgcaaacaggagacgaagcggattactattgtggcacctgggacggctccttatctactgggggagtaatcggtacaggcaccaaagtgacggtcctg

SEQ ID NO: 25593 - RNA, 333 nt, synthetic construct
  misc_feature 1..333: note = derived and/or modified sequence opt3 from anti-HIV_048-122740_VR-Chain
  source 1..333: mol_type = other RNA
cagagcgtgctgacccaacccccttccatgtctgccgctccaggccagtcagtcacaatcagttgcagcgggtccactttcaatattgagaagcaccaggttacgtggctcagacatcttccgggaaccgcacccacatctgtgataatcatgaactcgcagaggccttcaggtactccagaccggtttagcggcagtaaatccgggacctctgccacactggcgattaccggattgcaaactggcgatgaagctgactactattgtggtacatgggatgggagcttatccaccggaggcgtaatcggcacggggactaaggtgaccgtcctg

SEQ ID NO: 25594 - RNA, 327 nt, synthetic construct
  misc_feature 1..327: note = derived and/or modified sequence opt3 from anti-HIV_048-119536_VR-Chain
  source 1..327: mol_type = other RNA
gagctgacccagagcccctccgtgtctgccgctcctggcgaaaaggtcacaatctcatgcagtgggactaacagcaatattggatactattacgtttcctggtatcaacagttcccaggtacggcaccgaaagtggtaatatacgagaacaccaagagaccctctggcatccctgacaggttttcggggtcaaaaagcggaacaagtgccactctcggcattaccggtcttcagacaggggatgaagcggactattactgtggaacctgggatacttccctgtctgctggcggcgtgttcgggagcggaacaaaggtcaccgtgttg

SEQ ID NO: 25595 - RNA, 333 nt, synthetic construct
  misc_feature 1..333: note = derived and/or modified sequence opt3 from anti-HIV_048-116929_VR-Chain
  source 1..333: mol_type = other RNA
cagagcgtgctgacccaacccccttccgtctctggcgccccagggcagagagttacaatctcatgcactggaagtagctccaacattggtgactacgatgtgcactggtatcagcagctcccgggcacggctcccaaacttctgatatacaggaataaccaacggccttctggggtaccagaccgcttctcgggatcaaagagcggcaccagtgcaacattgggtatcactgggttacagaccggagatgaggccgactattactgtggcacatgggatgcgtccctgtctgctggcggggtgtttggaaccggtactaaggtcacagtgcta

SEQ ID NO: 25596 - RNA, 333 nt, synthetic construct
  misc_feature 1..333: note = derived and/or modified sequence opt3 from anti-HIV_048-116577_VR-Chain
  source 1..333: mol_type = other RNA
cagagcgtgctgacccaacccccttccgcctctggcacaccagggcagagagtcactatctcatgcagtggaagctcctctaacattggttcgaattacgtttcatggtatcaggtgctcccgggcacggctcccaaacttctgatatacaagaacaataagaggcctagcgggatcccagaccggttcagtggatccaaatctggcaccagcgcaacattgggtattactgggttacagaccggagatgaggccgactattactgtgcgacatgggatacctccctgtcagctggcggcgtatttgggactggaacaaaggtgaccgtccta

SEQ ID NO: 25597 - RNA, 333 nt, synthetic construct
  misc_feature 1..333: note = derived and/or modified sequence opt3 from anti-HIV_048-116046_VR-Chain
  source 1..333: mol_type = other RNA
cagagcgtgctgacccaacccccttccgtctctggcgccccagggcagagagttacaatctcatgcactggaagtagctccaacattggtggctacgacgtgcactggtatcagcagttcccggggacggctcccaagctccttatatacgataatgacaaaaggccttctggaatcccagatcggttttcgggctcaaagagcggtaccagtgcaacactggggattactggattgcaaaccggcgacgaggccaactattactgtggcgcgtgggatacatccttatctgctgggggagtattcggtaccggcactaaagtgacagtcctg

SEQ ID NO: 25598 - RNA, 333 nt, synthetic construct
  misc_feature 1..333: note = derived and/or modified sequence opt3 from anti-HIV_048-115875_VR-Chain
  source 1..333: mol_type = other RNA
cagagcgtgctgacccaacccccttccgtctctgccgctccaggccagagagttacagtgtcatgcagtgggagctcctctaacatcggaaataacttcgtatcgtggtaccagcacctcccgggtactgcacccaaacttctgatttatgacaattcaaacaggcctagcggcataccagatcggtttagtgggtccaagtctggaacgagcgccaccttgggcatcacaggtttacatactggggacgaggcggattactattgtggaacctgggacacatccctgtcagctggcggcgtgttcgggagtggaaccaaggtcactgtgcta

SEQ ID NO: 25599 - RNA, 333 nt, synthetic construct
  misc_feature 1..333: note = derived and/or modified sequence opt3 from anti-HIV_048-115599_VR-Chain
  source 1..333: mol_type = other RNA
cagagcgtgctgacccaacccccttccgtctctgccgctccaggccagatggttacaatctcatgcagtgggagctcctctaacattggatcgcactcagtgagctggtaccagcatttcccgggtactgcacccaagctcgtaatagaggaaaatgaccagagacctagtggcatcccagataggttttccgggtctaaaagcggaacgtccgccacccttggcattacaggtctgcaaactggggacgagggagattattactgtggcacctgggacacatcattgagtggcgggggagtgttcggtaccggcactaaggtcacagtgtta

SEQ ID NO: 25600 - RNA, 333 nt, synthetic construct
  misc_feature 1..333: note = derived and/or modified sequence opt3 from anti-HIV_048-113988_VR-Chain
  source 1..333: mol_type = other RNA
cagagcgtgctgacccaacccccttccgtctctgccgctccaggccagatggttacaatctcatgcagtgggagctcccacaacattggagagaattacgtgtcttggtatcagcatctcccgggtactgcacccaaacttctgatattcaagaacaatgaaagaccttcgggcatcccagacaggttttcagggagcaagagtggaacgtccgccaccttgggcattacaggtttacagactggggatgaggcggactactattgtggaacctgggatacatctctgagcgctggcggcgtattcgggaccggaactaaagtgacagtccta

SEQ ID NO: 25601 - RNA, 333 nt, synthetic construct
  misc_feature 1..333: note = derived and/or modified sequence opt3 from anti-HIV_048-112989_VR-Chain
  source 1..333: mol_type = other RNA
cagagcgtgctgacccaacccccttccgcctctggcacaccagggcagagagtcactctctcatgcagtggaggtagctccaacatcggcaatgacaacgtttactggtatcagcagaggccggggacgacccccaaacttctgatttacaatgataaccggcgcccttctggaacaccagaccgattctcgggctcaaagagcggtaccagtgctactttggcaataacagggttacaaaccggagatgaggccgactattactgtggcacttgggatggctccctgtctacagggggagtgatcggtaccggcacgaaggtaactgtgcta

SEQ ID NO: 25602 - RNA, 333 nt, synthetic construct
  misc_feature 1..333: note = derived and/or modified sequence opt3 from anti-HIV_048-112435_VR-Chain
  source 1..333: mol_type = other RNA
cagagcgtgctgacccaacccccttccgtctctgccgctccaggccagaaggtttcaatcagttgcagcgggtcctcttcgaacattggaaagaattacgtgtcatggtatcagcagctcccgggtacagcacccaaacttctgatattcaaaaacaatgagagacctagcggcatcccagacaggtttagtgggtccaagtctggaactagcgccacgttgggcattaccggtttacaaacaggggatgaagcggactactattgtgctacttgggatacctccctgtcagccggaggcgtattcggcacagggaccaaagtgactgtccta

SEQ ID NO: 25603 - RNA, 333 nt, synthetic construct
  misc_feature 1..333: note = derived and/or modified sequence opt3 from anti-HIV_048-111339_VR-Chain
  source 1..333: mol_type = other RNA
cagagcgtgctgacccaacccccttccgtctctgccgctccaggccagaaggttacaatctcatgcactgggagtagctccaacattggaggttacgcagtgcactggtatcagcaggtaccggccacggcgcccaaactccttatatacgagaataacgaaagaccttctggcatcccagacaggttctcggggtcaaagagcggaaccagtgctacactgggcattactggtttgcaaaccggggatgaggccgactattactgtggaacatgggatacctccttatctgcaggcggcgtgtttgggactggaacaaaagtcaccgtgctg

SEQ ID NO: 25604 - RNA, 333 nt, synthetic construct
  misc_feature 1..333: note = derived and/or modified sequence opt3 from anti-HIV_048-111055_VR-Chain
  source 1..333: mol_type = other RNA
cagagcgccctgacccaacccgcttccgtgtctggctcacctgggcagagtatcacaattagctgcactggaacgagatccgacgtcggttacaactatgtttcttggtaccagcagcacccaggcaaggcaccgaaactccttatatatgagaataccaagaggccctcggggatccctgatcggttctcaggaagcaaaagtggcacatccgccactctgggtattaccgggttgcaaacaggagacgaagcggattactattgtggcacctgggacacttctttaagcgctggcggggtgtttggatccggtacaaaggtaaccgtgctg

SEQ ID NO: 25605 - RNA, 333 nt, synthetic construct
  misc_feature 1..333: note = derived and/or modified sequence opt3 from anti-HIV_048-111027_VR-Chain
  source 1..333: mol_type = other RNA
cagagcgtgctgacccaacccccttccgtctctgccgctccaggccagaaggttacaatctcatgcagtgggagcaactccaatctcggaaacaattacgtgtcttggtatcagcaccttccgggtactgcacccagactgttgatttacgaggacaaaaagaggccttcgggcataccagatcggttctcagggagcaaaagtggagcctccgcgacgttagacatcaccggcctgcagacaggtgatgaagctgactattactgtgggatttgggatacttctctaagcgccggaggcgtatttggcaccgggacaaaggtgaccgtcctc

SEQ ID NO: 25606 - RNA, 333 nt, synthetic construct
  misc_feature 1..333: note = derived and/or modified sequence opt3 from anti-HIV_048-109721_VR-Chain
  source 1..333: mol_type = other RNA
cagagcgtgctgacccaacccccttccgtctctgccgctccaggccagaaggttacaatctcatgcagtgggagctcctctgacattggatcgaacttcgtgtcatggtaccagcacctcccgggtactgcacccagacttctgatatatgagaataacaggcggcctagcggcatcccagatcgctttagtgggtccaaatctggaacgagcgccaccttggcgattacaggcttacagactggtgacgaagctgattactattgtgggacctgggacacatccctgaatcgaggaggcgtattcggcaccgggactaaggtgacagtccta

SEQ ID NO: 25607 - RNA, 333 nt, synthetic construct
  misc_feature 1..333: note = derived and/or modified sequence opt3 from anti-HIV_048-109666_VR-Chain
  source 1..333: mol_type = other RNA
cagagcgtgctgacccaacccccttccatgtctgccgctccaggcgagagagtcacaatctcatgcagtgggagctcctctaacattggaaatcaccatgtttcgtggtaccagcagaggccgggtactgcacccaagctccttatatatgaaaacaatgagcggccttcaggcatcccagaccgcttcagcgggagtaaatccggatctagcgccacgctggcgattaccggcttgcagacaggtgatgaagctgactactattgtgggacttgggatggacgattaaacatcggcggcgtgattgggaccggaacaaaggtaaccgtgctg

SEQ ID NO: 25608 - RNA, 333 nt, synthetic construct
  misc_feature 1..333: note = derived and/or modified sequence opt3 from anti-HIV_048-109196_VR-Chain
  source 1..333: mol_type = other RNA
cagagcgtgctgacccaacccccttccgtctctgccgctccaggccagaaggttacaatctcatgcagtgggagctcctctaacattggaaataactacgtgtcgtggtatcagcagctcccgggtactgcacccaaacttctgatatacgagacgaataagagaccttcaggcatcccagacaggttcagcgggagtaaatccggaacctctgccacattggcgattactggcttacaaaccggtgatgaagctgactattactgtgggacatgggataccagcctgtccggaggcggcgtatttgggactggaacaaaggtgaccgtccta

SEQ ID NO: 25609 - RNA, 333 nt, synthetic construct
  misc_feature 1..333: note = derived and/or modified sequence opt3 from anti-HIV_048-109051_VR-Chain
  source 1..333: mol_type = other RNA
cagagcgtgctgacccaacccccttccgtctctgccgctccaggccagaaggttacaatctcatgcagtgggaacaatagcaacatggtgaataactacatttcctggtatcagctccttccgggaactccccctaaactgttgatattcaagaataacgagagaccatctggtatccccgacaggttttcgggctcaaaaagcgggacgagtgcaaccttaggaattacaggcctgcagactggtgatgaagccgactactattgtgggacctgggatacatccctatctgcgggaggcgtattcggcaccgggactaaggtgacagtcctc

SEQ ID NO: 25610 - RNA, 333 nt, synthetic construct
  misc_feature 1..333: note = derived and/or modified sequence opt3 from anti-HIV_048-108570_VR-Chain
  source 1..333: mol_type = other RNA
cagagcgccctgacccaacccccttccgtgtctgctgcaccaggccagaaggtcacaatctcatgcagtgggaaaagctccaacattggaactaatttcgtttcttggtaccagcagtttccggaggccgcgcccaagctccttatatatgacaacaataaaagaccttcgggtatcccagataggttctcaggcagcaagagtgggacgtccgctaccctgggaattacaggcttgcaaactggtgacgaagccgattactattgtgggacctgggacggatctttaagcacaggcggcgtgatcgggaccggaactaaagtaacagtgctg

SEQ ID NO: 25611 - RNA, 327 nt, synthetic construct
  misc_feature 1..327: note = derived and/or modified sequence opt3 from anti-HIV_048-108033_VR-Chain
  source 1..327: mol_type = other RNA
gagctgacccagagcccctccgtgtctgccgctcctggccaaagagtcacaatctcatgcagtgggaacagctccaatattggaaacaattacgtttcttggtatcagctccttccaggtactgcaccgaagctgttgatatacaaaaacgacaagaggccctcgggcatccctgatcggttctcagggagcaaaagtggaacgtccgccaccttaggcattacaggtctgcagactggggacgaagcggattattactgtggaacctgggacacatctctaagcaccggcggcgtgtttgggactggaacaaaggtaaccgtgctc

SEQ ID NO: 25612 - RNA, 333 nt, synthetic construct
  misc_feature 1..333: note = derived and/or modified sequence opt3 from anti-HIV_048-107279_VR-Chain
  source 1..333: mol_type = other RNA
cagagcgtgctgacccaacccccttccgtctctgccgctccaggccagaaggttatcatttcatgcagtgggagctcctctaacataggaaagaattacgtgtcgtggtatcagcacctcccgggtacagcacccaaacttctgatctacgagaacaataaaagaccttcaggcattccagacaggttcagcgggagtaagtccggaacttctgccacgttgggcatcaccggtttacagacaggggatgaagcggactattactgtggaacttgggatgctagcctgtccgccggcggcgtactagggaccggaacaaaagtgaccgtcctc

SEQ ID NO: 25613 - RNA, 333 nt, synthetic construct
  misc_feature 1..333: note = derived and/or modified sequence opt3 from anti-HIV_048-106271_VR-Chain
  source 1..333: mol_type = other RNA
cagagcgtgctgacccaacccccttccgtctctgccgctccaggccagaaggttacaatctcatgcagtgggagcagatccaacattggatctaattacatatcgtggtatcagcagctcccgggtactgcacccaaacttctgatctacaagaacgacaaaaggccttcaggcattccagatcggttcagcgggagtaagtccggaacgtctgccatcttgggcattaccggtttacaaacaggggacgaggcggattattactgtggagcttgggacactagcctgtccgccggcggcgtgtttgggaccggaacaaaagtaaccgtgcta

SEQ ID NO: 25614 - RNA, 333 nt, synthetic construct
  misc_feature 1..333: note = derived and/or modified sequence opt3 from anti-HIV_048-106054_VR-Chain
  source 1..333: mol_type = other RNA
cagagcgtgctgacccaacccccttccgtctctgccgctccaggccagcaggttacaatctcatgcagtgggagcacttccaacattggaaataactacgtgtcttggtatcagcaagtaccgggtacggcacccaagctccttatatacgacaataacaatagaccttcgggcatcccagataggttctcagggagcaaaagtggaacctccgccacactgggcatttctggtttgcagactggggacgaggcggattattactgtggaacctgggacaccagcttatccggcggcggggtgtttggaacaggtactaaggtcacagtgctg

SEQ ID NO: 25615 - RNA, 333 nt, synthetic construct
  misc_feature 1..333: note = derived and/or modified sequence opt3 from anti-HIV_048-104848_VR-Chain
  source 1..333: mol_type = other RNA
cagagcgccctgacccaacccgcttccgtgtctggctcacctgggcagagtatcacaattagctgcactggaacgtcctctgacgtcggttacaactatgtttcgtggtaccagcagctcccaggcaccgcaccgaaacttctgatattcgataatgacgatagaccctcagagatccctgacaggtttagcgggagtaagtccggaacatctgccactttgggcattaccggtttacaaccaggggatgaagcggactattactgtggaacatgggatagctccctgtcagctggcggcgtgttcgggaccggaactaaggtaacagtgcta

SEQ ID NO: 25616 - RNA, 333 nt, synthetic construct
  misc_feature 1..333: note = derived and/or modified sequence opt3 from anti-HIV_048-104638_VR-Chain
  source 1..333: mol_type = other RNA
cagagcgtgctgacccagcccccttccgcctctggcacaccagggcacagagtcactatctcatgcagtggaaacagctccaatattggtggcaaccatgtttactggtatcaacaggtgccggggacgacccccaagctccttatatacaggaataacgagcggccttctggaatcccagaccgcttctcgggctcaaaaagcggtacaagtgctactctggggattaccggattgcagacaggcgatgaagcagactattactgtggcacctgggatacttccttatctgccgggggagtatttggtacaggcaccaaggtgacggtcctg

SEQ ID NO: 25617 - RNA, 333 nt, synthetic construct
  misc_feature 1..333: note = derived and/or modified sequence opt3 from anti-HIV_048-104567_VR-Chain
  source 1..333: mol_type = other RNA
cagagcgtgctgacccaacccccttccgcctctggcacaccagggcagagagtcactatctcatgcagtggaagcaactccaatattggtacgaacttcgttaattggtaccagcacgtgccgggcagggctcccaagctccttatatataaaaacaccgagcggccttctgggatcccagaccgcttttcgggatcaaagagcggcacaagtgcaactctggatattaccggtttgcagacaggggacgaagccgattactattgtggaacctgggacacttccttatctgcgggcggcgtattcgggacaggaaccaaagtgacggtcctg

SEQ ID NO: 25618 - RNA, 333 nt, synthetic construct
  misc_feature 1..333: note = derived and/or modified sequence opt3 from anti-HIV_048-102804_VR-Chain
  source 1..333: mol_type = other RNA
cagagcgtgctgacccaacccccttccgtctctacagccccaggccagaaggttactatctcatgcagtgggagctcctctaacattggatactcgtatgtgtcatggttccagcacctcccgggtacggctcccaaacttctgatatacggcaatagcaacagacctagtggggtaccagacaggttttccggatctaagagcggcacctccgcatcattggccatcacaggtttacagactggggatgaggcggactattactgtggaacctgggatagtagcctgtctgctggcggcgtgttcgggacaggaaccaaagtcactgtgcta

SEQ ID NO: 25619 - RNA, 333 nt, synthetic construct
  misc_feature 1..333: note = derived and/or modified sequence opt3 from anti-HIV_048-101676_VR-Chain
  source 1..333: mol_type = other RNA
cagagcgtgctgacccaacccccttccgtctctggcgccccagggcagtcagttacaatcagttgcactggaacgagctccaacattggtgacttcgatgtgcactggtaccagcagctcccgggcaccgctcccaaacttctgttgtatgagaataacaagagaccttctgggataccagacaggttttcgggatcaaagagcggcacaagtgcaactttagccatcaccggtctgcaaacaggggatgaagcggactactattgtggaacctgggatggctccctatctactggcggggtaattggaacaggtaccaaagtgacggtcctc

SEQ ID NO: 25620 - RNA, 333 nt, synthetic construct
  misc_feature 1..333: note = derived and/or modified sequence opt3 from anti-HIV_048-097603_VR-Chain
  source 1..333: mol_type = other RNA
cagagcgtgctgacccaacccccttccgtctctgccgctccaggccagaaggttacaatctcatgcagtgggagctcctctaacattggaaataactacgtgtcgtggtatcagcagctcccgggtactgcacccaaacttctgatatacgacacggtaaagagaccttcaggcatcccagataggttcagcgggagtaaatccggaacctctgccacattgggcattactggtttacaaaccggggacgaggcggattattactgtggaacatgggacagctccctgtcaggcggcggggtgtttggaaccggtactaaggtcacagtgcta

SEQ ID NO: 25621 - RNA, 333 nt, synthetic construct
  misc_feature 1..333: note = derived and/or modified sequence opt3 from anti-HIV_048-097107_VR-Chain
  source 1..333: mol_type = other RNA
cagagcgtgctgacccaacccccttccgtctctgccgctccaggccagaaggttacaatctcatgcagtgggagctcctctaacattgagaataactacgtgtcgtggtatagacaggtaccgggaactgcacccaaactccttatatacaagaatgacaacaggccttcaggtatcccagatcggttcagcggcagtaaatccgggacgtctgccaccctgggaattacaggcttgcagactggtgacgaagcggattattactgtgggatctgggacaccagcttatccgctggaggcgtgtttggcacagggaccaaggtcactgtgctg

SEQ ID NO: 25622 - RNA, 333 nt, synthetic construct
  misc_feature 1..333: note = derived and/or modified sequence opt3 from anti-HIV_048-096871_VR-Chain
  source 1..333: mol_type = other RNA
cagcccgtgctgacccaacctccaagcgcctccggcacaccggggcagagagtcactatctcttgctcaggaagtagctccaacattggttctaattacgtttattggtaccagcagctccccggcacgacccctaaacttctgatatataggaacaatcaacggccatcggggatccccgaccgcttctcaggaagcaagagtggcacatccgctactttgggtattaccgggttacagacaggagatgaggcagactactattgtggcacctgggatacttctctgagcacaggcggggtgtttggaaccggtacgaaggtaactgtgcta

SEQ ID NO: 25623 - RNA, 333 nt, synthetic construct
  misc_feature 1..333: note = derived and/or modified sequence opt3 from anti-HIV_048-096668_VR-Chain
  source 1..333: mol_type = other RNA
cagagcgtgctgacccaacccccttccgtctctgccgctccaggccagaaggttacaatctcatgcagtgggagcggatccaacattggtaataactacgtgtcttggtatcagcagctcccgggcactgcacccaaacttctgatatacaagaatacggagagaccttcggggatcccagacaggttctcaggaagcaaaagtggcacctccgccacattggatattactggtttacaaaccggggacgaagcggattattactgtggaacatgggacacctctctgagcgctggcggcgtatttgggactggaacaaaggtgaccgtccta

SEQ ID NO: 25624 - RNA, 333 nt, synthetic construct
  misc_feature 1..333: note = derived and/or modified sequence opt3 from anti-HIV_048-095236_VR-Chain
  source 1..333: mol_type = other RNA
cagagcgtgctgacccaacccccttccgtctctgccccaccgggccagaaggttacaatctcatgcagtgggactacgagcaacattggatccaattacgtggcttggtatcagcagctccccggtaccgcacctaaacttgtaatatacgagaactctaagagaccatcgggcatccccgacaggttctcagggagcaaaagtggaacatccgccactctgggcattaccggtttgcaaacaggggatgaagcggactattactgtggaacctgggatacttctttaagcgctggcggcgtgtttgggtccggaacaaaggtcaccgtgctg

SEQ ID NO: 25625 - RNA, 333 nt, synthetic construct
  misc_feature 1..333: note = derived and/or modified sequence opt3 from anti-HIV_048-094155_VR-Chain
  source 1..333: mol_type = other RNA
cagagcgtgctgacccaacccccttccgtctctgccgctccaggccagaaggttacagtgtcatgcagtgggagctcctctgacatcggagagaactacgtatcgtggtatcagcagttcccggaaactgcacccaaactccttatttacgataataacaagagaccttcaggtataccagacaggtttagcggcagtaaatccgggacgtctgccaccctggcgatcacaggattgcaaactggcgatgaggctgactattactgtggtacctgggatagctccttatcagccgggggagtgttcggcacaggcaccaaggtcactgtgctg

SEQ ID NO: 25626 - RNA, 333 nt, synthetic construct
  misc_feature 1..333: note = derived and/or modified sequence opt3 from anti-HIV_048-093219_VR-Chain
  source 1..333: mol_type = other RNA
cagcccctgctcacccaacctccagccgtgagcgctacaccgggccagagagtcactatctcctgcacggggtcttcaagtaacattggaaggaccttcgttaattggtaccagcagcttcccggtacagcacctaagctgttgatatatgagaacagcaaacggccatccggcatccccgaccgcttttctgggtcgaagtcaggaactagcgccaccttaggcattacaggtctgcaaaccggggatgaagcggactactattgtggaacttgggatacaagtctatccgctggcggcgtgttcgggtctggaaccaaagtaacggtgctc

SEQ ID NO: 25627 - RNA, 333 nt, synthetic construct
  misc_feature 1..333: note = derived and/or modified sequence opt3 from anti-HIV_048-092976_VR-Chain
  source 1..333: mol_type = other RNA
cagagcgtgctgacccaacccccttccgtctctgccgcttcaggccagaaggttacaatcagttgcagcgggtcctcttcgaacattggaaataactacgtgtcatggtatcagcacctcccaggtactgcaccgaaacttctgatatacaagaatgacaaaagacccagcggcatccctgataggttcagtgggtccaagtctggaacgagcgccaccttgggcattacaggtttacagactggggacgaggcggattattactgtggaacctgggacacatccctgtcagctggcggcgtatttgggaccggaactaaagtgacagtccta

SEQ ID NO: 25628 - RNA, 333 nt, synthetic construct
  misc_feature 1..333: note = derived and/or modified sequence opt3 from anti-HIV_048-090866_VR-Chain
  source 1..333: mol_type = other RNA
cagagcgtgctgacccaacccccttccgtctctgccgctccaggccagaaggttacaatctcatgcagtgggagcagatccaacattggatctaattacatatcgtggtatcagcagctcccgggtactgcacccaaacttctgatctacgacaacaataagaggccttcaggcattccagatcggttcagcgggagtaaatccggaacgtctgccaccttgggcatcacaggtttacaaactggggacgaggcgtattactattgtggaacctgggatacaagcctgtccgctggcggcgtgtttgggtcaggaaccaaggtaactgtgcta

SEQ ID NO: 25629 - RNA, 333 nt, synthetic construct
  misc_feature 1..333: note = derived and/or modified sequence opt3 from anti-HIV_048-090650_VR-Chain
  source 1..333: mol_type = other RNA
cagagcgccctgacccaacccgcttccgtgtctggctcactcgggcagagtatcacaattagctgctccggatcttcgtcaactataggtaacaattacgtcagctggtatcaggttcttcctggcgcagccccaaagctgttgatctgtaaaaacaatgagagaccgagtgggattcccgacaggttctccggatctaagagcggcacgtccgcgaccttaggtatcacagggctgcagactggagatgaagctgactactattgcggcacctgggatacatcactaagtgccggcggggtgtttggaaccggtactaaagtaacagtgctc

SEQ ID NO: 25630 - RNA, 333 nt, synthetic construct
  misc_feature 1..333: note = derived and/or modified sequence opt3 from anti-HIV_048-089009_VR-Chain
  source 1..333: mol_type = other RNA
cagagcgtgctgacccaacccccttccgtctctgccgctccaggccagaaggttacaatctcatgcagtgggggaagctccaacattggtaataactacgtgtcttggtatcagcagctcccggagactgcacccaaacttataatctacgacaataacaagagaccttcgggcattcacgataggttctcagggagcaaaagtggaacgtccgccaccctggacatcacagcgttgcaaactggcgatgaagctgactattactgtggtacctgggatacatctttaagcgccgggggagtatttggcaccggcactaaggtgacagtcctg

SEQ ID NO: 25631 - RNA, 333 nt, synthetic construct
  misc_feature 1..333: note = derived and/or modified sequence opt3 from anti-HIV_048-088654_VR-Chain
  source 1..333: mol_type = other RNA
cagagcgccctgacccaacccagatccgtgtctgctgcacctggccagaaggtctcaatcagttgcagcgggaggtccacaaacctcggatacaattatgtttcttggtaccagcaccttccaggtgccgcgccgaaagtgctgatttatgagaacaataagcggccctcgggcatacctgaccgcttctcagggagcaaaagtggaacttccgctacgttgggcatcaccggtttacagacaggggatgaagccgactactattgtggaacttgggatacctctctgagcgcaggcggcgtatttgggtccggaacaaaggtgaccgtccta

SEQ ID NO: 25632 - RNA, 333 nt, synthetic construct
  misc_feature 1..333: note = derived and/or modified sequence opt3 from anti-HIV_048-086513_VR-Chain
  source 1..333: mol_type = other RNA
cagagcgccctgacccaacccccttccgtgtctgctgcaccaggccagaaggtcacaatctcatgcagtgggagcacttccaacattggaaataactacgtttcttggtatcagcagctcccgggtacggcccccaaacttctgatatacaagaatgacaacagaccttcgggcatcccagataggttctcaagcagtaaatccgggacctctgcgacattgggaattactggcttacaaaccggtgacgaggctgattattactgtgggatctgggacacaagcctgtccgccggaggcgtgtttggcaccgggactaaggtaacagtgcta

SEQ ID NO: 25633 - RNA, 324 nt, synthetic construct
  misc_feature 1..324: note = derived and/or modified sequence opt3 from anti-HIV_048-086024_VR-Chain
  source 1..324: mol_type = other RNA
ctggcccagccccctagcgtgtccggcaccccagggcaaagagtcacaatctcttgctcaggaagtagctccaacattggttctaatgctgttaactggtaccagcagttcccgggcactgcacccaagctccttatatatgacacggataaaaggccttcggggatcccagaccggttttcaggaagcaagagtggcacctccgccattctgggtatcacagggttgcagactggagatgaggcggactactattgtggcgcttgggatacctctttaagcgccggcggggtgttcggaacaggtaccaaagtaactgtgctg

SEQ ID NO: 25634 - RNA, 333 nt, synthetic construct
  misc_feature 1..333: note = derived and/or modified sequence opt3 from anti-HIV_048-085857_VR-Chain
  source 1..333: mol_type = other RNA
cagagcgccctgacccaacccagatccgtgtctggctcactcgggcagagtgtcacaatcagctgcactggaacgacctccgacgttggtttcgattacgtgtcttggtatcaggtacttcctggcacagctccaaagctgttgatttacaaaaacgacaagaggccgtcggggatacccgatcggttttcaggaagcaaaagtggcacttccgcaaccttaggtatcacagggctgcagaccggagacgaggccgattattactgtggcacttgggacacatctctaagcaccggcggggtgttcggaacgggtactaaggtcaccgtgctc

SEQ ID NO: 25635 - RNA, 333 nt, synthetic construct
  misc_feature 1..333: note = derived and/or modified sequence opt3 from anti-HIV_048-084277_VR-Chain
  source 1..333: mol_type = other RNA
cagagcgtgctgagacaacccccttccctctctggcgcgccagggcagagggtcaccctttcatgcacaggaagtagctccaacatcggtggctacgacgttcactggtatcagcatgtgccggggactgctcccaagctgttgatttacgagaatacgaaacggccttctggaataccagatcgcttctcgggctcaaagagcggtaccagtgcaacattagggatcactggactgcagaccggcgacgaagccgattattactgtggcacatgggacacctccctatctgccgggggagtatttggtagcggcactaaagtgacagtcctc

SEQ ID NO: 25636 - RNA, 333 nt, synthetic construct
  misc_feature 1..333: note = derived and/or modified sequence opt3 from anti-HIV_048-084245_VR-Chain
  source 1..333: mol_type = other RNA
cagagcaccctgacacaacccccttccgtgtctgccgctccaggccagaaggtcactatctcatgcagtgggagcaactccaatattggaaaacactacgtttcttggtatcagcagttcccgggtgcagtgcccaagctccttatatacgagaacaaaaagagaccttcgggcatcccagacaggttttcagggagcaaaagtgatacgtccgccaccctggacattacaggattgcaaactggcgatgaagcggactattactgtggtacctgggatacatctttaagcgctgggggagtattcggctccggcaccaaggtgactgtcctg

SEQ ID NO: 25637 - RNA, 333 nt, synthetic construct
  misc_feature 1..333: note = derived and/or modified sequence opt3 from anti-HIV_048-082487_VR-Chain
  source 1..333: mol_type = other RNA
cagagcctgctcacccaacccccttccgtgtctgccgctccaggccagaaggtcacaatctcatgcagtgggagctcctctactattggaaacaattacgtttcgtggtatcaggtgcttccgggtgcagcccccaaactgttgatatgtaagaacaatgagagaccttcaggcatcccagacaggttcagcgggagtaaatccggaacgtctgcgaccttaggcattacaggtctgcagactggggatgaagctgactactattgcggaacctgggatacaagcctatccgccggcggcgtatttgggtcaggaaccaaggtgactgtcctc

SEQ ID NO: 25638 - RNA, 333 nt, synthetic construct
  misc_feature 1..333: note = derived and/or modified sequence opt3 from anti-HIV_048-081787_VR-Chain
  source 1..333: mol_type = other RNA
cagagcgtgctgacccaacccccttccgtctctggcgccccagggcagagagttacaatctcatgcactggaagtagctccaacattggttcttacgacgtgcactggtatcagcagctcccgggcacggctcccaaacttctgatatacgaaaattcgaagaggccttcagggatcccagatcggttcagcggaagtaagtccggcacctctgcaacattgggtattactgggttacaaaccggagacgaggccgattattactgtggcacatgggacaccagcctgtccggcgggggagtatttggtactggcacaaaagtgaccgtccta

SEQ ID NO: 25639 - RNA, 333 nt, synthetic construct
  misc_feature 1..333: note = derived and/or modified sequence opt3 from anti-HIV_048-081062_VR-Chain
  source 1..333: mol_type = other RNA
cagagcgtgctgacccaacccccttccgtctctgccgctccaggccagaaggttacaatctcatgcagtgggactagctccaacattggagcaaattacgtgtcttggtatcagcaggtaccgggtacggcccccaaactccttatatacgagaacaataagagaccttcgggcaccccagacaggttctcagggagcaaaagtggaacatccgcgactctgggcatcaccggtttgcaaacaggggatgaagctgactattactgtggaacctgggatacttctttaagcgccggcggcgtgtttgggtccggaacaaaggtcaccgtgctg

SEQ ID NO: 25640 - RNA, 333 nt, synthetic construct
  misc_feature 1..333: note = derived and/or modified sequence opt3 from anti-HIV_048-079639_VR-Chain
  source 1..333: mol_type = other RNA
cagagcgtgctgacccaacccccttccgtctctgccgctccaggccagaaggttacaatctcatgcagtgggagctcctctaacattggaaagaattacgtgtcgtggtatcagcacctcccgggtactgcacccaaacttctgatatacgagaacaataaaagaccttcaggcatcccagacaggttcagcgggagtaagtccggaacggccgcgaccttgggcattacaggtttacagactggggatgaagctggatattactgtggcacctgggacacatctctgagcgccggcggggtatttggaaccggtactaaagtgacagtccta

SEQ ID NO: 25641 - RNA, 333 nt, synthetic construct
  misc_feature 1..333: note = derived and/or modified sequence opt3 from anti-HIV_048-079126_VR-Chain
  source 1..333: mol_type = other RNA
cagagcgtgctgacccaacccccttccgtctctgccgctccaggccagaaggttacaatctcatgcagtgggagctcctctaacattggaaataactacgtgtcgtggtatcagcacctcccgggtactccccctaaacttctgatattcaagaataacgagagaccatcaggcatccccgacaggtttagcgggagtaaatccggaacgtctgcaaccttgggcattacaggtttacagactggggatgaagccgactactattgtggaacctgggatacaagcctgtccgcgggcggcgtattcgggaccggaactaaggtgacagtccta

SEQ ID NO: 25642 - RNA, 333 nt, synthetic construct
  misc_feature 1..333: note = derived and/or modified sequence opt3 from anti-HIV_048-073118_VR-Chain
  source 1..333: mol_type = other RNA
cagagcgtgctgacccaacccccttccgtctctgccgctccaagacacaacgttacaatctcatgcagtggcgggagctccaatattggaaacaatttcgtgtcttggtaccagtatctcccgggtactgcacccaaacttctgatatacgacaacaataagaggccttcgggcatcccagatcggttttcagggagcaagagtggaacgtccgccaccttgggcattacaggtttacagactggggacgaggcggattattactgtgctacctgggacacatctctgagcgccggaggcgtattcggcaccgggactaaagtgacagtccta

SEQ ID NO: 25643 - RNA, 333 nt, synthetic construct
  misc_feature 1..333: note = derived and/or modified sequence opt3 from anti-HIV_048-070264_VR-Chain
  source 1..333: mol_type = other RNA
cagagcgtgctgacccaatccccctctgtctcagccgctcctggccagaaggttacaatcagttgcagcgggacttcctctaacattggaaatacgtacgtgtcgtggtatcagcagctcccaggtaccgcaccgaaacttctgatatacaagaacgacaaaagaccctcaggcatccctgataggttcagcgggagtaagtccggaacatctgccactttgggcattaccggtttacaaacaggggacgaggcggattattactgtggaacctgggacagctccctgtcagctggcggcgtatttgggactggaacaaaagtgaccgtccta

SEQ ID NO: 25644 - RNA, 333 nt, synthetic construct
  misc_feature 1..333: note = derived and/or modified sequence opt3 from anti-HIV_048-069426_VR-Chain
  source 1..333: mol_type = other RNA
cagagcgtgctgacccaacccccttccgtctctgccgctccaggccagaaggttacaatctcatgcagtgggagctcctctactattggaaacaattacgtgtcgtggtatcagcagctcccgggtacggcacccaaacttctgatatacaagaacaataaaagaccttcaggcgtaccagacaggttcagcgggagtaagtccggaacctctgccacacccggcatcactggtttgcaaaccggggatgaggcggactattactgtggaacatgggataccagcttatccgctggcggcgtgtttgggactggaacaaaagtcaccgtgctg

SEQ ID NO: 25645 - RNA, 333 nt, synthetic construct
  misc_feature 1..333: note = derived and/or modified sequence opt3 from anti-HIV_048-068564_VR-Chain
  source 1..333: mol_type = other RNA
cagagcgccctgacccaacccagatccgtgtctggctcacctgggcagagtgtcgctatcagctgcacaggaacttcctctgacgttggttacaactatgtgtcgtggtaccaggtactcccaggcacggcaccgaaacttctgatttataagaataacgagaggccctcagggatacctgatcggttcagcggaagtaagtccggcacctctgccacattgggtatcactgggttacagaccggagacgaagcggattactattgtggcacatgggacaccagcctgtccgctggcggggtgtttggaactggtacaaaagtcaccgtgcta

SEQ ID NO: 25646 - RNA, 333 nt, synthetic construct
  misc_feature 1..333: note = derived and/or modified sequence opt3 from anti-HIV_048-068345_VR-Chain
  source 1..333: mol_type = other RNA
cagagcgtgctgacccaaacaccctccgtctctgccgctcctggccagagagttactatctcatgcagtgggagcacgtccaacattggaaataactacgtgtcttggtatcagcagctcccaggtaccgcaccgaaacttctgatatacgagaataacaagaggccctcgggcatccgggaccgcttctcagccagcaagagtgggacatccgcgactttgggaattaccggcttacaaacaggtgatgaagctgactattactgtgggacctgggatacttctctgagcgccggaggcgtatttggcacagggaccaaagtgacggtccta

SEQ ID NO: 25647 - RNA, 333 nt, synthetic construct
  misc_feature 1..333: note = derived and/or modified sequence opt3 from anti-HIV_048-067337_VR-Chain
  source 1..333: mol_type = other RNA
cagagcgtgctgacccaacccccttccgtctctgccgctccaggccagaaggttacaatctcatgcagtggggcaagctacaacattggtaaaaattccgtgtcttggtatcagcagctcccgggaactgcccccaaacttctgatatacaagaacgacaagagaccttcgggcatcccagataggttctcagggagcaaaagtggagcgtccgctacgttggacattaccggcttacaaacaggtgatgaggccgactattactgtgggatctgggatacttctctgagcgcaggaggcgtatttggcaccgggacaaaggtgaccgtccta

SEQ ID NO: 25648 - RNA, 333 nt, synthetic construct
  misc_feature 1..333: note = derived and/or modified sequence opt3 from anti-HIV_048-067180_VR-Chain
  source 1..333: mol_type = other RNA
cagagcgtgctgacccaacccccttccgtctctgccgctccaggccagaaggttacaatctcatgcagtgggagctccccgaacattggaaataactacgtgtcttggtatcagagactccccggtactgcacctaaacttctgatatacgagaatgaccagaggccatcgggcatccccgatcggatttcagggagcaagagtggaacgtccgccaccttgggcatcacaggtttacaaactggggacgaagcggattattactgtggaacctgggacacatctctgagcaccggcggcgtattcgggactggaacaaaagtgaccgtccta

SEQ ID NO: 25649 - RNA, 333 nt, synthetic construct
  misc_feature 1..333: note = derived and/or modified sequence opt3 from anti-HIV_048-063017_VR-Chain
  source 1..333: mol_type = other RNA
cagagcgtgctgacccaacccccttccgtctctgccgctccaggccagaaggttacaatctcatgcagtgggagctcctctaacattggaaataactacgtgtcgtggtatcagcaccatccgggtaaagcacccaagctcatgatatacgaggtatcaaaaagacctagcggcatcccagacaggttcagtgggtccaagtctggaactagcgccacgcttggcattaccggtctgcagacaggggatgaagcggactattactgtggaacttgggatacctccttgaatcggggcggcgtgtttgggacaggaaccaaagtcactgtgtta

SEQ ID NO: 25650 - RNA, 333 nt, synthetic construct
  misc_feature 1..333: note = derived and/or modified sequence opt3 from anti-HIV_048-061885_VR-Chain
  source 1..333: mol_type = other RNA
cagagcgtgctgacccaacccccttccgtctctgccgctccaggccagaaggttacaatctcatgcagtgggagctcctctaacattggatcgcactacatatcatggtatcagcagttcccgggtgcagcccccaaactccttatctacgagaatgacaagagacctagcggcattccagataggtttagtgcgtccaaatctgggactagcgctacgctgggaatcaccggcttgcaaacaggtgacgaagccgattattactgtgggacttgggacacctccttatcagcaggaggcgtgttcggcacagggaccaaggtaactgtgctg

SEQ ID NO: 25651 - RNA, 333 nt, synthetic construct
  misc_feature 1..333: note = derived and/or modified sequence opt3 from anti-HIV_048-061671_VR-Chain
  source 1..333: mol_type = other RNA
cagagcgtgctgacccaacccccttccgcctctggcacaccagggcagagagtcactatctcatgcagtggaagcaggtccaacattggttctaattacgtttattggtaccagcagttcccgggcacggctcccaagctccttatatatgagaacaataaacggccttcggggatcccagaccgcttttcaggaagcaagagtggcacctccgcaacactgggtattactgggttgcaaaccggagatgaagccgactactattgtgcgacatgggatacctctttaagcgctggcggcgtgttcgggactggaacaaaagtaaccgtgctg

SEQ ID NO: 25652 - RNA, 333 nt, synthetic construct
  misc_feature 1..333: note = derived and/or modified sequence opt3 from anti-HIV_048-060700_VR-Chain
  source 1..333: mol_type = other RNA
cagagcgtgctgacccaactcccctccctttctgccgctcctggccagaaggtcacaatctcatgcagtgggagctcctctaacattggaaataactacgtttcgtggtatcagcagctgccaggtactgcaccgaaattgttaatatacgagaataacaagagaccctcaggcatccctgacaggttcagcgggagtaaatccggaacgtctgccaccctgggcattacaggtctacaaactggggatgaagcggagtattactgtgctacctgggacgccagcctctccggaggcggcgtgtttgggacaggaaccaaggtaactgtgctg

SEQ ID NO: 25653 - RNA, 333 nt, synthetic construct
  misc_feature 1..333: note = derived and/or modified sequence opt3 from anti-HIV_048-060592_VR-Chain
  source 1..333: mol_type = other RNA
cagagcgtgctgacccaacccccttccgtctctgccgctccaggccagaaggttacaatctcatgcagtgggagctcctctaacattggtaaaaattacgtgtcgtggtatcagcagttcccgggtactgcacccaagctccttatatacgagaacaataaaagaccttcaggcatcccagacaggtttagcgccagtaagtccgcgacgtctgctaccctggtaattacagggttgcaaactggagatgaagccgtgtattactgtggcacctgggacaccagcttatccgcaggaggggtcttcggatcaggcacaaaagtgactgttctg

SEQ ID NO: 25654 - RNA, 333 nt, synthetic construct
  misc_feature 1..333: note = derived and/or modified sequence opt3 from anti-HIV_048-060300_VR-Chain
  source 1..333: mol_type = other RNA
cagcccgtgctgacccaacctccaagcgcctccggcacaccggggcagagagtcactatctcttgctcaggaagtagctccaacattggtacgaataccgttaactggtaccagcagttccccggcacagctcctaagctccttatatataaaaataacgagaggccatctgggatccccgaccggttttcgggatcaaagagcggcaccagtgcaactctgggtattacagggttgcaaaccggagatgaagccgactactattgtggcacttgggatacatccttatctggcgggggagtgttcggtaccggcacgaaagtaactgtgctg

SEQ ID NO: 25655 - RNA, 333 nt, synthetic construct
  misc_feature 1..333: note = derived and/or modified sequence opt3 from anti-HIV_048-059141_VR-Chain
  source 1..333: mol_type = other RNA
cagcccgtgctgacccaacctccaagcgcctccggcacaccggggcagagagtctctatctcatgcagtggaaacttcagcaatattggttccaagtacgtttattggtaccagcagatacccggcactgctcctaacgtgatcatttataggacgaatctccggccatctgggatccccgaccgcttttcggcatcaaaaagcggaaccagtgccacacttggcattactggtctgcaaaccggggatgaggcggactactattgtggaacatgggatacctccttgtctgctggcggcgtattcgggactggaacaaaggtgaccgtctta

SEQ ID NO: 25656 - RNA, 333 nt, synthetic construct
  misc_feature 1..333: note = derived and/or modified sequence opt3 from anti-HIV_048-057777_VR-Chain
  source 1..333: mol_type = other RNA
cagagcgtgctgacccaacccccttccctctctgccgctccaggccagagagtcacaatctcatgcagtgggagctcctctaacattggaaataactacgtttcgtggtatcagcagttcccgggtactgcacccacgcttctgatatacgagaatgacaagaggccttcaggcatcccagatcggtttagcgccagtaaatccgggacctctgcgacattgggaattactggcttacaagctggtgacgaagccgattattactgtgggacctgggacacaagcctgtccgcaggaggcgtgttcggcaccgggactaaggtaacagtgcta

SEQ ID NO: 25657 - RNA, 333 nt, synthetic construct
  misc_feature 1..333: note = derived and/or modified sequence opt3 from anti-HIV_048-056928_VR-Chain
  source 1..333: mol_type = other RNA
cagagcgtgctgacccaacccccttccgtctctgccgctccaggccagaaggttacaatctcatgcagtgggagctcctctactattggaaacaattacgtgtcgtggtatcagctccttccgggtacggcacccaaactgttgatatacgacaacgataatagaccttcagacatcccagataggttcagcggcagtaagtccgggacctctgccacattaggaattactggcctgcagaccggtgacgaggcggattattactgtggggcttgggacacaagcctatccgccggaggcgtatttggcaccgggactaaagtgacagtcctc

SEQ ID NO: 25658 - RNA, 333 nt, synthetic construct
  misc_feature 1..333: note = derived and/or modified sequence opt3 from anti-HIV_048-056131_VR-Chain
  source 1..333: mol_type = other RNA
cagttcgtgctgacccaacccgccagcgtctccggctctcctgggcagtcaatcacaattagttgcagcggaacttcctctgacgttggttacaactatgtgtcgtggtaccagcagctcccaggcacggctccgaaacttctgatatatgagaataccaagagaccctcagggatccctgataggtttagcggaagtaagtccggcacatctgcaactttgggtattaccgggttacaaacaggagacgaagccgattactattgtggcacctgggacactagcctgtccgcgggcggggtattcggatcaggtacaaaagtgaccgtccta

SEQ ID NO: 25659 - RNA, 333 nt, synthetic construct
  misc_feature 1..333: note = derived and/or modified sequence opt3 from anti-HIV_048-055864_VR-Chain
  source 1..333: mol_type = other RNA
cagagcgtgctgacccaacccccttccgtctctgttgccccaggccagaaggtgacaatctactgctcagggagtagctccaacattggtaaaaattctgtatcgtggtatgtgcaggtcccgggaactgctcccaagttcctcatatacgagaacaatcagagaccttcaggcatcagcgacaggtttagtgggtccaaatctggaacgagcgcaacccttggcatttccggtctgcaaacaggggatgaagccgactattactgtggaacttgggatacctcattgagtggcggcggggtgttcggaacaggtaccaaggttactgtgtta

SEQ ID NO: 25660 - RNA, 333 nt, synthetic construct
  misc_feature 1..333: note = derived and/or modified sequence opt3 from anti-HIV_048-055094_VR-Chain
  source 1..333: mol_type = other RNA
cagagcgtgctgacccaacccccttccgtctctggcgccccagggcagagagttacaatctcatgcagtgctagctcctcttcgattggaaacgacttcgtgtcatggtaccagcagctcccgggtactgcacccaaacttctgataagcgagaataacaagaggcctagtggcatcccagatcggttttccgggtctaagagcggaacgtccgccaccttgggcattacaggtttacaaactggggacgaagcggattattactgtggaacctgggactcaagtctgagcgctggcggcgtattcgggacaggaaccaaagtgactgtccta

SEQ ID NO: 25661 - RNA, 333 nt, synthetic construct
  misc_feature 1..333: note = derived and/or modified sequence opt3 from anti-HIV_048-054343_VR-Chain
  source 1..333: mol_type = other RNA
cagagcgtgctgacccaacccccttccgtctctggcgcgccagggcagagagttacaatctcatgcactggaagtagctccaacattggtggctacgacgtgaattggtatcagcagctcccggggacggctcccaaacttctgatattcaagaacaatgagaggccttctggaatcccagatcggttttcgggctcaaagagcggtaccagtgcaacattggggattactggattacaaaccggcgacgaagccgattactattgtggcacatgggacacctccctgtctgccgggggagtattcggtactggcacaaaagtgaccgtccta

SEQ ID NO: 25662 - RNA, 333 nt, synthetic construct
  misc_feature 1..333: note = derived and/or modified sequence opt3 from anti-HIV_048-054193_VR-Chain
  source 1..333: mol_type = other RNA
cagagcgtgctgacccaacccccttccgtctctgccgctccaggccagaaggttacaatctcatgcagtgggggaagctccaacattggtaataactacgtgtcttggtatcaccaggtaccgggcactgcacccaaactccttatattcgagaataacaagagaccttcggggatcccagacaggttttcaggaagcaaaagtggcacgtccgccaccctgggtattacagggttgcagactggagatgaagcggactactattgtggcacctgggatacatctttaagcggcgggggagtgttcggtaccggcactaaggtcacagtgctg

SEQ ID NO: 25663 - RNA, 333 nt, synthetic construct
  misc_feature 1..333: note = derived and/or modified sequence opt3 from anti-HIV_048-052521_VR-Chain
  source 1..333: mol_type = other RNA
cagagcgtgctgacccaacccccttccgtctctgccgctccaggccagaaggttacaatctcatgcagtgggagctcctctaacattggaagacactcggtgtcatggtaccagcagctcccgggtactgcacccaaacttctgatatatgacacggataagaggcctagcggcatcccagaccggttcagtgggtccaaatctggaaccagcgccacattgggcattactggtttacaaaccggggatgaggcggactactattgtggaacatgggatacctccctgtcaggcggcggggtatttggaactggtacaaaggtgaccgtccta

SEQ ID NO: 25664 - RNA, 333 nt, synthetic construct
  misc_feature 1..333: note = derived and/or modified sequence opt3 from anti-HIV_048-049037_VR-Chain
  source 1..333: mol_type = other RNA
cagagcgtgctgacccaacccccttccgtctctgccgctccaggccagaaggttacaatctcatgcagtgggagctccttcaacattggaaataactacgtgtcttggtatcagcacctcccgggtactgcacccaaacttctgatatacgccgcggtaacgagaccttcgggcatcccagacaggttttcagggagcaagagtggaacctccgctacattggatattactggcttacagaccggtgacgaggccgattattactgtgggacatgggacacctctctgagcgcaggaggcgtgttcggcactgggacaaaagtcaccgtgcta

SEQ ID NO: 25665 - RNA, 333 nt, synthetic construct
  misc_feature 1..333: note = derived and/or modified sequence opt3 from anti-HIV_048-048720_VR-Chain
  source 1..333: mol_type = other RNA
cagagcgtgctgacccaaccccctgccgtctccgctgcaccaggccagagagttgccatctcttgctcagggacaagtagcaacattggatccaatctcgtgtcttggtaccagcagcttccgggtaaggcgcccaggctgttgatatatgacaactacaaacggccttcgggcatcccagatcgcttctcagggagcaagagtggaacttccgctacgttaggcattaccggtctgcaaacaggggacgaggccgattattactgtggaacttgggacacctctctaagcacaggcggcgtatttgggaccggaactaaagtgacagtcctc

SEQ ID NO: 25666 - RNA, 333 nt, synthetic construct
  misc_feature 1..333: note = derived and/or modified sequence opt3 from anti-HIV_048-048542_VR-Chain
  source 1..333: mol_type = other RNA
cagagcgtgctgacccaacccccttccgtctctgccgctccaggccagaaggttacaatctcatgcagtgggagctcctctaacattggaaataacttcgtgtcgtggtaccagcagctcccgggtactgcacccaaacttctgatatataataacgacagaaggccttcaggcgtaccagatcggtttagcgccagtaagttcgggacggcggctaccttgggaatcacaggcttacaaactggtgacgaggccgattactattgtgggacctgggactcctctctgagcgcaggaggcgtgtttggcacagggaccaaagtcactgtgcta

SEQ ID NO: 25667 - RNA, 333 nt, synthetic construct
  misc_feature 1..333: note = derived and/or modified sequence opt3 from anti-HIV_048-047777_VR-Chain
  source 1..333: mol_type = other RNA
cagagcgtgctgacccaacccccttccgcctctggcacaccagggcagagagtcactatctcatgcagtggaagctccgctaacattggtacgaattacgttttctggtatcagcacctcccgggcaccgcacccaaacttctgatatacgagaacaataagaggccttctgggatcccagaccggttttcgggatcaaagagcggcacaagtgccactttgggtattaccgggttacagacaggagatgaagcggactattactgtggcacctgggattcctctctgagcgctggcggggtgttcggaactggtacaaaagtaaccgtgcta

SEQ ID NO: 25668 - RNA, 333 nt, synthetic construct
  misc_feature 1..333: note = derived and/or modified sequence opt3 from anti-HIV_048-046841_VR-Chain
  source 1..333: mol_type = other RNA
cagagcgtgctgacccaacccccttccgtctctgccgctctcggccagaaggttacaatcacttgctcaggggacaacggaaatattggttaccactatgtgagttggtaccagcaggtaggcagagcagccccaaaacttctgatatatgcgaacaataagaggccgagcgggatccccgatcggttctccggatctaaatcgggcacgtcagctaccttgggtattacagggttacaaactggagacgaggccgattactattgtggcacctgggacacaagcctgagtgcaggcggggtgtttggatccggtaccaaggtcactgtgcta

SEQ ID NO: 25669 - RNA, 333 nt, synthetic construct
  misc_feature 1..333: note = derived and/or modified sequence opt3 from anti-HIV_048-046202_VR-Chain
  source 1..333: mol_type = other RNA
cagagcgtgctgacccaacccccttccgtctctgccgctccaggccagaaggttacaatctcatgcagtgggagctcctctaacattggaaataactacgtgtcgtggtatcagcacctcccgggtactgcacccaaacttctgatatacgacacgtataagagacattcaggcgtacctgataggttcagcaatagtaaatccgggacctctgccacattggcgatcactggattacagaccggcgacgagggtgattactattgtggggcttgggacacaagcctgtccgccggaggcgtgtttggcaccgggactaaggtcacagtgcta

SEQ ID NO: 25670 - RNA, 333 nt, synthetic construct
  misc_feature 1..333: note = derived and/or modified sequence opt3 from anti-HIV_048-046059_VR-Chain
  source 1..333: mol_type = other RNA
cagagcgtgctgacccaacccccttccgtctctgccgctccaggccagaacgttacaatctcatgcagtgggactagctccaatattgagaacaattacgtgtcttggtatcagacgctcccgggaaccgcacccaaacttctgatatacgacaacaataagagaccttcgggtatcccagataggttctcaggcagcaagagtgggacatccgccactttgggaattaccggcttacagacaggtgacgaagcggattattactgtgggacctgggactctagcctgtccgctggaggcgtatttggcactgggacaaaagtgaccgtccta

SEQ ID NO: 25671 - RNA, 333 nt, synthetic construct
  misc_feature 1..333: note = derived and/or modified sequence opt3 from anti-HIV_048-043568_VR-Chain
  source 1..333: mol_type = other RNA
cagagcgtgctgacccaacccccttccgtctctgccgctccaggccagaaggttacaatctcatgcagtgggagcgactccaacattggatctaattacgtgtcgtggtatcagcagctcccgggtgcagcccccaaacttctgatatacaagaacaataacagaccttcaggcatcccagataggttcagcgggagtaaatccggaacttctgcgacgttgggcattagcggtttacaaaccggggacgaggctgattattactgtggaacatgggacacttccctgtcaggcggcggggtatttggaaccggtacaaaggtgaccgtccta

SEQ ID NO: 25672 - RNA, 333 nt, synthetic construct
  misc_feature 1..333: note = derived and/or modified sequence opt3 from anti-HIV_048-042713_VR-Chain
  source 1..333: mol_type = other RNA
cagagcgtgctgacccaacccccttccgtctctgccgctccaggccagaaggttacaatctcatgcagtgggagctcctctaacattggaagacactacgtgtcgtggtatcagcagctcccgggtactgcacccaaacttctgatatacgacaataactcaaggcctagcggcatcccagatcggttcagtgggtccaagtctggaacgagcgccaccttgggcattacaggtttacaaactggggacgaggcggattattactgtggaacctgggacacatccctgaatcgcggcggcgtatttgggaccggaactaaagtgacagtccta

SEQ ID NO: 25673 - RNA, 333 nt, synthetic construct
  misc_feature 1..333: note = derived and/or modified sequence opt3 from anti-HIV_048-042440_VR-Chain
  source 1..333: mol_type = other RNA
cagagcgtgctgacccaacccccttccgcctctggcacaccagggcagagagtcactatctcatgcagtggaagctcctctaacattggtacgaataccgttaactggtaccagcagctcccgggcacagctcccaaacttctgatatatgaaaattcgaagaggccttcagggatcccagaccggttcagcggaagtaagtccggcacttctgcaaccttgggtattacagggttacaaaccggagatgaggccgactactattgtggcacttgggatacaagcctgtccgcgggcggggtgtttggatcaggtaccaaagtaacggtgcta

SEQ ID NO: 25674 - RNA, 333 nt, synthetic construct
  misc_feature 1..333: note = derived and/or modified sequence opt3 from anti-HIV_048-040511_VR-Chain
  source 1..333: mol_type = other RNA
cagagcgtgctgacccaacccccttccgtctctgccgctccaggccagaaggttacaatctcatgcagtgggagctcctctaacattggaaataactacgtgtcgtggtatcagcacctcccgggtactgcacccaaacttctgatatacgagaataacaagagatcaagcggcatccctgaaaggttcagtgggtcccagtctggaacgagcgccaccttgggcattacaggtttacaaactggggacgaggcggattattactgtggaacctgggacacatccctgtcaaccggcggcgtatttgggactggaacaaaagtgaccgtccta

SEQ ID NO: 25675 - RNA, 333 nt, synthetic construct
  misc_feature 1..333: note = derived and/or modified sequence opt3 from anti-HIV_048-039195_VR-Chain
  source 1..333: mol_type = other RNA
cagagcgtgctgacccaacccccttccgtctctgccgctccaggccagagagttacaatctcatgcagtgggagcacttccaacattggaaatcactacgtgtcttggtatcagcagctcccgggtacggcacccaaacttctgatatacgacaacggcaataggccttcggggatcccagatcggttctcaggaagcaagagtggcacctccgccacattggacattactggtttacaaaccggggatgaggcggactattactgtggaacatgggatacctctctgaaccgcggcggcgtatttgggactggaacaaaggtgaccgtccta

SEQ ID NO: 25676 - RNA, 333 nt, synthetic construct
  misc_feature 1..333: note = derived and/or modified sequence opt3 from anti-HIV_048-036935_VR-Chain
  source 1..333: mol_type = other RNA
cagagcgtgctgacccaacccccttccatgtctgccgctccaggcgagagagtcacaatctcatgcactgggagtagctccaatattggaggttacgacgttcactggtatcagcagctcccgggcatagcacccaagatccttatttacaggaactctatccggccttcggggattccagatcgcttctcaggaagcaaaagtggcacgtccgccaccctgggtatcacagggttgcagactggagacgaagcggattattactgtggcacctgggacacatctttaagcaccggcggggtgtttggaactggtacaaaggtaaccgtgctg

SEQ ID NO: 25677 - RNA, 333 nt, synthetic construct
  misc_feature 1..333: note = derived and/or modified sequence opt3 from anti-HIV_048-034478_VR-Chain
  source 1..333: mol_type = other RNA
cagagcgtgctgacccaacccccttccgtctctgccgctccaggccagaaggttacaatctcatgcactgggagtggaagcaacattggtaataacgacgtgtcctggtaccagcagctcccgggcacggcacccagacttctgatatatggggataataaaaggccttctggaatcccagaccggttctcgggctcaaagagcggtaccagtgccacattggggattactggattacaaaccggcgatgaggcggactactattgtggcacatgggatacctccctgtctgctgggggagtatttggtactggcacaaaagtgaccgtccta

SEQ ID NO: 25678 - RNA, 333 nt, synthetic construct
  misc_feature 1..333: note = derived and/or modified sequence opt3 from anti-HIV_048-031641_VR-Chain
  source 1..333: mol_type = other RNA
cagagcgtgctgacccaacccccttccgtctctgccgctccaggccagaaggttacaatctcatgcagtgggaacaatagcaacattggaaataactacgtgtcctggtatcagcagctcccgggtactgcacccaaacttctgatatacgaaaattctaagagaccttcgggcatcccagacaggttctcagggagcaaaagtggaacgtccgccaccttgggcattacaggtttacaaactggggatgaggcggactattactgtggaacctgggatacatctctgagcgctggcggcgtatttgggtccggaaccaaggtgactgtccta

SEQ ID NO: 25679 - RNA, 333 nt, synthetic construct
  misc_feature 1..333: note = derived and/or modified sequence opt3 from anti-HIV_048-029760_VR-Chain
  source 1..333: mol_type = other RNA
cagagcgccctgacccaacccgcttccgtgtctggctcaagtgggcagagcatcacaatttcctgcactggaacgaactctgacgtcggttacgattatgtttgttggtaccagcagctccctggcaccgcaccaaaacttctgatatatgagaataacaagagaccgtcggggatccccgacaggttctcaggaagcaagagtggcacatccgccactttgggtattaccgggttacaaacaggagatgaagcggactactattgcggcacctgggatacttctctgagcgctggcggggtgtttggaacaggtaccaaagtaacggtgcta

SEQ ID NO: 25680 - RNA, 333 nt, synthetic construct
  misc_feature 1..333: note = derived and/or modified sequence opt3 from anti-HIV_048-027970_VR-Chain
  source 1..333: mol_type = other RNA
cagagcgtgctgacccaacccccttccgtctctgccccaccgggccagaaggttacaatctcatgcagtgggactacgagcaacattggatccaattacgtggcttggtatcagcagttccccggtaccgcacctaaactccttatatacgagaacaataagagaccatctggcatccccgacaggttttcggggtcaaaaagcggaacaagtgccactctgggcattaccggtttgcaaacaggggatgaagcggactattactgtgctacctgggatacttccttatctgccggaggcgtattcggcacagggaccaaggtgacggtcctg

SEQ ID NO: 25681 - RNA, 333 nt, synthetic construct
  misc_feature 1..333: note = derived and/or modified sequence opt3 from anti-HIV_048-027337_VR-Chain
  source 1..333: mol_type = other RNA
cagagcgtgctgacccaacccccttccgtctctgccgctccaggccagaaggttacaatctcatgcagtgggagctactccaacattggaaataactatctctcttggtaccagcagcttccgggtactgcacccaaactgttgatatataagaataacaaaagaccttcgggcgtgccagacaggttctcagggagcaagagtggagcctccgcgacgttagatatcaccggcctgcaaacaggtgacgaggctgattactattgtgggatttgggacacttctctaagcgccggaggcgtatttggcaccgggacaaaagtgaccgtcctc

SEQ ID NO: 25682 - RNA, 333 nt, synthetic construct
  misc_feature 1..333: note = derived and/or modified sequence opt3 from anti-HIV_048-027217_VR-Chain
  source 1..333: mol_type = other RNA
cagagcgtgctgacccaacccccttccgtctctgccgctccaggccagaaggttacaatctcatgcagtgggagctcctctattataggaaacaattacgtgtcgtggtatcagcagctcccgggtactgcacccaaacttctgatctacgagaacaataagagaccttcaggcattccagacaggttcagcgggagtaaatccggaacgtctgccaccttggcgatcgctggcttacaaacaggtgatgaagccgactattactgtgcaacttgggataccagcctgtccgccgggggagtatttggcacaggcaccaaggtgactgtccta

SEQ ID NO: 25683 - RNA, 333 nt, synthetic construct
  misc_feature 1..333: note = derived and/or modified sequence opt3 from anti-HIV_048-026760_VR-Chain
  source 1..333: mol_type = other RNA
cagagcgtgctgacccaacccccttccgtctctgccgctccaggccagaaggttacaatctcatgcagtgggagctcctctaacattggaaataactacgtgtcgtggtatcagcacctcccgggtactgcacccaaacttctgatatacgacacggtaaagagacattcaggcgtgcctgataggttcagcgggagtaaatccggaacctctgccacattgggcatcagcggtttacagactggggacgaggcggattattactgtggaacctgggacacatccctgtcagctggcggcgtctttgggagtggaaccaaggtgactgttcta

SEQ ID NO: 25684 - RNA, 333 nt, synthetic construct
  misc_feature 1..333: note = derived and/or modified sequence opt3 from anti-HIV_048-024800_VR-Chain
  source 1..333: mol_type = other RNA
cagagcgtgctgacccaacccccttccgtctctgccgctccaggccagaaggttacaatctcatgcagtgggagctactccaacattggaaataactatgtgtcttggtaccaggtactcccgggtactgcacccaaacttctgatatataagaataacgagagaccttcgggcatcccagacaggttctcagggagcaaaagtggaacgtccgccaccttgggcattacaggtttacagactggggatgaagcggactactattgtggaacctgggatacatctctgagcgctggcggcgtgtttgggaccggaactaaggtcacagtgcta

SEQ ID NO: 25685 - RNA, 333 nt, synthetic construct
  misc_feature 1..333: note = derived and/or modified sequence opt3 from anti-HIV_048-024313_VR-Chain
  source 1..333: mol_type = other RNA
cagagcgtgctgacccaacccccttccgtctctgccgctccaggccagaaggttacaatctcatgcagtgggagctcctctactattggaaactcgcacgtgtcatggtaccagatactcccgggtacggcacccaaacttctgatctataaggacgataaaagacctagcggcattccagacaggttcagtgggtccaagtctggaaccagcgccacattgggcatcactggtttacagaccggggatgaggcggactactattgtggaacatgggatacctccctgaatcggggcggcgtatttgggactggaacaaaagtgaccgtccta

SEQ ID NO: 25686 - RNA, 333 nt, synthetic construct
  misc_feature 1..333: note = derived and/or modified sequence opt3 from anti-HIV_048-021748_VR-Chain
  source 1..333: mol_type = other RNA
cagagcgtgctgacccaacccccttccgtctctgccgctccaggccagagagttacaatctcatgcagtgggagcacttccaacattggaaataactacgtgtcttggtatcagcagctcccgggtacggcacccaaacttctgatatacgagaataacaagaggccttcgggcatcccagaccggttctcagggagcaagagtggaacctccgccacattgggcatttctggtttacaaactggggatgaagcggactattactgtggaacctgggatagctccctgtcaggcggcggggtatttggaacaggtaccaaagtgactgtccta

SEQ ID NO: 25687 - RNA, 333 nt, synthetic construct
  misc_feature 1..333: note = derived and/or modified sequence opt3 from anti-HIV_048-020991_VR-Chain
  source 1..333: mol_type = other RNA
cagagcgtgctgacccaacccccttccgcctctggcacaccagggcagaaggtcactatctcatgcagtggaagctcctctacgattggtaacaattacgtttcgtggtatcaggtgctcccgggcaccgctcccaaacttctgatatacaagaacgacaaaagaccttcagggatcccagataggttcagcggaagtaagtccggcacatctgcaactttgggtattaccgggttacagacaggagacgaggccgattattactgtggcacctgggacactagcctgtccacaggcggggtatttggaaccggtacgaaagtgactgtccta

SEQ ID NO: 25688 - RNA, 333 nt, synthetic construct
  misc_feature 1..333: note = derived and/or modified sequence opt3 from anti-HIV_048-020340_VR-Chain
  source 1..333: mol_type = other RNA
cagagcgtgctgacccaacccccttccgtctctgccgctccaggccagagagttacaatctcatgcagtgggagctcctctaacgtgggaaataactacgtatcgtggtatcagcagctcccgggtactgcacccaaacttctgatttacgagaataacaagaggccttcaggcataccagaccggttcagcgggagtaagtccggaacgtctgccaccttgggcatcacaggtttacaaactggggatgaagcggactattactgtggaacctgggatgctagcctgtccgccggcggcgtgtttgggacaggaaccaaagtcactgtgcta

SEQ ID NO: 25689 - RNA, 333 nt, synthetic construct
  misc_feature 1..333: note = derived and/or modified sequence opt3 from anti-HIV_048-019993_VR-Chain
  source 1..333: mol_type = other RNA
cagagcgtgctgacccaacccccttccgtctctggcgcgccagggcagagagttacaatctcatgcactggaagtagctcctctattggtggcttcgacgtgcactggtaccagaggctcccggggacggctccccggcttctgatatatgagaacaataagcgcccttcgggaatcccagatcgattttcaggcagcaaaagtggtacctccgcaacattggggattactggattacagaccggcgacgaagccgattactattgtggcacatgggactctagcctgtccgccgggggagtattcggtaccggcactaaggtgacagtccta

SEQ ID NO: 25690 - RNA, 333 nt, synthetic construct
  misc_feature 1..333: note = derived and/or modified sequence opt3 from anti-HIV_048-019947_VR-Chain
  source 1..333: mol_type = other RNA
cagagcgtgctgacccaacccccttccgtctctgccgctccaggccagagagttacaatctcatgcagtgggagctcctctaacattggatcgaagtacgtgtcatggtatcagcagctcccgggtactgcacccaaacttctgatatacgagaatagcaagaggcctagtggcatcccagaccggttctccgggtctaaaagcggaacgtccgccaccttgggcattacaggtttacaaactggggatgaagcggactattactgtggaacctgggatacatcactgagtaccggcggcgtatttgggactggaacaaaggtgaccgtccta

SEQ ID NO: 25691 - RNA, 333 nt, synthetic construct
  misc_feature 1..333: note = derived and/or modified sequence opt3 from anti-HIV_048-017871_VR-Chain
  source 1..333: mol_type = other RNA
cagagcgtgctgacccaacccccttccgtctctgccgctccaggccagaaggttacaatctcatgcagtgggagctcctctaacattggaaatagatacgtgtcgtggtatcagcagctcccgggtactgcacccaaacttctgatatacaagaacaataaaaggccttcaggcatcccagaccggttcagcgggagtaagtccggaacgtctgccaccttgggcattacaggtttacaaactggggatgaggcggactattactgtggaacctgggatggcagcctgtccacaggcggggtaatcggaaccggtactaaagtgacagtccta

SEQ ID NO: 25692 - RNA, 333 nt, synthetic construct
  misc_feature 1..333: note = derived and/or modified sequence opt3 from anti-HIV_048-015931_VR-Chain
  source 1..333: mol_type = other RNA
cagagcgtgctgacccaacccccttccgtctctgccgctccaggccagaaggttacaatctcatgcagtgggggaagctccaacattggttctacttacgtgtcgtggtatcagcaggtaccgggcacggcacccaaactccttatatacgagaataacaagagaccttcagggatcccagacaggttcagcggaagtaaatccggcacctctgccacactggatattactggtttgcaaaccggggacgaagcggattattactgtggaacatgggacaccagcttatccggcggcggggtgtttggaactggtacaaaggtcaccgtgctg

SEQ ID NO: 25693 - RNA, 333 nt, synthetic construct
  misc_feature 1..333: note = derived and/or modified sequence opt3 from anti-HIV_048-015920_VR-Chain
  source 1..333: mol_type = other RNA
cagagcctgctcacccaacccccttccgtgtctgccgctccaggccagaaggtcacaatctcatgcagtgggagctcctctactattggaaacaattacgtttcgtggtatcaggtgcttccgggtacggcacccaaactgttgatatacaagaacaatgagagaccttcaggcatcccagacaggttcagcgggagtaaatccggaacctctgccacattaggcattactggtctgcagaccggggatgaagcggagtattactgtgctacatgggacgccagcctatccggaggcggcgtatttgggaccggaactaaggtgacagtcctc

SEQ ID NO: 25694 - RNA, 333 nt, synthetic construct
  misc_feature 1..333: note = derived and/or modified sequence opt3 from anti-HIV_048-013898_VR-Chain
  source 1..333: mol_type = other RNA
cagagcgtgctgacccaacccccttccgtctctgccgctccaggccagaaggttacaatctcatgcagtgggagctcctctaacattggaaaacactcggtgtcatggtaccagcagctcccgggtactgcacccgagcttctgatatatgacaataacaatagacctagcggcatcccagataggttcagtgggtccaagtctggaacgagcgccaccttgggcattacaggtttacaaactggggacgaagcggattactattgtggaacctgggacacatccctgtcagctggcggcgtatttgggaccggaactaaagtgacagtccta

SEQ ID NO: 25695 - RNA, 333 nt, synthetic construct
  misc_feature 1..333: note = derived and/or modified sequence opt3 from anti-HIV_048-013429_VR-Chain
  source 1..333: mol_type = other RNA
cagagcgtgctgacccaacccccttccgtctctgccgctccaggccagaaggttacaatctcatgcagtgggagctcctctaacattggaaataactacgtgtcgtggtatcagcagctcccgggtactgcacccacgcttctgatatacgagaatgacaaaagaccttcaggcatcccagataggttcagcgggagtaagtccggaacctctgccacattgggcattactggtttacaaaccggggacgaagcggattattactgtggaacatgggacagctccctgtcagctggcggcgtatttgggaccggaactaaagtgacagtccta

SEQ ID NO: 25696 - RNA, 333 nt, synthetic construct
  misc_feature 1..333: note = derived and/or modified sequence opt3 from anti-HIV_048-012358_VR-Chain
  source 1..333: mol_type = other RNA
cagagcgtgctgacccaacccccttccgtctctgccgctccaggccagaaggttacaatctcatgcagtgggagcaactccgcaattggaaataactacgtgtcttggtatcaggtactcccgggtactgcccccaaacttctgatatacaagaataacgagagaccttcgggcatcccagacaggttctcagggagcaaaagtggaacgtccgcgaccttggatattacaggcttacagactggtgacgaagctgattattactgtgggacctgggacacatctctgagcgccggaggcgtgtttggcaccgggactaaggtcacagtgcta

SEQ ID NO: 25697 - RNA, 333 nt, synthetic construct
  misc_feature 1..333: note = derived and/or modified sequence opt3 from anti-HIV_048-011158_VR-Chain
  source 1..333: mol_type = other RNA
cagagcgtgctgacccaacccccttccgtctctgccgctccaggccagaaggttacaatctcatgcagtgggattagctccaacataggaaataacgacgtgtcttggtaccagcagctcccgggtactgcacccaaacttctgatctatgataatgacaagagaccttcgggcattccagataggttctcagggagcaaaagtggaacgtccgccaccttgggcatcacaggtttacaaactggggacgaggcggattactattgtggaacctgggactctagcctgtccgctggcggcgtatttgggacaggaaccaaggtgactgtccta

SEQ ID NO: 25698 - RNA, 333 nt, synthetic construct
  misc_feature 1..333: note = derived and/or modified sequence opt3 from anti-HIV_048-010720_VR-Chain
  source 1..333: mol_type = other RNA
cagagcgtgctgacccaacccccttccgtctctgccgctccaggccagaaggttacaatctcatgcagtgggagctcctctaacattggatcgcactacgtgtcatggtatcagcaggtaccgggtactgcacccagactcgtgatatacgagaatagcaaaaggcctagtggcatcccagaccggttctccgggtctaagagcggaacgtccgccacccttggcattacaggtctgcaaactggggatgaagcggactattactgtggaacctgggatacatcattgagtgctggcggcgtctttgggagcggaaccaaagtgactgtttta

SEQ ID NO: 25699 - RNA, 333 nt, synthetic construct
  misc_feature 1..333: note = derived and/or modified sequence opt3 from anti-HIV_048-009445_VR-Chain
  source 1..333: mol_type = other RNA
cagagcgtgctgacccaacccccttccgtctctgccgctccaggccagaaggttacaatctcatgcagtgggagctcctctaacattggaaataactacgtgtcgtggtatcagcagctcccgggtactgtacccaaacttctgatatacgacacgtataccagaccttcaggcacaccagataggttcagcgggagtaagtccggaacttctgcaaccttggccatcacaggcttacaaaccggtgacgaggcggattactattgtgggacttgggacggaagcctgtccacaggcggcgtgattgggaccggaacgaaagtcactgtgcta

SEQ ID NO: 25700 - RNA, 324 nt, synthetic construct
  misc_feature 1..324: note = derived and/or modified sequence opt3 from anti-HIV_048-006126_VR-Chain
  source 1..324: mol_type = other RNA
cagagcgtgctgacccaacccccttccgtctctggcgccccagggcagaaggttacaatctcatgcagtggaattagctccaacttcggtatatcttggtaccaacaggtgccgggcactgctcccaaactccttatctatgagaatgacaagagaccttcggggattccagataggttttcaggaagcaaaagtggcacgtccgcaaccctgggtatcacagggttgcagactggagacgaagccgattactattgtggcacctgggacacatctttaagcgcgggcggggtattcggaaccggtactaaggtgacagtcctg

SEQ ID NO: 25701 - RNA, 333 nt, synthetic construct
  misc_feature 1..333: note = derived and/or modified sequence opt3 from anti-HIV_048-005652_VR-Chain
  source 1..333: mol_type = other RNA
cagagcgtgctgacccaacccccttccgtctctgccgctccaggccagaaggttacaatctcatgcagtgggagcaactccgcaattggaaataactacgtgtcttggtatcaggtactcccgggtactgcccccaaacttctgatatacgacacgtataagagagcgtcgggcatccctgataggttctcagggagcaaaagtggaacctccgctacattgggcattactggtttacagaccggggacgaggccgattactattgtggaacatgggacacctctctgagcggcggcggggtgtttggaactggtacaaaggtcaccgtgcta

SEQ ID NO: 25702 - RNA, 333 nt, synthetic construct
  misc_feature 1..333: note = derived and/or modified sequence opt3 from anti-HIV_048-005532_VR-Chain
  source 1..333: mol_type = other RNA
cagagcgtgctgacccaacccccttccgtctctgccgctccaggccagaaggttacaatctcatgcagtgggactagctccaacattggaaatacgtacgtgtcttggtatcagcagctcccgggtaccgcacccaactaccttatatataaaatcgacaagagaccttcgggcattccagataggttctcagggagcaaaagtggaacatccgccactctgggcatcaccggtttgcaaacaggggacgaggcggattactattgtggaacctgggacacttctttaagcgctggcggcgtatttgggacaggaaccaaggtgacggtcctg

SEQ ID NO: 25703 - RNA, 333 nt, synthetic construct
  misc_feature 1..333: note = derived and/or modified sequence opt3 from anti-HIV_048-005189_VR-Chain
  source 1..333: mol_type = other RNA
cagagcgtgctgacccaacccccttccgtctctgccgctccaggccagaaggttacaatctcatgcagtgggagcggatccactattggtaacaatgacgtgtcttggtaccagcagctcccgggcgcagcccccaaacttctgatatatgaggataacaagagaccttcggggatcccagcgaggttctcaggaagcaaaagtggcacgtccgctaccttgcggattacaggtttacaaactggggacgaagccgattactattgtggaacctgggactctagcctgtccgcaggcggcgtatttgggacaggaacccgcgtgtcagtccta

SEQ ID NO: 25704 - RNA, 333 nt, synthetic construct
  misc_feature 1..333: note = derived and/or modified sequence opt3 from anti-HIV_048-005088_VR-Chain
  source 1..333: mol_type = other RNA
cagagcgtgctgacccaacccccttccgtctctgccgctccaggccagaaggttacaatctcatgcagtgggagctcctctaacattggaaagaattacgtgtcgtggtatcagcagctcccgggtactgcacccaaacttctgatatacgacaacaataacagaccttcaggcatcccagataggttcagcgggagtaaatccggaacgtctgccaccttgggcattacaggtttacaaactggggacgaggcggattattactgtggagcttgggacaccagcctgtccgccggcggcgtatttgggacaggaaccaaggtgactgtccta

SEQ ID NO: 25705 - RNA, 333 nt, synthetic construct
  misc_feature 1..333: note = derived and/or modified sequence opt3 from anti-HIV_048-004023_VR-Chain
  source 1..333: mol_type = other RNA
cagagcgtgctgacccaacccccttccgtctctgccacaccaggccagaaggttactatctcatgcagtgggggaagctccaacattggtaaaaatgacgtgtcttggtaccagcagctcccgggcacggctcccaaacttctgatatatgataccaacaagagaccttcggggatcccagacaggttctcagcagcccggagcggaacaagtgcgactttggatattaccggcttacaaacaggtgacgaggctgattactattgtgggacctgggacacttccctgtctgccggaggcgtatttggcacagggaccaaggtgacggtccta

SEQ ID NO: 25706 - RNA, 333 nt, synthetic construct
  misc_feature 1..333: note = derived and/or modified sequence opt3 from anti-HIV_048-001580_VR-Chain
  source 1..333: mol_type = other RNA
cagagcgtgctgacccaacccccttccgtctctgccgctccaggccagaaggttacaatctcatgcagtgggagctcctctaacattggaaataactacgtgtcgtggtatcagcagctcccgggtactgcacccaaacttctgttgtacgagaataacaagagaccttcaggcataccagacaggttcagcgggagtaaatccggaacgtctgccaccttagcgatcacaggcctgcaaactggtgatgaagctgcctattactgtgggacctgggacggaagcctatccacaggcggcgtaattgggaccggaactaaggtgacagtcctc

SEQ ID NO: 25707 - RNA, 333 nt, synthetic construct
  misc_feature 1..333: note = derived and/or modified sequence opt3 from anti-HIV_038-221120_VR-Chain
  source 1..333: mol_type = other RNA
cagagcgtgctgacccaacccccttccgtctctgccgctccaggccagaaggttacaatctcatgcagtgggagcacttccaacattggaaagaattacgtgtcttggtatcagcagctcccgggtacggcacccaaacttctgatatacgacaacaatgagagaccttcgggcatcccagataggttctcagggagcaaaagtggaacctccgccacattgggcattactggtttacaaaccggggacgaagcggattattactgtgctacatgggactctagcctgtccggaggcggcgtatttgggaccggaactcgggtgacagtccta

SEQ ID NO: 25708 - RNA, 333 nt, synthetic construct
  misc_feature 1..333: note = derived and/or modified sequence opt3 from anti-HIV_038-197677_VR-Chain
  source 1..333: mol_type = other RNA
cagagcgtgctgacccaacccccttccgtctctgccgctccaggccagaaggttacagtgtcatgcagtgggagcaactccaatatcggaaaccactacgtatcttggtatcagcagctcccgggtactgcacccaaacttctgatttacgacaataacaagagaccttcgggcataccagataggttctcagggagcaaaagtggaacgtccgccaccttgggcatcacaggtttacaaactggggacgaggcggattattactgtggaacctgggactctagcctgtccgctggcggcgtgtttgggacaggaaccaaggtcactgtgcta

SEQ ID NO: 25709 - RNA, 333 nt, synthetic construct
  misc_feature 1..333: note = derived and/or modified sequence opt3 from anti-HIV_038-196765_VR-Chain
  source 1..333: mol_type = other RNA
cagagcgccctgacccaacccgcttccgtgtctggctcacctgggcagagtatcacaattagctgcactggaacgtccggtgacgtcggctacaacctcgtttcttggtatcagcagcttccagggaccgcaccgaaggtgctgatatacgagaataacaaaagaccctcgggaatccctgataggttctcaggcagcaagagtggtacatccgccactttggggattaccggattacaaacaggcgacgaagcggattattactgtggcacctgggactctagcctgtccgctgggggagtatttggtactggcacaaaagtgaccgtccta

SEQ ID NO: 25710 - RNA, 333 nt, synthetic construct
  misc_feature 1..333: note = derived and/or modified sequence opt3 from anti-HIV_038-186200_VR-Chain
  source 1..333: mol_type = other RNA
cagagcgtgctgacccaacccccttccgcctctggcacaccagggcagagaatcactatttcatgcagtggaacgagctccaacataggttctaatatcgtctcgtggtaccagcacctcccgggcaccacacccaaacttgttattttcaggaacaatcagcggccttcagggatcccagaccgctttagcggaagtaagtccggcacttctgctaccctgggtattacagggttgcaaaccggagatgaggcagactattactgtggcacttgggatagctccttatcagccggcggggtgttcggaacaggtaccaaggtaacggtgctg

SEQ ID NO: 25711 - RNA, 333 nt, synthetic construct
  misc_feature 1..333: note = derived and/or modified sequence opt3 from anti-HIV_038-126170_VR-Chain
  source 1..333: mol_type = other RNA
cagagcgtgctgacccaacccccttccgtctctgccccaccgggccagaaggttacaatctcatgcagtgggactacgagcaacattggatccaattacgtggcttggtatcagcagctccccggtaccgcacctaaacttctgatatacgacaacgtaaagagaccaacaaatatccccgataggttctctggctcgaaatcagggactagcgccaccttgggaattacaggcttacaaaccggtgacgaggcggattattactgtgggacttgggacagttccctgtctgctggaggcgtgtttggcacagggaccaaggtcacggtgcta

SEQ ID NO: 25712 - RNA, 333 nt, synthetic construct
  misc_feature 1..333: note = derived and/or modified sequence opt3 from anti-HIV_038-108545_VR-Chain
  source 1..333: mol_type = other RNA
cagagcgtgctgacccaacccccttccgcctctggcacaccagggcagagagtcactatctcatgcagtggaagctcctctaacattggttacaatacggtttcgtggtatcagcagctcccgggcaccgctcccaaacttctgatatacgagaacaataagaggccttcagggatcccagaccggttcagcggaagtaagtccggcacatctgcaactttgggtattaccgggttacaaacaggagatgaagccgactattactgtggcacctgggatagctccctgtcagcgggcggggtgtttggaactggtacaaaagtaaccgtgcta

SEQ ID NO: 25713 - RNA, 333 nt, synthetic construct
  misc_feature 1..333: note = derived and/or modified sequence opt3 from anti-HIV_038-107263_VR-Chain
  source 1..333: mol_type = other RNA
cagagcgtgctgacccaacccccttccgcctctggcacaccagggcagagagtcactatctcatgcagtggaagctcctctaacattggttcgaatacggttaactggtaccaacaggtgccgggcaccgctcccaatctccttatatattcaaacgaccagaggcctagcgggatcccagatcggttcagtggatccaagtctggcacaagcgcaactctgggtattaccgggttgcagacaggagacgaggccgattactattgtggcacctgggactcctcattaagtgcgggcggggtatttggaactggtacaaaagtgaccgtcctg

SEQ ID NO: 25714 - RNA, 333 nt, synthetic construct
  misc_feature 1..333: note = derived and/or modified sequence opt3 from anti-HIV_038-104530_VR-Chain
  source 1..333: mol_type = other RNA
cagagcgtgctgacccaacccccttccgtctctgccgctccaggccagaaggttacaatctcatgcagtgggagctcctctaacattggatcgaattacgtgtcatggtatcagcacctcccgggtaaagcacccaaacttctgatatacgacaacaataagagacctagcggcatcccagataggttcagtgggtccaagtctggaactagcgccacgttgggcattaccggtttacagacaggggacgaggcggattattactgtggaacttgggactcctcactgagtgctggcggcgtatttgggaccggaacaaaagtgaccgtccta

SEQ ID NO: 25715 - RNA, 333 nt, synthetic construct
  misc_feature 1..333: note = derived and/or modified sequence opt3 from anti-HIV_038-099169_VR-Chain
  source 1..333: mol_type = other RNA
cagagcgtgctgacccaacccccttccgcctctggcacaccagggcagagagtctcaatcagttgcagcggaattacttcctctctcggttcgaaccacatgtcatggtaccagcagcttccgggcacggctcccaagctgttgatatatgagaataacaaaaggcctagcgggatcccagaccggttcagtggatccaagtctggcaccagcgcaacattaggtattactgggctgcaaaccggagatgaagccgactactattgtggcacatgggattcctcactaagtgcgggcggggtttttggaaccggtactaaagtgacagtactc

SEQ ID NO: 25716 - RNA, 333 nt, synthetic construct
  misc_feature 1..333: note = derived and/or modified sequence opt3 from anti-HIV_038-075067_VR-Chain
  source 1..333: mol_type = other RNA
cagagcgtgctgacccaacccccttccgtctctggcgccccagggcagagagttacaatctcatgcagtggaagctcctctactattggtaacaattacgtgtcgtggtatcagctccttccgggcacggctcccaagctgttgatatacaaaaacaataagaggccttcagggatcccagaccggttcagcggaagtaaatccggcacctctgcaacattaggtattactgggctgcagaccggagatgaggccgactattactgtggcacatgggataccagcctatccgcgggcggggtatttggaactggtacaaaggtgaccgtcctc

SEQ ID NO: 25717 - RNA, 333 nt, synthetic construct
  misc_feature 1..333: note = derived and/or modified sequence opt3 from anti-HIV_038-072368_VR-Chain
  source 1..333: mol_type = other RNA
cagagcgtgctgacccaatccccctctgcctcaggcacacctgggcagagagtcactatcagttgcagcggatcctcttcgaacattggtaataactacgtttcatggtatcagcagctcccaggcacggctccgaaacttctgatatacgagaataacaagaggcccagcgggatccctgaccggttcagtggatccaagtctggcaccagcgcaacattgggtattactgggttacaaaccggagatgaagccgactattactgtggcacatgggattcctcactgagtgcgggcggggtgtttggaaccggtactaaagtaacagtgcta

SEQ ID NO: 25718 - RNA, 333 nt, synthetic construct
  misc_feature 1..333: note = derived and/or modified sequence opt3 from anti-HIV_038-068503_VR-Chain
  source 1..333: mol_type = other RNA
cagagcgtgctgacccaacccccttccgtctctgccgctccaggccagatggttacaatctcatgcagtgggagcagatccaacattgagaatcactacgtgtcttggtatcagcatctcccgggagcagcccccaaacttctgatatacgacaacggtaagaggccttcgggcatcccagatcggttctcagggagcaagagtggaacttccgcgacgttgggcattaccggtttacagacaggggacgaagctgattattactgtggaacttgggactctagcctgtccgccggcggcgtatttgggaccggaacaaaagtgaccgtccta

SEQ ID NO: 25719 - RNA, 333 nt, synthetic construct
  misc_feature 1..333: note = derived and/or modified sequence opt3 from anti-HIV_038-068016_VR-Chain
  source 1..333: mol_type = other RNA
cagagcgtgctgacccaacccccttccgcctctggcacaccagggcagagagtcactatctcatgcagtggaagctcctctaacattgagtcgaatttcgtttactggtatcagcagtttccgggtacgacccccaagctccttatatacagggacggccaacggccttcagggatcccagatcgcttcagcggaagtaaatccggcacatctgctactctgggtattaccgggttgcagacaggagacgaagcagattattactgtggcacctgggacagctccttatcagccggcggggtgtttggaactggtacaaaggtaaccgtgctg

SEQ ID NO: 25720 - RNA, 333 nt, synthetic construct
  misc_feature 1..333: note = derived and/or modified sequence opt3 from anti-HIV_038-063958_VR-Chain
  source 1..333: mol_type = other RNA
cagagcgtgctgacccaacccccttccgtctctggcgcgccagggcagagagttacaatctcatgcactggaagtagctccaacattggtaattctggcgtgcactggtaccagcagctcccggggacggctcccaaacttctgatatatgagaacaataagaggccttcgggaatcccagaccggttctcaggcagcaagagtggtacctccgcaacattggggattactggattacaaaccggcgatgaagccgactactattgtggcacatgggattctagcctgtccgccgggggagtatttggtaccggcactaaagtgacagtccta

SEQ ID NO: 25721 - RNA, 333 nt, synthetic construct
  misc_feature 1..333: note = derived and/or modified sequence opt3 from anti-HIV_038-033733_VR-Chain
  source 1..333: mol_type = other RNA
cagagcgtgctgacccaacccccttccgcctctggcacaccagggcagagagtcactatctcatgcagtggaagctcctctaacattggttcgaagtacgtttattggtaccagcagctcccgggcacggctcccaaacttctgatatatgacaatgataagaggccttcagggatcccagaccggattagcgcaagtaaatccggaacctctgccacattggatatcactcgcttacaaaccggcgacgaggcggattactattgtggtacatgggacagctccctgtcagctgggggagtgttcggcaccggcactaaggtaacagtgcta

SEQ ID NO: 25722 - RNA, 333 nt, synthetic construct
  misc_feature 1..333: note = derived and/or modified sequence opt3 from anti-HIV_038-030557_VR-Chain
  source 1..333: mol_type = other RNA
cagagcgtgctgacccaacccccttccgtctctgccgctccaggccagaaggttacaatctcatgcagtgggagctcctctactattggaaacaattacgtgtcgtggtatcagctccttccgggtacggcacccaaactgttgatatacaagaacaataaaagaccttcaggcatcccagacaggttcagcgggagtaagtccggaacctctgccacattaggcattactggtctgcagaccggggatggagcggactattactgtggcacatgggataccagcctatccgctggcggggtatttggaactggtacaatcgtgaccgtcctc

SEQ ID NO: 25723 - RNA, 333 nt, synthetic construct
  misc_feature 1..333: note = derived and/or modified sequence opt3 from anti-HIV_038-024298_VR-Chain
  source 1..333: mol_type = other RNA
cagagcgtgctgacccaacccccttccgtctctgccgctccaggccagaaggttacaatctcatgcagtgggagctcctctaacattggaaattcgcacgtgtcatggtaccagcagttcccgggtactggccccaaactccttatatatgagaacgcaaagagacctagcgggatcccagacaggattagtggatccaaatctgatacgagcgccaccctgggcatcacaggtttgcaaactggggacgaagcggattactattgtggaacctgggactcctcattaagtgctggcggcgtatttgggacaggaaccaaggtgactgtcctg

SEQ ID NO: 25724 - RNA, 333 nt, synthetic construct
  misc_feature 1..333: note = derived and/or modified sequence opt3 from anti-HIV_038-011154_VR-Chain
  source 1..333: mol_type = other RNA
cagagcgtgctgacccaacccccttccgtctctgccgctccaggccagagaatcacaatttcatgcagtgggagctcctctaacataggaaataactacgtttcgtggtatcagcagctcccgggtactgcacccaaacttctgatctacaagaataacaagaggccttcaggcattccagaccggttcagcgggagtaaatccggaacgtctgccaccttgggcatcacaggtttacaaactggggatgaggcggactattactgtggaacctgggatacaagcctgtccgctggcggcgtgtttgggaccggaactaaggtaacagtgcta

SEQ ID NO: 25725 - RNA, 318 nt, synthetic construct
  misc_feature 1..318: note = derived and/or modified sequence opt3 from anti-HIV-1_LightChain
  source 1..318: mol_type = other RNA
gagatcgtgctgacccagagccccggcacactctccctttctcctggggaaagagccactctgtcatgcagggctagtcaaagcgtctccaacaatttcttggcatggtaccagtataagccaggacagccgccccgggttttaatttacggtacgtctcgccgagcctcgggcatacctgaccgtttttcagggagcggaagtggcaccgatggttccctgacaatctctagactagaggcggaagacttcgctgtgtattactgtcagcaatatgagtttttcgggcagggaactaggctcgaaatgaaacggacc

SEQ ID NO: 25726 - RNA, 318 nt, synthetic construct
  misc_feature 1..318: note = derived and/or modified sequence opt3 from anti-HIV-1_LightChain
  source 1..318: mol_type = other RNA
gaggtggtcctgacccagagccccggcacactctccctttctcctggggaaagagccactctgtcatgcagggctagtcaaagcgtttcccggaactacttggcatggtatcagcagaagttaggacacggtccacgcctgctagtgtacgccacgtctcgacgtgcgaccggcatcccggacagattcattgggtcgcagtcaggaacagagtataatctcactataaccaggctggatcccggcgactttgctcaatacttctgtcagcagtatgaatttttcggtcctgggacacggcttgatatcaaacgcacc

SEQ ID NO: 25727 - RNA, 309 nt, synthetic construct
  misc_feature 1..309: note = derived and/or modified sequence opt3 from anti-HIV-1_LightChain
  source 1..309: mol_type = other RNA
gaagtggtcctgacccagagccccggcacactctccctttctcctggggaaagagcctcattcagttgcaagagctcccaatacggacacactgcttggtatcagcagaaactgggtcatggcccaaggttgttaatctacgcaacgtctcggcgcgccaccgggattccggaccgatttataggatcgcagtcaggcacagagtataacctgactatcacccgtctagatcccggtgacttcgcgcactacttttgtcaacagaatgagttctttgggcctggaacaagactcgatatgaagaggacc

SEQ ID NO: 25728 - RNA, 306 nt, synthetic construct
  misc_feature 1..306: note = derived and/or modified sequence opt3 from anti-HIV-1_LightChain
  source 1..306: mol_type = other RNA
gagatcgtgctgacccagagcccctcctctctctcacttagtcctggcgaaagagccagcctgtcctgcagggggtctcacggacatgtcgcttggtaccaacacaagccaggtcagattccgcggttgttaatatatgcaacatcgaaacgcgcctcaggcatcagcgaccgattcagtgggtccggatctggcactgatgcgacgctgagcatttcccgtctagagcccgaagactttgctgtttacttctgtcagcagtatgagtttttcggtcaagggaccagactcgaaatcaagaggaca

SEQ ID NO: 25729 - RNA, 306 nt, synthetic construct
  misc_feature 1..306: note = derived and/or modified sequence opt3 from anti-HIV-1_LightChain
  source 1..306: mol_type = other RNA
gagatcatgctgacccagagccccggcacactctccctttctcctggggaaagagccactctgtcatgcaggggaagtcacggtcatgtggcttggtaccaacagaagccaggccggattccgcgcttgttaatatatgggacgagcaaacgagcatccggaatccccgaccgtttctctggctcgggttcagggaccgatgccacactgactattagcagactagagagtgaagactttgcggtctacttctgtcagcagtatgagtttttcggacaaggcaccaggctcgatatcaaccggaca

SEQ ID NO: 25730 - RNA, 309 nt, synthetic construct
  misc_feature 1..309: note = derived and/or modified sequence opt3 from anti-HIV-1_LightChain
  source 1..309: mol_type = other RNA
gagagcgtgctgacccagtcccccggcacactctctctttcacctggggaaactgccagtctgagctgcacggctgcattgtacggacacatgacctggtatcaaaagaaaccaggtcagccgcccaagttactgctatacgcctcctctaaaagagcgtcgggcatccctgacaggttctcagggagccagtttggaaagcagtatacactcattataactaaaatggagccagaagatttcgctgagtactattgtcaacagtttgaagtcttcggccagggtacccggctggacatgcgccgaaca

SEQ ID NO: 25731 - RNA, 306 nt, synthetic construct
  misc_feature 1..306: note = derived and/or modified sequence opt3 from anti-HIV-1_LightChain
  source 1..306: mol_type = other RNA
gaggtggtcctgacccagagccccggcacactctccctttctcctggggaaagagccactctgtcatgcaggggaagtcacggtcatttgagctggtaccaatataagccaggccagccgccccgggttttaatctacgggacgtcccgccgagcttctggcattcctgaccgtttctcgggatcaggtagcgggaccgatggaagtctgacaatatccagactagaggcagaagactttgccgtgtattactgtcagcagtatgagttctttggccaaggcactaggctcgaaatgaaacggacc

SEQ ID NO: 25732 - RNA, 309 nt, synthetic construct
  misc_feature 1..309: note = derived and/or modified sequence opt3 from anti-HIV-1_LightChain
  source 1..309: mol_type = other RNA
gaggtggtcctgacccagagccccggcacactctccctttctcctggggaaagagcctcactgagttgcaagagctcccaatacggacacactgcttggtatcagcagaaattgggtcagggcccaaggttactgatctacgcaacgtctcggcgcgccaccgggattccggaccgattctcgggatcacaaagcggcacagagtataacctaactataacccgtctcgatcccggtgactttgcgcagtacttctgtcagcagtatgaatttttcgggcctggaacaagactggatatcaagaggacc

SEQ ID NO: 25733 - RNA, 306 nt, synthetic construct
  misc_feature 1..306: note = derived and/or modified sequence opt3 from anti-HIV-1_LightChain
  source 1..306: mol_type = other RNA
gagatcatgctgacccagagccccggcacactctccctttctcctggggaaagagccactctgtcatgcaggggaagtcacggtcatgtggcttggtaccaacagaagccaggccggattccgcgcttgttaatatatgggacgagcaaacgagcatccggaatccccgaccgtttctctggctcgggttcagggaccgatgccacactgactattagcagactagagagtgaagactttgcggtctactattgtcagcagtacgagttctttggacaaggcaccaggctcgatatcaagcggaca

SEQ ID NO: 25734 - RNA, 309 nt, synthetic construct
  misc_feature 1..309: note = derived and/or modified sequence opt3 from anti-HIV-1_LightChain
  source 1..309: mol_type = other RNA
gagagcgtgctgacccagtcccccggcacactctctctttcacctggggaaactgccagtctgagctgcacggctgcatcctacggacacatgacctggtatcaaaagaaaccaggtcagccgcccaagttgttaatcttcgccacatctaaaagagcgtcgggcattcctgacaggttttcagggagccagttcggaaagcagtacactctgaccataacacggatggagccagaagattttgctggctattactgtcaacaggtcgagttctttggtcaggggacccgcctagaaatccgacgtact

SEQ ID NO: 25735 - RNA, 309 nt, synthetic construct
  misc_feature 1..309: note = derived and/or modified sequence opt3 from anti-HIV-1_LightChain
  source 1..309: mol_type = other RNA
gacatccagatgacccaaagcccctcctctctgtcagccagtgtgggcgatagagtcacaattacttgccaggctagccaggacatatccaactacctcaattggtatcagcaaaagcctgggaaagcaccaaaacttctgatctacgatgcctctaacttggagacgggagttccgtcgaggttctcaggtagcggctttcacaccacattcagtttaactatttccgggctgcagcgggacgattttgcgacctatttctgtgctgtgctagaatttttcggacccggcacaaaggtagactttaat

SEQ ID NO: 25736 - RNA, 309 nt, synthetic construct
  misc_feature 1..309: note = derived and/or modified sequence opt3 from anti-HIV-1_LightChain
  source 1..309: mol_type = other RNA
gacatccagatgacccaaagcccctcctctctgtcagccagtgtgggcgatagagtcacaattacttgccaggctagccaggacataacgaactacctcaattggtatcagcaaaagcctgggagggcaccaaaacttctggttcacggagcctccaacttgcagcggggtgtgccgtctcgcttctcgggctcagggtttcataccacattcactttaaccatcagcagtctgcagcccgatgacgtagcgacatacttttgtgaggtgttccagtggtttggacctggcacccgagtcgatttcaat

SEQ ID NO: 25737 - RNA, 309 nt, synthetic construct
  misc_feature 1..309: note = derived and/or modified sequence opt3 from anti-HIV-1_LightChain
  source 1..309: mol_type = other RNA
ggcttccagctgacccaaagcccctcctctctctcagccagtgtgggggacagagtcagcatcaactgccaggctggagagggtattggctcctctcttaattggtaccagcagaagcctgggagggcaccaaaactgttggttcacggagcctcgaacttacaacggggcgtgccgtcacgctttagcggtagtgggttccatacaacttttacgctgaccatatcctctctacagcccgatgacgtagcgacatatttctgtgaagtgtttcagtggttcggacctggcactcgagtcgattttaat

SEQ ID NO: 25738 - RNA, 309 nt, synthetic construct
  misc_feature 1..309: note = derived and/or modified sequence opt3 from anti-HIV-1_LightChain
  source 1..309: mol_type = other RNA
ggcatccagctgacccaaagcccctcctctctctcagtgagtgtcggggacagagttacaattacttgcagggccagccagggaataggtaactcccttaattggtaccagcagaagcctggcaaagctccaaacctgatggtgttcgggacgaccaagttgaatcggggagtaccgtctcgcttttcgggctcaggtagcgggacaactgcaaccttaacaatcaacagtctgcaacccgaagatattgccacctatttctgtcaggtgtttgagttcctaggacctggcactaaactcgacatgaag

SEQ ID NO: 25739 - RNA, 309 nt, synthetic construct
  misc_feature 1..309: note = derived and/or modified sequence opt3 from anti-HIV-1_LightChain
  source 1..309: mol_type = other RNA
gacatccagatgacccaaagcccctcctctctgtcagccagtgtgggcgatagagtcacaattacttgccaggctgggcagggaataggtagctccctcaagtggtaccagcaaaaacctggcagggcaccacggcttctggttcacggggcctctaacttgcatcgcggagtgccgtcgcgattctcaggcagcggttttcacacgaccttcagtttaacaatctccgggctgcagcgtgacgattttgcgacttatttctgtgctgtactagagtttttcggacccggcaccaaggtggactttaat

SEQ ID NO: 25740 - RNA, 309 nt, synthetic construct
  misc_feature 1..309: note = derived and/or modified sequence opt3 from anti-HIV-1_LightChain
  source 1..309: mol_type = other RNA
ggcatccagctgacccaaagcccctcctctctctcagccagtgtgggggacagagtcacaattacttgccaggctagccagggaataggttcctctcttcagtggtaccaacagaagcctggcagggcaccaaacctgttggttcacggggcctcgaatttacatcggggagtgccgtcacgcttcagcggcagtggttttcacacgaccttctccctgacaatctctgggctacagcgagatgactttgcgacttatttctgtgctgtactcgagtttttcggacccggcaccaaagtggaaattaag

SEQ ID NO: 25741 - RNA, 309 nt, synthetic construct
  misc_feature 1..309: note = derived and/or modified sequence opt3 from anti-HIV-1_LightChain
  source 1..309: mol_type = other RNA
ggcgtgcagctgacccaaagcccctcctctctctcagccagtgtcggggacagagttagcatcaactgccaggctggacagggtattggctcctctcttaattggtaccagcaaaagagggggaaagcacctaagctgttggtgcacggagcctcgacattacagcggggcgtaccatcacgcttcagcggtagtgggtttcatactacgttcaccctgacaatatcctctctacagccggatgacgtggcgacttatttttgtgaggtcttccagtggtttggacccggcacccgagtggatttcaac

SEQ ID NO: 25742 - RNA, 306 nt, synthetic construct
  misc_feature 1..306: note = derived and/or modified sequence opt3 from anti-HIV-1_LightChain
  source 1..306: mol_type = other RNA
tacatccagctgacccaaagcccctcctctctctcagccagtattggcgacagagtgacaatagcttgcagggcaagccaggggatcggatatgtccactggtaccagcagaagcggggtaaacctccaaaacttctgattcatggcgcctccatcttggagcgcggggttccgtctcgattctcgggatcaggcagcggtactttatttaacctgacggtgagtgggctacaacccgaagatttcgcgacctatatgtgtcaggtatttgagtccttcggacctggcacaaaggtgcagatgaag

SEQ ID NO: 25743 - RNA, 309 nt, synthetic construct
  misc_feature 1..309: note = derived and/or modified sequence opt3 from anti-HIV-1_LightChain
  source 1..309: mol_type = other RNA
ggcatccagctgacccaaagcccctcctctctctcagccagtcttggggacagagtgacaattacttgccaggctagccagggaataggttcctctctgcagtggtaccaacagaagcctggcaaagcaccaaagttgttagtccacggggcctcgaaactgcataggggagttccgtcacggttcagcggcagtggttttcacacgaccttctccctaacaatctctagcctccagcccgaagattttgcgacttatctgtgtcaggtgcttgagttctttgggcctggaaccaaggtagacttcaac

SEQ ID NO: 25744 - RNA, 309 nt, synthetic construct
  misc_feature 1..309: note = derived and/or modified sequence opt3 from anti-HIV-1_LightChain
  source 1..309: mol_type = other RNA
ggcatccagctgacccaaagcccctcctctctctcagccagtgtgggggacacagtcactattacgtgccaggctagccagggaataggttcctctcttcagtggtaccaacagaagagaggcagggcacctaaactgttggttcacggggcctcgaacttacagggaggcgtgccatcacggttcagcggtagtgggtttcataccacattcactctggcgatccgcggactacagccggatgactttgctacctatttctgtcaatccctcgagtttttcggccccggcacaaaggtagatatgaaa

SEQ ID NO: 25745 - RNA, 306 nt, synthetic construct
  misc_feature 1..306: note = derived and/or modified sequence opt3 from anti-HIV-1_LightChain
  source 1..306: mol_type = other RNA
tacatccagctgacccaaagcccctcctctctctcagccagtgtgggcgacagagtcacaattacttgcagggctagccaggatatagggtatgtttcctggtacgcacagaagcggggacgcgcccctaaacttctgatccacggtgcgtctggcttggagcgaggggtgccatcgcgtttctcaggaagcggcagtggtacgttatttaccctgacaattgaatccctacagccggaggacttcgctacttatatgtgtcaagtatttgaatctttcgggcccggaaccaaggtggagatgaaa

SEQ ID NO: 25746 - RNA, 309 nt, synthetic construct
  misc_feature 1..309: note = derived and/or modified sequence opt3 from anti-HIV-1_LightChain
  source 1..309: mol_type = other RNA
ggcatccagctgacccaaagcccctcctctctctcagccagtgtgggggacagagtcagcattaactgccaggctggacagggtataggctcctctcttaattggtaccagcaaaagcctgggagggcaccaaaactgttggttcacggagcctcgaacttacagcggggcgtgccgtcacgcttcagcggtagtgggtttcatacaactttcacgctgaccatctcctctctacagcccgatgacgtagcgacatatttttgtgctgtgttccagtggtttggacctggcactcgagtcgatttcaat

SEQ ID NO: 25747 - RNA, 366 nt, synthetic construct
  misc_feature 1..366: note = derived and/or modified sequence opt3 from anti-HIV-1_HeavyChain
  source 1..366: mol_type = other RNA
agccagcaactggtgcagtccggcacacaggtcaagaaacccggggcctctgttagaatctcatgccaggctagtggatacacattcactgactatgtgctccactggtggaggcaagcacctggtcagggccttgagtggatggggtggattaagccagtatacggagcccggaactatgcgcgccgatttcagggccgtatagatttcagcagagacatctacagggaaattgcttatatggatctgtccggtttgcggtctgacgatacggccttatacttttgtgcacgcgacgggtcgggagatgacacctcatggcatctggatccgtggggccagggcaccctagtgatcgtcagcgcc

SEQ ID NO: 25748 - RNA, 366 nt, synthetic construct
  misc_feature 1..366: note = derived and/or modified sequence opt3 from anti-HIV-1_HeavyChain
  source 1..366: mol_type = other RNA
agccagcaactggtgcagtccggcacccaggtcaagaaacccggggcctctgttagaatctcatgccaggctagtggatacacattcactgactatctccttcactggtggaggcaagcacctggtcagcggctggagtggatgggctggattaagccagtgtacggggcccgcaactatgcgcatcgatttcagggacgtataaatttcgatagagacatctacagggaaattgcttttatggatttgagcggcttacggtccgacgatacggccgtatatttctgtgcacgcgacggtgggggagatgacagaacctggctgctagatacatggggccagggcactctcgtggtcgtgtcttcg

SEQ ID NO: 25749 - RNA, 366 nt, synthetic construct
  misc_feature 1..366: note = derived and/or modified sequence opt3 from anti-HIV-1_HeavyChain
  source 1..366: mol_type = other RNA
caggtgcacctggagcaacccggcagcgtcgttagatggcctggggcctccctcaccctttcttgcacagcttcaggatacatcttcgtgaactatcatattcactggctgaggcaggcaccaggtcagcggttggaattactgggcactataaatccggtagggggagccacgagttacgcgcagaagtttcgcggccgtctagtgctcacccgagacatcggtagctccacagtcactctgcttctgaaccatttgagaagggatgactctgctgtgtatttctgtgcccgggagtcgaatgcatcagggcgcggaagaagcatggatcactggggcaggggcagtcgggttattgtgtcccaa

SEQ ID NO: 25750 - RNA, 366 nt, synthetic construct
  misc_feature 1..366: note = derived and/or modified sequence opt3 from anti-HIV-1_HeavyChain
  source 1..366: mol_type = other RNA
caggtgcaactggtccagagcggcgccgaggttaagaaacccggggcttccgtgagagtatcttgccaggcatcaggatacaccttcacaaactatatcctccactggtggaggcaggcccctggtcaaggccttgaatggatggggctgattaagccagtgtacggagcggtcaattatgctcggcagtttcagggccgcatacagttgactcgagacatctaccgtgagattgccttcttagatctgagtggtctaagaagcgacgatacggcagtgtattactgtgccagggacgaatccggggatgacctcaaatggcatctgcacccgtggggacaaggcacccaggttatcgtgtctccc

SEQ ID NO: 25751 - RNA, 366 nt, synthetic construct
  misc_feature 1..366: note = derived and/or modified sequence opt3 from anti-HIV-1_HeavyChain
  source 1..366: mol_type = other RNA
caggtgcaactggtccagagcggcgccgaggttaagaaacccggggcttccgtgagaatctcttgccaggcatcaggatacaccttcacagactatgtactccactggtggaggcaggcccctggtcaaggccttgaatggatggggtggattaagccagtgtacggagcgcggaactatgctcgccgatttcagggccgtataaatttcgatagagacatctacagggagattgcctatatggatctgagtggtttgcggagcgacgatactgcacgctacttttgtgccagagacgggtccggagatgacacgtcttggcatttacacccgtggggccagggcaccctggtcatcgtgtcggct

SEQ ID NO: 25752 - RNA, 366 nt, synthetic construct
  misc_feature 1..366: note = derived and/or modified sequence opt3 from anti-HIV-1_HeavyChain
  source 1..366: mol_type = other RNA
agccagcaactggtgcagtccggcacccaggtcaagaaacccggggcctctgttagagtgtcatgccaggctagtggatacacattcactaactatatcctccactggtggaggcaagcacctggtcagggccttgagtggatggggctgattaagccagtatacggagccgtgaattatgcgcggcagtttcagggccgcatacaattgacgcgagacatctaccgtgaaattgctttcttagatctgagcggtctaagaaccgacgatacagccgtctattactgtgcaagggacgagtccggggatgacctcaaatggcatctgcacccgtggggacagggcactcaggtgatcgtttctccc

SEQ ID NO: 25753 - RNA, 366 nt, synthetic construct
  misc_feature 1..366: note = derived and/or modified sequence opt3 from anti-HIV-1_HeavyChain
  source 1..366: mol_type = other RNA
caggtgcacctggagcaaagcggctccgtcgttagatggcccggggcctctctcaccctttcatgcacagctagtggatacatcttcgtgaactatcatattcactggctgaggcaggcacctggtcagcggttggaattaatgggcactataaatccagtagggggagccacgagctacacccagcgctttcgaggccgtctggtgctaacaagagacatcggttccaacactgtcaccctcctgcttaatcatctgaggtctgatgactcggcggtgtatttctgtgctcgggagtcaaacgccagcgggcgcggaagaagtatggatcactggggcaggggctcccatgttattgtgtctccg

SEQ ID NO: 25754 - RNA, 366 nt, synthetic construct
  misc_feature 1..366: note = derived and/or modified sequence opt3 from anti-HIV-1_HeavyChain
  source 1..366: mol_type = other RNA
agccagcacctggtgcaatccggcacccaggtcaagaaacccggggcctctgttagagtgtcatgccaggctagtggatacacattcactaactatatcctccattggtggaggcaggcacctggtcaaggccttgagtggatggggctgattaagccagtatacggagccgtgaattatgcgcggcagtttcagggccgcatacagttgacgcgagacatctaccgtgatattgctttcttagacctgagcggtctaagatccgatgacaccgccgtctattactgtgcaagggatgaatctggggacgatctcaaatggcatctgcacccgtggggacaaggcacacaggtgatcgtttcgccc

SEQ ID NO: 25755 - RNA, 366 nt, synthetic construct
  misc_feature 1..366: note = derived and/or modified sequence opt3 from anti-HIV-1_HeavyChain
  source 1..366: mol_type = other RNA
agccagcaactggtgcagtccggcacccaggtcaagaaacccggggcctctgttagaatctcatgccaggctagtggatacacattcactgactatgtgctccactggtggaggcaagcacctggtcagggccttgagtggatggggtggattaagccagtatacggagcccggaactatgcgcgccgatttcagggccgtataaatttcgatagagacatctacagggaaattgcttatatggatctgagcggtttgcggtccgacgatacggcccgctacttttgtgcaagagacgggtctggagatgacacctcgtggcatttacacccgtggggccagggcacactggtgatcgtctcagcc

SEQ ID NO: 25756 - RNA, 366 nt, synthetic construct
  misc_feature 1..366: note = derived and/or modified sequence opt3 from anti-HIV-1_HeavyChain
  source 1..366: mol_type = other RNA
caggtgcacctggagcaacccggcagcgtcgttagatggcctggggcctccctcaccctttcttgcacagcttcaggatacatcttcgtgaactatcatattcactggctgaggcaggcaccaggtcagcggttggaattactgggcactataaatccggtagggggagccacgagttacgcgcagaagtttcgcggccgtctagtgctcacccgagacatcggtagctccacagtcactctgcttctgaaccatttgagaagggatgactctgctgtgtatttctgtgcccgggagtcgaatgcatcagggcgcggaagaagcatggatcactggggcaggggcaaacccgttattgtgagtcct

SEQ ID NO: 25757 - RNA, 321 nt, synthetic construct
  misc_feature 1..321: note = derived and/or modified sequence opt3 from anti-HIV-1_HeavyChain
  source 1..321: mol_type = other RNA
gagatcgtgatgacccagagccccgccattctgtccgtctctcctggcgacagagctacattctcatgcagggcaagtcaaagcgttaagaacaatctcgcctggtaccagaaacggccagggcaggcgccgcgccttctgatatttgatgcttcctctcgagcctcgggaatccccgcacgtttctcaggtggcgggagcggaactgaatttacgttgaccgtgaacagtatgcagtccgaggacttcgccacatattactgtcaacagtatgaagagtggcctagaacttttggccagggtaccaaggtagaaattatg

SEQ ID NO: 25758 - RNA, 321 nt, synthetic construct
  misc_feature 1..321: note = derived and/or modified sequence opt3 from anti-HIV-1_HeavyChain
  source 1..321: mol_type = other RNA
cagatcgtgctgacccaaagccctcccacactctccctttctccaggcgagagagccactctgtcatgcagggctagtcagagcgtcaagaacaatttggcatggtaccagaaacggccggggcaggcgccccgcttactgattttcgacacgtcctctcgagcctcgaacatacctgctcgtttttcaggaggtggcagcgggaccgagttcacactaactgttaatagtatgcaatccgaagattttgccacctattactgtcagcagtatgaagagtggccaagaacattcggacagggcaccaaggtggaaatcatt

SEQ ID NO: 25759 - RNA, 321 nt, synthetic construct
  misc_feature 1..321: note = derived and/or modified sequence opt3 from anti-HIV-1_HeavyChain
  source 1..321: mol_type = other RNA
gagatcgtgatgacccagagccccgccgtcctgtccgtttctcctggcgacagagctacactctcatgcagggcaagtcaaagcgtgaagaacaatcttgcctggtaccagaaacggccagggcaggcgccgcgcctgttgattttcgatacttcctctcgagcttcgaacatacccgcccgtttttcaggaggtggcagcgggacggagttcaccttaacagtaaatagtatgcagtccgaagactttgcaacttattactgtcaacagtatgaagagtggcctagaaccttcggacagggcacaaaggtggaaatcaac

SEQ ID NO: 25760 - RNA, 321 nt, synthetic construct
  misc_feature 1..321: note = derived and/or modified sequence opt3 from anti-HIV-1_HeavyChain
  source 1..321: mol_type = other RNA
gagatcgtgctgacccagagccctcccacactctccgtctctccaggcgaagccgctactctttcatgcagagcaagtcaaagcgttaagaacaatctggcctggtaccacttgaaagcggggcaggctccgaggttactgattttcgacgcctcctctcgggcaggagatgcccccgctcgcgtgtcgggttcaggctatgggacggagtttaccctaacagtaaacagcgtgcagagtgaagacttcggagattactattgtcagcaatacgaggaatggcctcgaacttttggccagggtaccaaggtcgacctccgt

SEQ ID NO: 25761 - RNA, 321 nt, synthetic construct
  misc_feature 1..321: note = derived and/or modified sequence opt3 from anti-HIV-1_HeavyChain
  source 1..321: mol_type = other RNA
gagatcgtgatgacccagtcaccccctacactgtccgtctctccaggcgaaactgccacgctctcatgcagagctagtcaaaacgttaagaataaccttgcatggtaccagctgaaaccggggcaggcccccaggttgttaattttcgacgcgagctcccgggctggaggtatacctgatcgcttttctggctcggggtatggaaccgacttcacactgactgtgaatagcgtacagagcgaggattttggcgactacttctgtcaacagtatgaagagtggccacgaacctttggtcaggggacaaaggtggatctacgt

SEQ ID NO: 25762 - RNA, 321 nt, synthetic construct
  misc_feature 1..321: note = derived and/or modified sequence opt3 from anti-HIV-1_HeavyChain
  source 1..321: mol_type = other RNA
gagatcgtgatgacccagagccccgccgtcctgtccgtttctcctggcgacagagctacactctcatgcagggcaagtcaaagcgtgaagaacaatcttgcctggtaccagaaacggccagggcaggcgccgcgcctgttgattttcgatacttcctctcgagcttcgaacatacccgcccgtttttcaggaggtggcagcgggacggagttcaccttaacagtaaatagtatgcagtccgaagactttgcaacttattactgtcaacagtatgaagagtggcctagaaccttcggacagggcacaaaggtggaaatcatt

SEQ ID NO: 25763 - RNA, 399 nt, synthetic construct
  misc_feature 1..399: note = derived and/or modified sequence opt3 from anti-HIV-1_HeavyChain
  source 1..399: mol_type = other RNA
gaggtgcatctgcaggaaagcggccccgggctcgtcagacctcttgagaccctgtccttgacatgcactgcctctggagcttcaatcaggggtggcgaatggggagacaacgattaccactgggggtgggttcggcacagtccagagaagggcttagaatggattggtagcatacattggcgcgggacgacccactataatgcaccgttccgaggacgtgccacactgtccatcgacacttctagaaaccaatttttcctaaggctcacctcgatgacagcggatgacaccgctgtgtactattgtgtaaaacataagtaccacgatattgtgatggtcgtgcccatcgccggctggtttgacccttggggccaggggctgcaggttactgtgtcagca

SEQ ID NO: 25764 - RNA, 399 nt, synthetic construct
  misc_feature 1..399: note = derived and/or modified sequence opt3 from anti-HIV-1_HeavyChain
  source 1..399: mol_type = other RNA
gaggtgcatctgcaggaaagcggccccgggctcgtcagacctcttgagaccctgtccttgacatgcactgcctctggagcttcaatcaggggtggcgaatggggagacaacgattaccactgggggtgggttcggcacagtccagagaagggcttagaatggattggtagcatacattggcgcgggacgacccactataatgcaccgttccgaggacgtgccacactgtccatcgacacttctagaaaccaatttttcctaaggctcacctcgatgacagcggatgacaccgctgtgtactattgtgtaaaacataagtaccacgatattgtgatggtcgtgcccatcgccggctggtttaatccttggggccaggggctgcaggcaactgttccatca

SEQ ID NO: 25765 - RNA, 399 nt, synthetic construct
  misc_feature 1..399: note = derived and/or modified sequence opt3 from anti-HIV-1_HeavyChain
  source 1..399: mol_type = other RNA
caggtgcaactgaaggagagcggccccgggctcgtcaaaccttccgaaaccctttctctgacatgcactgtttcaggaggtagtatgagaggcacggactggggagagaacgatttccactacgggtggatcaggcatagctccgccgaaggcttggagtggattggttctatacactggcgggggaccacacattataagatgtcgtttcgctcacgagctactatcagcattgacaccagtaataaccgtttctccttaatgttttctttcgtgacagcagaagataccgccgtatactattgtgcgagacacaaataccatgacatctttagggtggtcccagtggctggatggttcgatccgtggggccagggcctgctagttactgtgagctcc

SEQ ID NO: 25766 - RNA, 399 nt, synthetic construct
  misc_feature 1..399: note = derived and/or modified sequence opt3 from anti-HIV-1_HeavyChain
  source 1..399: mol_type = other RNA
gaggtgcatctgcaggaaagcggccccgggctcgtcagacctcttgagaccctgtccttgacatgcactgcctctggagcttcaatcaggggtggcgaatggggagacaacgattaccactgggggtgggttcggcacagtccagagaagggcttagaatggattggtagcatacattggcgcgggacgacccactataatgcaccgttccgaggacgtgccacactgtccatcgacacttctaaaaaccaattttcgctaagactcacctcaatgacagcggatgacaccgctgtgtactattgtgtaaagcataaataccacgatattgtgatggtcgtgcccttcgccggctggtttgacccttggggccaggggctgagggttactgtgagcgca

SEQ ID NO: 25767 - RNA, 399 nt, synthetic construct
  misc_feature 1..399: note = derived and/or modified sequence opt3 from anti-HIV-1_HeavyChain
  source 1..399: mol_type = other RNA
gaggtgcatctgcaggaaagcggccccgggctggtcagacctcttgagaccctgtccttgacatgcactgcctctggagcttcaatcaggggtggcgaatggggagacaacgattaccactgggggtgggttcggcacagtccagagaagggcttagaatggattggtagcatacattggcgcgggacgacccactataatgcaccgttccgaggacgtgccacactgtccatcgacacttctaaaaaccaatttttcctaagactcacctcgatgacagcggatgacaccgctgtgtactattgtgtaaagcataaataccacgatatttgcatggtggtccccatcgccggctggtttgacccttggggccaggggctccaggtgactgtttcacag

SEQ ID NO: 25768 - RNA, 399 nt, synthetic construct
  misc_feature 1..399: note = derived and/or modified sequence opt3 from anti-HIV-1_HeavyChain
  source 1..399: mol_type = other RNA
caggtgcatctgcaagagagcggccccgggctcgtcagacctcttgaaaccctgtccttgacatgcactgcctctggagcttcaatcaggggtggcgagtggggagacaacgattaccactgggggtgggttcggcacagtccagaaaagggcttagagtggattggtagcatacattggcgcgggacgacccactataatgcaccgttccgaggacgtgccacactgtccatcgacacttctagaaaccagtttttcctaaggctcacctcgatgacagcggatgacaccgctgtgtactattgtgtaaaacataagtaccacgatattgtgatggtcgtgcccatcgccggctggtttgacccttggggccaggggctgcaggttactgtgtcaagc

SEQ ID NO: 25769 - RNA, 399 nt, synthetic construct
  misc_feature 1..399: note = derived and/or modified sequence opt3 from anti-HIV-1_HeavyChain
  source 1..399: mol_type = other RNA
caggtgcatctgcaagagagcggccccgggctcgtcagacctcttgaaaccctgtccttgacatgcactgcctctggagcttcaatcaggggtggcgagtggggagacaacgattaccactgggggtgggttcggcacagtccagaaaagggcttagagtggattggtagcatacattggcgcgggacgacccactataatgcaccgttccgaggacgtgccacactgtccatcgacacttctagaaaccagtttttcctaaggctcacctcgatgacagcggatgacaccgctgtgtactattgtgtaaaacataagtaccacgatattgtgatggtcgtgcccatcgccggctggtttgacccttggggccaggggctgcgggttactgtgtcacag

SEQ ID NO: 25770 - RNA, 399 nt, synthetic construct
  misc_feature 1..399: note = derived and/or modified sequence opt3 from anti-HIV-1_HeavyChain
  source 1..399: mol_type = other RNA
caggtgcatctgcaagagagcggccccgggctcgtcagacctcttgaaaccctgtccttgacatgcactgcctctggagcttcaatcaggggtggcgagtggggagacaacgattaccactgggggtgggttcggcacagtccaggcaagggtttagaatggattgggagcatacattggcgcggaacgacccactataatgcaccgttccgaggccgtgccacactgtccatcgacacttttagaaaccagttctttctaaggctcacctctatgacagcggatgacaccgctgtgtactattgtgtaaaacataagtaccacgatattgtgatggtcgtgcccatcgccggctggttcgacccttgggggcagggactgcaggttactgtgtcgcaa

SEQ ID NO: 25771 - RNA, 399 nt, synthetic construct
  misc_feature 1..399: note = derived and/or modified sequence opt3 from anti-HIV-1_HeavyChain
  source 1..399: mol_type = other RNA
gaggtgcatctgcaggaaagcggccccgggctcgtcagacctcttgagaccctgtccttgacatgcactgcctctggagcttcaatcaggggtggcgaatggggagacaacgattaccactgggggtgggttcggcacagtccagagaagggcttagaatggattggtagcatacattggcgcgggacgacccactataatgcaccgttccgaggacgtgccacactgtccatcgacacttctagaaaccaatttttcctaaggctcacctcgatgacagcggatgacaccgctgtgtactattgtgtaaaacataagtaccacgatattgtgatggtcgtgcccatcgccggctggtttgacccttggggccaggggctgcggggaactgtttcagca

SEQ ID NO: 25772 - RNA, 393 nt, synthetic construct
  misc_feature 1..393: note = derived and/or modified sequence opt3 from anti-HIV-1_HeavyChain
  source 1..393: mol_type = other RNA
caggtgcaactggtccagagcggcgccgttatcaagacccccgggtcctctgtgaaaatttcatgcagagctagtggatacaacttcagggactatagcatacactgggtacggctcatccctgataagggttttgagtggattggctggatcaaaccactttggggagcagtgtcctacgcccgccagctgcaggggcgagtctctatgacacgtcaattgtcgagagacccggatgaccccgattggggcgtggcgtatatggagttctcaggtttaactcctgctgacacggccgaatacttttgtgttaggcgggggagctgcgattattgtggagacttcccatggcagtactggggccagggcaccgtggtcgtggtaagttccgca

SEQ ID NO: 25773 - RNA, 393 nt, synthetic construct
  misc_feature 1..393: note = derived and/or modified sequence opt3 from anti-HIV-1_HeavyChain
  source 1..393: mol_type = other RNA
caggtgcaactggtccagagcggcgccgttatcaagacccccgggtcctctgtgaaactctcatgcagagctagtggatacaacttcagggactatagcattcactgggtacggcttatacctgataagggttttgagtggatcggctggattaaaccactgtggggagcagtgtcctacgcccgccagttgcaggggcgagtctctatgacacgtcaattatcgcaggacccggatgaccccgattggggcgtggcgtatatggagttctcaggtctgactcctgctgacacggccgaatacttttgtgttagaagggggagctgcgattattgtggagacttcccatggcagtactggggccagggcaccgtggtcgtggtaagttccgca

SEQ ID NO: 25774 - RNA, 303 nt, synthetic construct
  misc_feature 1..303: note = derived and/or modified sequence opt3 from anti-HIV-1_LightChain
  source 1..303: mol_type = other RNA
accgccggcctgacacagagccccgggactctctccctttctcctggagagagagctatcctgtcatgcaggacgagtcaatacggtagcttggcatggtatcagcagcggccaggccaggccccgcgcttagtgatttacgcggggctgacccgagctacaggaatacccgaccgtttctccggctctagatggggtgccgaatataacctaactatctcgaatctcgagtcagaagattttggggtctactattgtcaacagtacgacttctttggacagggcaccaaggttcaggtggat

SEQ ID NO: 25775 - RNA, 378 nt, synthetic construct
  misc_feature 1..378: note = derived and/or modified sequence opt3 from anti-HIV-1_HeavyChain
  source 1..378: mol_type = other RNA
caggtgcaactggtccagagcggctccggggttaagaaactcggagcctctgtgagagtatcatgctggaccagtgaggacatcttcgaaaggacagagcttattcactgggtgcggcaggctcccggtcagggcctggaatggatagggtgggtcaaggcagtgagcggagccgttaactacggctccttggattttcgccatcgagtgtctttaactcgtgacagagatctgtcgacggcgcacatggacatcaggggtctaacccaagatgacacagctacttatttctgtgcccggcagaaatttgcacgcggggatcagggatggttctttgacctctggggcagaggcaccctgattgtcgtgtcaagcgcc

SEQ ID NO: 25776 - RNA, 384 nt, synthetic construct
  misc_feature 1..384: note = derived and/or modified sequence opt3 from anti-HIV-1_HeavyChain
  source 1..384: mol_type = other RNA
caggtgcaactggtccagagcggctccggggttaagaaactcggagcctctgtgagagtatcatgctggaccagtgaggacatcttcgaaaggacagagcttattcactgggtgcggcaggctcccggtcagggcctggaatggatagggtgggtcaaggcagtgactggaacggttaactttggcagcttgaatttccgccaacgagtgtccttaacccgtgatagagacctgtttacagcccatatggatatcaggggtctaactcagggggacaccgcgacatacttctgtgctcggcagaaatttgagaagtataccggaggccagggctggtacttcgatctctgggggcgcggaactctgattgtcgtgtcttcggcc

SEQ ID NO: 25777 - RNA, 378 nt, synthetic construct
  misc_feature 1..378: note = derived and/or modified sequence opt3 from anti-HIV-1_HeavyChain
  source 1..378: mol_type = other RNA
caggtgcaactggtccagagcggctccgccatgaagaaacccggggcttctgttagagtgtcatgctggaccagtgaggacatcttcgatacaactgaactcatttactgggtaaggcaggcacctggacagggtcttgagtggataggctgggtgaagatcgtcagcgggacggtgaactttgcctccctggacttccggaatcgcatttctttgtcgcgagatcgtgacttatttaccgcgcacatggatatcagaggactgacacaaggcgacactgctacctatttctgtgccaggcagaaattttacgccggtgggcagggatggtatttcgatctatggggccggggcacactcattgttgtgtcaagcgca

SEQ ID NO: 25778 - RNA, 387 nt, synthetic construct
  misc_feature 1..387: note = derived and/or modified sequence opt3 from anti-HIV-1_HeavyChain
  source 1..387: mol_type = other RNA
caggtgcaactggtccagagcggcgccgaggttaagaaacccggggcttccgtgagagtatcttgctggacctcagaagacatcttcgatacaactgagctcatttactgggtgaggcaggcacctggacagggtcttgaatggataggctgggtcaagatcgtgagtgggacggttaactttgccagcctggacttccggaatcgcatttccttgtctcgagatcgtgacttatcgaccgcgcacatggatatcagaggactgacacaagacgatactgctacctatttttgtgccaggcagaaattcgagtcacggtacacaggcggtcaggggtggtattttgacctatggggacgcggcacccatattgtggtcagcagtgca

SEQ ID NO: 25779 - RNA, 387 nt, synthetic construct
  misc_feature 1..387: note = derived and/or modified sequence opt3 from anti-HIV-1_HeavyChain
  source 1..387: mol_type = other RNA
caggtgcaactggtccagagcggctccgccatgaagaaacccggggcttctgttagagtgtcatgctggaccagtgaggacatcttcgaaaggacagagctcatttactgggtacggcaggcacctggacgcggtcttgaatggataggctgggtgaagactgtcagcgggacggtgaactttggatcctctgatttccgaaatcgtatctcgctgaccagagacagggatttgtcaacagcccacatggacattcggggcttaactcaggatgacaccgcgacatatttttgtgctcgccaaaaattcgagagcctgtacagtgatgaccagggttcctattttgatctatgggggagaggaaccctcatcattgtttctagcgcc

SEQ ID NO: 25780 - RNA, 387 nt, synthetic construct
  misc_feature 1..387: note = derived and/or modified sequence opt3 from anti-HIV-1_HeavyChain
  source 1..387: mol_type = other RNA
caggtgcaactggtccagagcggcctcgaggttaagaaacccggggcctccgtgagagtatcttgctggacctcagaagacatcttcgatacaactgagcttatttactgggtgaggcaggctcctggacagggtctggaatggataggctgggtcaagatcgtgagtgggacggttaactttgccagcttggacttccggaatcgcatttccttatctcgagatcgtgacctgtcgaccgcacacatggatatcagaggactaacacaagacgatactgcgacctatttttgtgctaggcagaaattcgcctcacggtacagcggcgaccagggtagttattttgatctctgggggcgcggaacactgattatcgtgtcctctgca

SEQ ID NO: 25781 - RNA, 387 nt, synthetic construct
  misc_feature 1..387: note = derived and/or modified sequence opt3 from anti-HIV-1_HeavyChain
  source 1..387: mol_type = other RNA
caggtgcaactggtccagagcgcctccggcgttagaaggcccggggcttctgtgcgggtatcatgctggaccagtgaggacatcttcgaacgcagcgagctcatttactgggtgcgacaggcacctggacgtggtcttgaatggataggctggatcaagctggtctccggggccgtgaactttggatctgttgatttcagagacagggtgtcgttgacacgggatcgcgacttatttactgcgcacatggatattagaggcctgacgcaggacgataccgctacatatttctgtgccaggcaaaaatttgcatcacggtacagcggtgaccaggggagttatttcgatctatggggacgcggcactctcatcattgtctcctctgcc

SEQ ID NO: 25782 - RNA, 375 nt, synthetic construct
  misc_feature 1..375: note = derived and/or modified sequence opt3 from anti-HIV-1_HeavyChain
  source 1..375: mol_type = other RNA
caggtgcaactggtccagagcggctccggggttaagaaacccggagcctctgtgagagtatcatgctggaccagtgagggtatcttcgaaaagagcgagctcattcactgggtgaggcaggctcctggccaggggcttgaatggataggatgggtcaaaacagtgactggcgcagttaactttggtcatcaaatctccgaccgggtgtctctgacgcgcgatcgagacttgttcaccgcccacatggatattcgtgggttaacacagggagacactgcgacctacttttgtgctagacagaagttcgagaggggcggccaggggtggatctttgatctgtggggacggggtacactaattgccgtctcgtcagca

SEQ ID NO: 25783 - RNA, 378 nt, synthetic construct
  misc_feature 1..378: note = derived and/or modified sequence opt3 from anti-HIV-1_HeavyChain
  source 1..378: mol_type = other RNA
caggtgcaactggtccagagcggcgccgaggttaagaaacccggggcttccgtgagagtatcttgctggacctcagaagacatcttcgagaagagtgaactcattcactgggtgaggcaggcacctggacagggtcttgagtggataggctgggtcaaaacagtgactggggccgttaactttggaagctccgatttccggcaacgcgtgtctctgacgcgagaccgtgatttgtttaccgcgcatatggacatcagaggcttaacacagggtgatactgctacctacttctgtgccaggcagaagtttgaacgcgggggacagggctggtatttcgacctgtggggccgggggacactaattgtcgtgtcgtcagca

SEQ ID NO: 25784 - RNA, 378 nt, synthetic construct
  misc_feature 1..378: note = derived and/or modified sequence opt3 from anti-HIV-1_HeavyChain
  source 1..378: mol_type = other RNA
caggtgcaactggtccagagcggcgccgaggttaagagacccggggcttccgtgaaagtatcttgctggacctcagaagacatcttcgagaggacagaactcattcactgggtgcggcaggcacctggacagggtcttgagtggataggctgggtcaagactgtgagtggggccgttaactttggaagcccaaatttccgccatcgagtgtccctgacgcgtgatagagacttgtttaccgcgcacatggatatcaggggcttaacacaaggtgacactgctacctacttctgtgcccggcagaaatttgaacgcgggggacagggctggtatttcgatctgtggggcagagggacactaattgtcgtgtcttcggca

SEQ ID NO: 25785 - RNA, 378 nt, synthetic construct
  misc_feature 1..378: note = derived and/or modified sequence opt3 from anti-HIV-1_HeavyChain
  source 1..378: mol_type = other RNA
caggtgcaactggtccagagcggctccggggttaagaaacccggagcctctgtgagagtatcatgctggaccagtgaggacatcttcgaaggtagcgagctcattcactgggtgaggcaggctcctggccaggggcttgaatggataggatgggtcaagacagtgactggcgcagttaactttggttccgcctacttccggcatcgcgtgtctctgacgcgagatcgtgacttgtttaccgcgcacatggatatcagagggttaacacaaggagacactgctacctatttctgtgccaggcagaaatttatgtcgggcggccaggggtggtacttcgatctgtggggacggggtacagtcattgtggtatcaagcgca

SEQ ID NO: 25786 - RNA, 387 nt, synthetic construct
  misc_feature 1..387: note = derived and/or modified sequence opt3 from anti-HIV-1_HeavyChain
  source 1..387: mol_type = other RNA
caggtgcaactggtccccagcggctccggggttaagaaacctggagcctctgtgagagtatcatgctggaccagtgaggacatcttcgaaaggacagagctcattcactgggtgcggcaggctccaggtcagggccttgaatggatagggtgggtcaagactgtgacgggagcagttaactttggcagcctggatttccgccatcgaatctccttgacccgtgacagagatttatttacagcccacatggacattaggggtctgactcagggggataccgcgacatacttctgtgctcggcaaaaatttgagtctcgctataccggaggccagggctggtacttcgacctatgggggagaggaactcatatcgtggtctcgtcagcc

SEQ ID NO: 25787 - RNA, 378 nt, synthetic construct
  misc_feature 1..378: note = derived and/or modified sequence opt3 from anti-HIV-1_HeavyChain
  source 1..378: mol_type = other RNA
caggtgcaactggtccagagcggctccggggttaagaaagtgggagcctctgtaagagtgtcatgctggaccagtgaggacatcttcgaaaggacagagctcattcactgggtccggcaggctcccggtcagggccttgaatggatagggtgggtgaaggcagttagcggagccgtgaactacggctccctggattttcgccatcgagtctctttgactcgtgacagagatttattcacggcgcacatggacatcaggggtctgacccaagatgacacagctatttatttttgtgcccggcagaaattctacgcagggggacagggctggtattttgatctatggggccgcgggactctcatcgtggtatcgtcagcc

SEQ ID NO: 25788 - RNA, 387 nt, synthetic construct
  misc_feature 1..387: note = derived and/or modified sequence opt3 from anti-HIV-1_HeavyChain
  source 1..387: mol_type = other RNA
caggtgcaactggtccagagcggcgccgaggttaagaaacccgggtcctctgtgagagtatcatgctggaccagtgaagacatcttcgagaggacagaactcattcactgggtgcggcaggctcctggacagggtcttgagtggataggctgggtcaagactgtgacgggggcagttaactttggaagcccaaatttccgccatcgagtgtccctgacccgtgatagagacttgtttacagcccacatggatatcaggggcttaactcaaggtgacaccgcgacatacttctgtgctcggcagaaatttgaatctcgctattcgggggatcagggatcatacttcgacctgtggggcagaggcaccctaattatcgtcagcagtgcc

SEQ ID NO: 25789 - RNA, 375 nt, synthetic construct
  misc_feature 1..375: note = derived and/or modified sequence opt3 from anti-HIV-1_HeavyChain
  source 1..375: mol_type = other RNA
caggtgcaactggtccagagcggcgccgaggttaagaaacccggggcttccgtgaaggtatcttgcaaagcatcaggatacaccttcacaagttattacatgcactgggtgagacaggcccctggtcagggcctcgaatggatcgggtgggtcaagccagtgactggagcggttaactttggcagcccgaatttcaggcatcgggtgtcccttacgcgcgaccgagatctgtttaccgctcacatggacattcgtggtttgacacaaggggatactgccacctatttctgtgcaagacagaaatactatgccggaggccagggctggtactttgacttatgggggaggggaacactgatagtcgtgtcttcggct

SEQ ID NO: 25790 - RNA, 375 nt, synthetic construct
  misc_feature 1..375: note = derived and/or modified sequence opt3 from anti-HIV-1_HeavyChain
  source 1..375: mol_type = other RNA
caggtgcaactggtccagagcggcgccgaggttaagaaacccggggcttccgtgcaggtatcttgcaaggcatcaggataccctttcaccaaatattacatgcactgggtgagacaggccccaggtcaaggcctcgaatggatcgggtgggtcaaggcggtgagtggagctgttaactatggcagccttgactttaggcatcgggtgtccctgacacgcgatcgagacttgtctactgcccacatggatattcgtggtttaacgcaggacgataccgcaacatacttctgtgccagacagaaatttgctaggggagaccaggggtggttctttgatctgtggggccggggcactctaatagtcgtgtcgtcagca

SEQ ID NO: 25791 - RNA, 375 nt, synthetic construct
  misc_feature 1..375: note = derived and/or modified sequence opt3 from anti-HIV-1_HeavyChain
  source 1..375: mol_type = other RNA
caggtgcaactggtccagagcggcgccgaggttaagaaacccggggcttccgtgaaggtatcttgcaaagcatcaggatacaccttcacaggttattacatgcactgggtgagacaggcccctggccaggggctcgaatggatcggatgggtcaagactgtgagtggcgcggttaactttggtagccttaatttcaggcatcgggtgtccctgacgcgcgaccgagatttgtttaccgctcacatggacattcgtgggttaacacaaggagatactgccacctatttctgtgcaagacagaaatttgccaggggcgaccagggctggttctttgatctgtgggggcggggaacactaatagtcgtgtcttcggct

SEQ ID NO: 25792 - RNA, 402 nt, synthetic construct
  misc_feature 1..402: note = derived and/or modified sequence opt3 from anti-HIV-1_HeavyChain
  source 1..402: mol_type = other RNA
caggtgcaactggtccagagcggctccggggttaagaaacccggagcctctgtgagagtatcatgcagggctagtgaggacctcttcggtgatgaaatcatttacgacgatgaggtgatacactggcttcggcaggtccctggccagcgcccagaatggatggggtggatccgaccgaagaccggagcacgtaaccaagccagacagtttcagcccaggattagcctgacacgggaccgcgcgttgtccactgcttatttagatctaaattctctgacgtcggccgactcaggcacctacttctgtgcaagacagacatttaaacctgatttctattttgccgaccaaggttggagcttcaacctctgggggaggggagctcattttatcgtgagttccgca

SEQ ID NO: 25793 - RNA, 381 nt, synthetic construct
  misc_feature 1..381: note = derived and/or modified sequence opt3 from anti-HIV-1_HeavyChain
  source 1..381: mol_type = other RNA
caggtgcaactggtccagagcggcgggggagttaagaaacccggtgcctccgcttctttctcatgcagaaccagtgaggacccttttgataacgaatttttcgacagcgagttcatgcactgggtgaggctcacaccaggccagcggccggaatggatggggtggatgaatccccgctccggaggcgtaaactacgcaggtcagtttcgacctcgtatgtctatgtggagagatagggagctttcgactgcctatatggaactgcgggacttgacgttcgcggataccgggttatacttttgtgctcgcagaaaggaggacgattatgactggtactatgatctgtggggaaggggcgcccatatcattgtgtcagcagcc

SEQ ID NO: 25794 - RNA, 384 nt, synthetic construct
  misc_feature 1..384: note = derived and/or modified sequence opt3 from anti-HIV-1_HeavyChain
  source 1..384: mol_type = other RNA
caggtgcaactggtccaggccggcgggggagttaagaaacccggtgctagcgtgaccctctcctgcaagacagcagacgaggatgtattcgacgccgcgtacatgcactgggtgagacaggctcctggccagacttttgaatggcttgggtggatgaaaccagtcacgggagccgtgaactatgcaaggaagttccaaggccgggtttctttttaccgcacccgagagctgggtatcgcctatatggatttgcgtaatttaagattcgacgatacagctgtgtacttttgtgcaaggaaaactgccggggacgtctcaggagataagcggggcttctttttcgacctgtggggccgcgggagtagagtgattgtaagctccgct

SEQ ID NO: 25795 - RNA, 384 nt, synthetic construct
  misc_feature 1..384: note = derived and/or modified sequence opt3 from anti-HIV-1_HeavyChain
  source 1..384: mol_type = other RNA
caggtgcaactggtccagagcggcgccgaggttaagaaacccggggcttccgtgaccctctcttgcaagacagcagacgaagatgtattcgacgccgcgtacatgcactgggtgagacaggctcctggacagacttttgagtggcttggttggatgaaaccagtcacgggcgccgtgtcatatgcaaggaagttccaagggcgggttagtttttacatgacccgcgaactgggaatggcctatatggatttgcgaaacttacgtttcgacgatacagctgtgtacttttgtgcaagaaaaactgccggcgacgtcagcggtgataatagggggtatttctttgacctgtggggacggggctcccgcgtgatcgtatcttcggct

SEQ ID NO: 25796 - RNA, 384 nt, synthetic construct
  misc_feature 1..384: note = derived and/or modified sequence opt3 from anti-HIV-1_HeavyChain
  source 1..384: mol_type = other RNA
caggtgcaactggtccagagcgaggccgaagttaagaaacccggcgcttccatgaccgtgtcttgcgagacagcagacgaagatatcttcgacgccgcgtacatgcactgggtaagacaggctcctgggcagacttttgagtggctcggatggatgaagccagtgacgggtgccgtcaactatgcaaggaaattccaaggccggatttcattttaccgcacccgagaacttgccatagcttatatggatctgcgtgacttgagattcgatgacacagcagtgtacttttgtgccaggaagactgctggggatgttagtggagacaatcggggctatttctttgatttatggggtcgcgggagcagagtgatcgtctcctctgcc

SEQ ID NO: 25797 - RNA, 420 nt, synthetic construct
  misc_feature 1..420: note = derived and/or modified sequence opt3 from anti-HIV-1_HeavyChain
  source 1..420: mol_type = other RNA
cagagccacctggagcaatccggctctgccatgaagaaacccggggcttcagtgagagtcagttgctggaccagcgaagacatcttcgatacaactgagctcctttgggttaggcaggcacctggacagggtctggaatggattggctgggtgaagatagtatccgggacggtgaactttgcctctttggacttccggaatcgcatctcgttatcacgagatcgtgacctgagcaccgcgcatatggatattagaggactaacacaggacgatactgctacctactattgtgccaggcaaaaatttgcaagtcggtactccggcgaccagggttcttatttcgatctctgggggcgcggaacactgatcattgtcagctccgcctcaaccaagggcccaagtgtgtttccgcacgacctt

SEQ ID NO: 25798 - RNA, 417 nt, synthetic construct
  misc_feature 1..417: note = derived and/or modified sequence opt3 from anti-HIV-1_HeavyChain
  source 1..417: mol_type = other RNA
cagagccacctggagcaatccggctctgccatgaagaaacccggggcttcagtgagagtcagttgctggaccagcgaagacatcttcgagaggacagaactcatttactgggttcggcaggcacctggacgcggtcttgagtggataggctgggtgaagactgtatccgggacggtgaactttggatcttcggatttccgaaatcgtatctcactgaccagagacagggatttgtttacagcccatatggacattcggggcttaactcagggtgataccgcgacatatttctgtgctcgccagaaatttgaaagagggggacaaggctggtacttcgacctgtggggcagggggaccctaatcgtcgtgagcagtgcctccactaacggaccaattggtctcccgccccggtctgca

SEQ ID NO: 25799 - RNA, 423 nt, synthetic construct
  misc_feature 1..423: note = derived and/or modified sequence opt3 from anti-HIV-1_HeavyChain
  source 1..423: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagtttgaatcactgtatagcgacgatcagggaagttacttcgacctatggggccggggcacactcattatcgtttcctctgcaagcaccaaagggccatcctcaagtccgactatttgc

SEQ ID NO: 25800 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgagcggagccgtcaactttggctccccaaatttccgccaccgagtgtctctgacgcgtgatagagacttgtttaccgcgcatatggatatcaggggtttaacacagggggacactgctacctacttctgtgcccggcaaaaatttgaacgcggaggccagggctggtatttcgatctgtgggggagaggaacactaattgttgtgtcgtcagcaagcaccaagggtccgagtgtctttccccacgacctcagg

SEQ ID NO: 25801 - RNA, 411 nt, synthetic construct
  misc_feature 1..411: note = derived and/or modified sequence opt3 from anti-HIV-1_HeavyChain
  source 1..411: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgagcggagccgtcaactttggctccccaaatttccgccaccgagtgtctctgacgcgtgatagagacttgtttaccgcgcatatggatatcaggggtttaacacagggggacactgctacctacttctgtgcccggcaaaaatttgaacgcggaggccagggctggtatttcgatctgtgggggagaggaacactaattgttgtgtcgtcaagcctccaccagggtccgagtggcctgccccatgac

SEQ ID NO: 25802 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagttttatgcaggaggccagggctggtacttcgacctgtgggggcggggaacactaattgttgtgtcaagcgccagtaccaaaggtccatccgtctttccgcatgatctccgc

SEQ ID NO: 25803 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgagcggagccgtcaactttggctccccaaatttccgccaccgagtgtctctgacgcgtgatagagacttgtttaccgcgcatatggatatcaggggtttaacacagggggacactgctacctactattgtgcccggcaaaaattcgaatcgctgtactcagatgaccagggaagctattttgatctatggggccgcggcacactcattatcgttagttccgcatctaccaaggggccgagcgtgttcccccacgacctgaga

SEQ ID NO: 25804 - RNA, 384 nt, synthetic construct
  misc_feature 1..384: note = derived and/or modified sequence opt3 from anti-HIV-1_HeavyChain
  source 1..384: mol_type = other RNA
caggtgcacctggagcaaagcggctccggggtcaagaaacccggagcctctgttagagtgtcatgctggaccagtgaagacatcttcgaaaagagcgagctcattcattgggtaaggcaggctcctggtcagggccttgagtggatagggtgggtgaaaacagtcactggagcagtgaactttggctcctctgatttccggcagcgcgtttcgctgacgcgagaccgtgatttgtttaccgcccacatggacatcagaggtttaacacaaggggatactgcgacctacttctgtgctaggcagaagtttgaatcacggtatacaggaggccagggctggtacttcgacctgtgggggcgcggaacccatattgtggtcagcagt

SEQ ID NO: 25805 - RNA, 423 nt, synthetic construct
  misc_feature 1..423: note = derived and/or modified sequence opt3 from anti-HIV-1_HeavyChain
  source 1..423: mol_type = other RNA
caggtgtacatggagcaagccggcgctggggtcaagaaacccggagcaagcgttaccctgtcctgcaagacagccgacgaagatgtgttcgacgcggcttatatgcactgggtaagacaggcccctggtcagacttttgagtggctcggctggatgaaaccagtgacgggggcagtcaactacgccaggaagttccagggacgggtgtctttttatcgcacccgagaacttggcatcgcttacatggatctgcgtaatttgagattcgacgatacagcagtttatttttgtgccaggaaaactgctggtgacgtgtcaggggataagcggggattctttttcgacttatggggccgcggcagtagagtcattgtgagctccgcctctaccaaggggccgtcggtatttccccatgatctgagg

SEQ ID NO: 25806 - RNA, 414 nt, synthetic construct
  misc_feature 1..414: note = derived and/or modified sequence opt3 from anti-HIV-1_HeavyChain
  source 1..414: mol_type = other RNA
caggcccacctggagcaaagcggctccggggtgaagaaacccggaacctctgtcagagtttcatgctggacaagtgaagacatcttcgagaggactgaactcattcattgggtgcggcaggctcctggtcagggccttgagtggatagggtgggtaaagacggtgaccggagcagtcaactttggcagcccaaatttccgccaccgagtgtccctgacacgtgatagagacttgtttactgcccatatggatatcaggggtttaacccagggggacacagcgacctacttctgtgctcggcaaaaatttgcccgcggagatcagggctggttctttgacctgtggggcagagggactctaattgttgtgtcttcggcatcaacaaagggaccgagcgtcttccccaccatctgc

SEQ ID NO: 25807 - RNA, 411 nt, synthetic construct
  misc_feature 1..411: note = derived and/or modified sequence opt3 from anti-HIV-1_HeavyChain
  source 1..411: mol_type = other RNA
caggtgcaactggtccagagcggcgccgaggttaagaaacccggggcttccgtgaaggtatcttgcaaagcatcaggatacaccttcacaagttattacatgcactgggtgagacaggcccctggtcagggcctcgaatggatcgggtgggtcaagccagtgactggagcggttaactttggcagcccgaatttcaggcatcgggtgtcccttacgcgcgaccgagatctgtttaccgctcacatggacattcgtggtttgacacaaggggatactgccacctatttctgtgcaagacagaaatactatgccggaggccagggctggtactttgacttatgggggaggggaacactgatagtcgtgtcttcggcttcaaccaagggtcccgtagttttccctactatctgc

SEQ ID NO: 25808 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggagtcaagaaacccggtgctagcgttaccctgtcctgcaagacagcagacgaagatgtgttcgacgccgcgtatatgcactgggtaagacaggctcctggccagacttttgagtggctcgggtggatgaaaccagtgacgggagccgtcaactacgcaaggaagttccagggccgggtgtctttttatcgcacccgagaacttggtatcgcctacatggatctgcgtaatttgagattcgacgatacagctgtttatttttgtgcaaggaaaactgccggggacgtgtcaggagataagcggggcttctttttcgacttatggggccgcgggagtagagtcattgtgagctcc

SEQ ID NO: 25809 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtggatcaagactgtaacgggagccgtgaactttggcagcctggatttccgccaccgaatttccttgacccgtgacagagatttatttacagcgcatatggacatcaggggtctgactcagggggataccgctacatacttctgtgcccggcaaaaatttgaatctcgctataccggaggccagggctggtacttcgacctatgggggagaggaactcacattgtcgtgtcgtca

SEQ ID NO: 25810 - RNA, 420 nt, synthetic construct
  misc_feature 1..420: note = derived and/or modified sequence opt3 from anti-HIV-1_HeavyChain
  source 1..420: mol_type = other RNA
cagagccacctggagcaatccggctctgccatgaagaaacccggggcttcagtgagagtcagttgctggaccagcgaagacatcttcgagaggacagaactcatttactgggttcggcaggcacctggacgcggtcttgagtggataggctgggtgaagactgtatccgggacggtgaactttggatcttcggatttccgaaatcgtatctcactgaccagagacagggatttgagcacagcccatatggacattcggggcttaactcaggatgacaccgcgacatatttttgtgctcgccagaaattcgaaagaggtgggcaaggatggtactttgatctgtggggcaggggcaccctaatcgtcgtgagttccgcctctactgaggggccaagccggtccttcccgcagattctccgc

SEQ ID NO: 25811 - RNA, 414 nt, synthetic construct
  misc_feature 1..414: note = derived and/or modified sequence opt3 from anti-HIV-1_HeavyChain
  source 1..414: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagttttatgcaggaggccagggctggtacttcgacctgtgggggcggggaacactaatttgcgtttcaagcgccagtccacgcgctcatagatcctctccgaggagcgca

SEQ ID NO: 25812 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgtcaactttggctccctggatttccgccaccgaatctctttgacgcgtgacagagatttatttaccgcgcatatggacattaggggtctgacacgcggggatactgctacctactattgtgcccggcagaaattcgaatcgagatacacaggaggccaaggctggtattttgacctatgggggaggggaacccacatcgtggtttcaagc

SEQ ID NO: 25813 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgtcaactttggctccctggatttccgccaccgaatctctttgacgcgtgacagagatttatttaccgcgcatatggacattaggggtctgacacagggggatactgctacctacttctgtgcccggcaaaaatttgaatcgcgctatacaggaggccagggctggtacttcgacctatgggggagaggaacccacatcattgtgtcaagc

SEQ ID NO: 25814 - RNA, 423 nt, synthetic construct
  misc_feature 1..423: note = derived and/or modified sequence opt3 from anti-HIV-1_HeavyChain
  source 1..423: mol_type = other RNA
cagagccacctggagcaatccggctctgccatgaagaaacccggggcttcagtgagagtcagttgctggaccagcgaagacatcttcgatacaacttccatttttataggatgtgacaggcctctcgataaggactggtctggtcttggcgggtcgaaactgtcattggcaccaagcatcttcgccagtttagattttcggaaccgcatttccctgtctcgagaccgtgatctaagcacggcgtacatggacatcagaggactcacccaggatgacacagctacttatttctgcgccaggcagaagtttgcatcccggtactcaggcgatcagggtagttatttcgacctgtgggggcgcggaacccttattgttgtgagctctgcctccacaaaaggcccgtcagtatttccccatgatctg

SEQ ID NO: 25815 - RNA, 399 nt, synthetic construct
  misc_feature 1..399: note = derived and/or modified sequence opt3 from anti-HIV-1_HeavyChain
  source 1..399: mol_type = other RNA
agagagtacctggaacagagcggcgggggagtgaagaaactcggtgcctccgtcagggtttcttgccgggcttcagaggaccttttcggcgatgaagtgatctatgacgatgagctgattcactggttgcgccaagtacccgggcagcgacctgaatggatgggatggatacgtccaaagaccggcgcaagaaaccaggccaggcagtttcaaccgcggatcaatttaagtcgcgacagagcgctgaacacagcttacctagatctcagctccctgacttctgccgactcggcaacgtatttctgtgccaggcagacctttaaacccgatttctactttgctgaccagggttggtcattcaatctttgggggcggggagcacgcgtgattgtcagcagt

SEQ ID NO: 25816 - RNA, 384 nt, synthetic construct
  misc_feature 1..384: note = derived and/or modified sequence opt3 from anti-HIV-1_HeavyChain
  source 1..384: mol_type = other RNA
caggtgcacctggtccaaagcggcgccgaggttaagaaacccgggtcctctgtgagagtatcatgctggaccagtgaagacatcttcgagaggacagaactcattcattgggtgcggcaggctcctggacagggtcttgagtggataggctgggtcaagactgtgacgggggcagttaactttggaagcccaaatttccgccaccgagtgtccctgacccgtgatagagacttgtttacagcccatatggatatcaggggcttaactcagggtgacaccgcgacatacttctgtgctcggcaaaaatttgaatctcgctattcgggggatcagggatcatacttcgacctgtggggcagaggcaccctaattatcgtcagcagt

SEQ ID NO: 25817 - RNA, 414 nt, synthetic construct
  misc_feature 1..414: note = derived and/or modified sequence opt3 from anti-HIV-1_HeavyChain
  source 1..414: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagatcgtgagcggagccgtcaactttggctccccaaatttccgccagcgagtgtctctgactcgtgatagagacttgtttacggcgcacatggatattaggggtttaacccaaggggacacagctacttacttctgtgcccggcagaaatttgaacgcggaggccagggctggatcttcgatctgtgggggagaggaaccctaattgcagtttcgtcagccagcacaaagggtccgagtgtgtttcccaccatctgc

SEQ ID NO: 25818 - RNA, 441 nt, synthetic construct
  misc_feature 1..441: note = derived and/or modified sequence opt3 from anti-HIV-1_HeavyChain
  source 1..441: mol_type = other RNA
agagagttcctggaacagagcggcgggggagtgaagaaactcggtgcctcccttagggtctcttgccgggcttcagaggacctgtttggcgatgagttcatctacgacgatgaagttattcactggttgcgccaagtgcccgggcagcgacctgaatggatgggatggatacgtccaaagaccggcgcaagaaaccaggccacacagtttcaaccgaggatcagtttaactcgggaccgcgcgctgagcacggcttatctagatctcaattccctgacctctgccgactcgggtacatacttctgtgcaagacagacttttaaacccgatttctattttgccgaccaggggtggtcattcaacctttggggaaggggcgctcattttattgtaagcagtgcatccaccaagggcccttctgtgttcccacacgatagcgcc

SEQ ID NO: 25819 - RNA, 399 nt, synthetic construct
  misc_feature 1..399: note = derived and/or modified sequence opt3 from anti-HIV-1_HeavyChain
  source 1..399: mol_type = other RNA
agagagtacctggaacagagcggcgggggagtgaagaaactcggtgcctcccttagggtctcttgccgggcttcagaggacctgttcggcgatgaaatcatttatgacgatgaggttatacactggttgcgccaagtgcccgggcagcgacctgaatggatgggatggatccgtccaaagaccggcgcaagaaaccaggccaggcagtttcaaccgcggattagtttaacacgcgacagagcgctgagcactgcttacctagatctcaattccctgacgtctgccgactcgggtacctatttctgtgcaaggcagacatttaaacccgatttctactttgccgaccaggggtggtcattcaacctttggggacggggcgctcattttatcgtaagcagt

SEQ ID NO: 25820 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgtcaactttggctccctggatttccgccaccgaatctctttgacgcgtgacagagatttatttaccgcgcatatggacattaggggtctgacacagggggatactgctacctacttctgtgcccggcaaaaatttgaatcgcgctatacaggaggccagggctggtacttcgacctatgggggagaggaacccacatcgtggtttcaagc

SEQ ID NO: 25821 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggagtcaagaaacccggtgctagcgttaccctgtcctgcaagacagcagacgaagatgtgttcgacgccgcgtatatgcactgggtaagacaggctcctggccagacttttgagtggctcgggtggatgaaaccagtgacgggagccgtctcttacgcaaggaagttccagggccgggtgtcattttatatgacccgcgaacttggtatggcctacatggatctgcgaaacttgcgtttcgacgatacagctgtttatttttgtgcaagaaaaactgccggggacgtgagtggagataataggggctacttctttgacttatggggccgggggagccgcgtcatcgtgtcctct

SEQ ID NO: 25822 - RNA, 414 nt, synthetic construct
  misc_feature 1..414: note = derived and/or modified sequence opt3 from anti-HIV-1_HeavyChain
  source 1..414: mol_type = other RNA
caggcccacctggagcaaagcggcaccggggtgaagaaacccggagcttccgtcagagtttcttgctggacatcagaagacatcttcgagaagagtgaactcattcattgggtgaggcaggcacctggtcagggccttgagtggatagggtgggtaaaaatcgtgagcggagccgtcaactttggctccccaaatttccggcagcgcgtgtctctgactcgagatcgtgacttgtttacggcgcaaatggatattagaggtttaacccagggggacacagctacttacttctgtgccaggcagaagtttgaacggggaggccagggctggatcttcgatctgtgggggcgcggaaccctaattgcagtttcgtcagccagcacaaaaggtccgagtgtgtttccccacgacctc

SEQ ID NO: 25823 - RNA, 399 nt, synthetic construct
  misc_feature 1..399: note = derived and/or modified sequence opt3 from anti-HIV-1_HeavyChain
  source 1..399: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgtcgacggctcatatggacatcaggggtctaacccaggatgacacagccacttatttctgtgcacggcaaaaatttgcccgcggggatcagggatggttctttgacctctggggcagaggcaccctgattgttgtgtcaagcgctagtacaaaggggccttccgga

SEQ ID NO: 25824 - RNA, 414 nt, synthetic construct
  misc_feature 1..414: note = derived and/or modified sequence opt3 from anti-HIV-1_HeavyChain
  source 1..414: mol_type = other RNA
caggcccacctcgagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccatgatcgtgacttgtttacagcgcacatggatatcagaggtttaactcagggggacaccgctacatacttctgtgccaggcaaaaattttatgcaggaggccagggctggtacttcgatctgtgggggcggggaaccctaatttgcgtttcttcggcctcaactaagggtccgagcggcctgccccctcgcagt

SEQ ID NO: 25825 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgtcgacggctcatatggacatcaggggtctaacccaggatgacacagccacttatttctgtgcacggcaaaaatttgaatcactctacagcgatgaccaggggagttatttcgatctgtggggacgcggcacccttattatcgtttcctctgccagcacaaagggcccttccgtgtttccacacgacctgaga

SEQ ID NO: 25826 - RNA, 414 nt, synthetic construct
  misc_feature 1..414: note = derived and/or modified sequence opt3 from anti-HIV-1_HeavyChain
  source 1..414: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgagcggagccgtcaactttggctccccaaatttccgccaccgagtgtctctgacgcgtgatagagacttgtttaccgcgcatatggatatcaggggtttaacacagggggacactgctacctactattgtgcccggcaaaaattcgaacgcggaggccagggctggtactttgatctgtgggggagaggaacactaattgttgtgtcgtcagcaagcaccaagggtccgagtgtcttccccactatctat

SEQ ID NO: 25827 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgtcaactttggctccctggatttccgccaccgaatctctttgacgcgtgacagagatttatttaccgcgcatatggacattaggggtctgacacagggggatactgctacctactattgtgcccggcaaaaattcgaatcgcgctacacaggaggccagggctggtattttgacctatgggggagaggaacccacatcgtggtttcaagc

SEQ ID NO: 25828 - RNA, 414 nt, synthetic construct
  misc_feature 1..414: note = derived and/or modified sequence opt3 from anti-HIV-1_HeavyChain
  source 1..414: mol_type = other RNA
caggcccacctggagcaaagcggctccggggtgaagaaacccggagcttctgtcagagtttcatgctggaccagtgaagacatcttcgagggtagcgaactcattcattgggtgaggcaggcacctggccaggggcttgagtggataggatgggtaaagacagtgactggcgccgtcaactttggttccgcgtacttccggcaccgcgtgtctctgacgcgagatcgtgacttgtttaccgctcatatggatatcagagggttaacacagggagacactgccacctattactgtgcaaggcaaaaattctataagggcggccaggggtggtactttgatctgtggggacggggtacactaattgttgtgtcgtcagccagcaccaaaggcccaagtgtcttcccgactatctgc

SEQ ID NO: 25829 - RNA, 399 nt, synthetic construct
  misc_feature 1..399: note = derived and/or modified sequence opt3 from anti-HIV-1_HeavyChain
  source 1..399: mol_type = other RNA
agagagtacctggaacagagcggcgggggagtgaagaaacccggtgcctccgtcagggtttcttgccgggcttcagaggacctcttcggcgatgaaatcatttatgacgatgaggtgatacactggcttcgccaagtacctgggcagcgaccagaatggatgggatggatccgtccgaagaacggcggtagaaatcaggcaaggcagtttcaaccccggattagtctgacccgcgacagagccttgaacacagcgtacttagatctgaatagcctaacttccgctgactctgggacgtatttctgtgccaggcagacctttaaacctgatttctactttgcagaccagggatggtcgttcaacctctggggccggggcgcccgcgtgatcgtctcaagc

SEQ ID NO: 25830 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgtcgacggctcatatggacatcaggggtctaacccaggatgacacagccacttatttctgtgcacggcaaaaatttgcccgcggggatcagggatggttctttgacctctggggcagaggcaccctgattgttgtgtcaagc

SEQ ID NO: 25831 - RNA, 420 nt, synthetic construct
  misc_feature 1..420: note = derived and/or modified sequence opt3 from anti-HIV-1_HeavyChain
  source 1..420: mol_type = other RNA
caggtgtacatggagcaagccggcgggggagtcaagaaacccggtgctagcgttaccctgtcctgcaagacagcagacgaagatgtgttcgacgccgcgtatatgcactgggtaagacaggctcctggccagacttttgagtggctcgggtggatgaaaccagtgacgggagccgtctcttacgcaaggaagttccagggccgggtgtcattttatatgacccgcgaacttggtatggcctacatggatctgcgaaacttgcgtttcgacgatacagctgtttatttttgtgcaagaaaaactgccggggacgtgagtggagataataggggctacttctttgacttatggggccgggggagccgcgtcatcgtgtcctctgcttcgaccaagggaccgtcagtattccccacaatttgc

SEQ ID NO: 25832 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagggtagcgaactcattcattgggtgaggcaggcacctggccaggggcttgagtggataggatgggtaaagacagtgactggcgccgtcaactttggttccgcgtacttccggcaccgcgtgtctctgacgcgagatcgtgacttgtttaccgctcatatggatatcagagggttaacacagtcggacactgccacctatttctgtgcaaggcaaaaattttacgccggaggccagggctggtatttcgatctgtgggggcggggaacactaattgttgtgtcaagcgctagtaccaagggtccatccgtctttccgcacgacctccgc

SEQ ID NO: 25833 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgccatgaagaaacccggggcttcagtgagagtcagttgctggaccagcgaagacatcttcgagaggacagaactcatttactgggttcggcaggcacctggacgcggtcttgagtggataggctgggtgaagactgtatccgggacggtgaactttggatcttcggatttccgaaatcgtatctcactgaccagagacagggatttgagcacagcccatatggacattcggggcttaactcaggatgacaccgcgacatatttttgtgctcgccagaaattcgaaagtctgtactccgatgaccaaggttcttattttgatctatgggggagaggaaccctcatcattgtcagctccgcctcaccaaagggcccgagtggcctgccccctaggagcgca

SEQ ID NO: 25834 - RNA, 411 nt, synthetic construct
  misc_feature 1..411: note = derived and/or modified sequence opt3 from anti-HIV-1_HeavyChain
  source 1..411: mol_type = other RNA
caggtgcaactggtccagagcggcgccgaggttaagaaacccggggcttccgtgaaggtatcttgcaaagcatcaggatacaccttcacaacttatggtatcagttgggtgagacaggcccctggccaggggctcgaatggattggatgggtcaagacggtgaccggcgcggttaactttggtcaccaaataagcgacagggtgtcccttacacgggatcgcgacctgttcactgctcatatggatatccgagggttgacccagggagacacagccacctacttttgtgcacgtcagaaattctatgccggcggccaggggtggtactttgatttatggggaagaggtactctgattgtcgtgtcttcggcttcaacaaagggcccaagcgtattcccgcacgacctaagg

SEQ ID NO: 25835 - RNA, 417 nt, synthetic construct
  misc_feature 1..417: note = derived and/or modified sequence opt3 from anti-HIV-1_HeavyChain
  source 1..417: mol_type = other RNA
caggcccaactggagcagagcggctccggggtgaagaaacccggagcttctgtcagagtttcatgctggaccagtgaagacatcttcgagaggacagaactcattcactgggtgcggcaggcacctggtcagggccttgagtggatagggtgggtaaagactgtgacgggagccgtcaactttggcagctccgatttccgccaacgagtgtctctgacccgtgacagagatttgtttacagcgcatatggacatcaggggtttaactcagggggataccgctacatacttctgtgcccggcagaaattttatgcaggaggccagggctggtacttcgacctgtgggggcgcggaaccctaattgttgtgtcgtcagccagcactaagggtccaagtgtctttccgcacgatctcaga

SEQ ID NO: 25836 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtttacagcgcatatggatatcaggggtttaactcagggggacaccgctacatactattgtgcccggcaaaaattcgaacgcggaggccagggctggtactttgatctgtgggggagaggaaccctaattgttgtgtcttcg

SEQ ID NO: 25837 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctactattgtgccaggcagaagttcgaatcacggtacacaggaggccagggctggtattttgacctgtgggggcgcggaacccatattgttgtgagcagt

SEQ ID NO: 25838 - RNA, 414 nt, synthetic construct
  misc_feature 1..414: note = derived and/or modified sequence opt3 from anti-HIV-1_HeavyChain
  source 1..414: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtttacagcgcatatggatatcaggggtttaactcagggggacaccgctacatacttctgtgcccggcaaaaatttgaacgcggaggccagggctggtatttcgatctgtgggggagaggaaccctaattgttgtgtcttcggcatcaactaagggtccgagcgtctttcccacaatctgc

SEQ ID NO: 25839 - RNA, 381 nt, synthetic construct
  misc_feature 1..381: note = derived and/or modified sequence opt3 from anti-HIV-1_HeavyChain
  source 1..381: mol_type = other RNA
caggtgcaactggtccagagcggcgccgaggttcagaagcccggggcttccgtgaccgtatcttgcaaagcatcaggatacacactcatcagttatggtattagctgggtgagacaggcccctggccaagggccagaatggatgggatggataaggccgaagactggcgcgcggaaccaggctcgccagttccagccccgaatctcccttacgcgtgacagagccctgtctaccgcatacttggatttaaattcgctgacatcagccgacagcggtacttatttttgtgctaggcaaaccttcaaacctgatttttacttcgcagaccaggggtggagttttaacctatggggacggggcgcccacttcattgtctcctct

SEQ ID NO: 25840 - RNA, 414 nt, synthetic construct
  misc_feature 1..414: note = derived and/or modified sequence opt3 from anti-HIV-1_HeavyChain
  source 1..414: mol_type = other RNA
caggcccacctggagcaaagcggctccggggtgaagaaacccggagcttctgtcagagtttcatgctggaccagtgaagacatcctcaggaagaaagagcttattcattgggtgcggcaggcacctggtcagggcctggaatggatagggtgggtaaagacagtgactggaacggtcaacttcggcagctccgattttcgccagcgagtgtctttgacccgtgacagagatttattcacagcccacatggacatcaggggtctgactcaaggggataccgcgacatacctatgtgctcggcagaaatttgagcgcggaggccagggctggattttcgacctctgggggagaggaaccctgatcgccgtttcgtcagcaagcactaagggtccaagtgtgtttccgcatgatctt

SEQ ID NO: 25841 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgtcaactttggctccctggatttccgccaccgaatctctttgacgcgtgacagagatttatttaccgcgcatatggacattaggggtctgacacagggggatactgctacctacttctgtgcccggcaaaaatttgaatcgcgctatacaggaggccagggctggtacttcgacctatgggggagaggaacccacatcgtggtttcaagcgcaagtactaatggtccaattggcctcccgcataggtccgcc

SEQ ID NO: 25842 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcggtaagagcgagctcattcattgggtgaggcaggcacctggccaggggcttgaatggataggatgggtaaaaacagtgactggcgccgtcaactttggttcctctgatttccggcagcgcgtgtcgctgacgcgagaccgtgatttgtttaccgcgcacatggacatcagagggttaacacaaggagatactgctacctacttctgtgccaggcagaagtttgagtcactgtatagcgacgatcagggcagttacttcgacctatggggccgggggacactcattatcgtttcctct

SEQ ID NO: 25843 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagatcgtgagcggagccgtcaactttggctccccaaatttccgccagcgagtgtctctgactcgtgatagagacttgtttacggcgcacatggatattaggggtttaacccaaggggacacagctacttacttctgtgcccggcagaaatttgaacgcggaggccagggctggtatttcgatctgtgggggagaggaaccctaatcgttgtgtcgtcagcaagcacaaagggtccgagtggcctcccccatgggtccgcc

SEQ ID NO: 25844 - RNA, 423 nt, synthetic construct
  misc_feature 1..423: note = derived and/or modified sequence opt3 from anti-HIV-1_HeavyChain
  source 1..423: mol_type = other RNA
caggtgcaatacggcagagaggccggggctggaatgaagaaacccggtgcaagcatgaccgtctcctgcaagacagccgacgaagatatcttcgacgcggcttatatgcacagggttcggcaggcccctggccagacttttgagtggctggggtggatgaaaccagtgacgggagcagtaaactacgcccgccagttccaaggccgagtgtctttttatcgtaccagagaactcggtattgcttacatggatcttagggacctgaagttcgatgacacagcagtctatttttgtgcccggaaaactaagggggatgtgtcaggagacgatcgcggcttctttttcgacttgtggggcagagggaccagggttatagtgagtagcgcttccacaaagggaccgtctgtctttcccaccatctac

SEQ ID NO: 25845 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcctggatttccgccaccgaatctccttgacccgtgacagagatttatttacagcgcatatggacattaggggtctgactcagggggataccgctacatacttctgtgcccggcaaaaatttgaatctcgctataccggaggccagggctggtacttcgacctatgggggagaggaactcacatcgtggtttcgtcagcaagcacaaagggtccaagtgtgtttccgcatgatctcagg

SEQ ID NO: 25846 - RNA, 423 nt, synthetic construct
  misc_feature 1..423: note = derived and/or modified sequence opt3 from anti-HIV-1_HeavyChain
  source 1..423: mol_type = other RNA
caggtgcaactggtccagagcgaggccgaactcaagaaacccggcgcttccgtttctgtgtcatgcaaggcaagtgggtacagcttcacctcctatggaatctcttgggtaagacaggtgcctggtcagggccttgagtggattgcctggataaggccaaaaacaggggcgcggaaccaagctcgccagtttcagccgcgaatctcgctgactcgtgacagagccttgtcaacggcatacttagatctgaatagcctaaccagtgccgactccggaacatatttctgtgctaggcagacttttaagcccgatttctactttgcagaccaaggctggtctttcaacctctggggtcgcggggcccactttattgtcagctccgcttcaaccaaaggacctagtgtgttcccacatgatctgcgg

SEQ ID NO: 25847 - RNA, 414 nt, synthetic construct
  misc_feature 1..414: note = derived and/or modified sequence opt3 from anti-HIV-1_HeavyChain
  source 1..414: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtttacagcgcatatggatatcaggggtttaactcagggggacaccgctacatactattgtgcccggcaaaaattcgaacgcggaggccagggctggtactttgatctgtgggggagaggaaccctaattgttgtgtcttcggcatcaactaagggtccgagcgtcttcccccacgacctc

SEQ ID NO: 25848 - RNA, 381 nt, synthetic construct
  misc_feature 1..381: note = derived and/or modified sequence opt3 from anti-HIV-1_HeavyChain
  source 1..381: mol_type = other RNA
caggtgcaactggtccagagcggcgccgaggttcagaagcccggggcttccgtgaccgtatcttgcaaagcatcaggatacacactcatcagttatggtattagctgggtgagacaggcccctggccaagggccagaatggatgggatggataaggccgaagactggcgcgcggaaccaggctcgccagttccagccccgaatctcccttacgcgtgacagagccctgtctaccgcatacttggatttaaattcgctgacatcagccgacagcggtacttattactgtgctaggcaaacctttaaacctgatttctattttgcagaccaggggtggagtttcaacctatggggacggggcgcccactttattgtctcctct

SEQ ID NO: 25849 - RNA, 414 nt, synthetic construct
  misc_feature 1..414: note = derived and/or modified sequence opt3 from anti-HIV-1_HeavyChain
  source 1..414: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgttcacggctcatatggacatcaggggtctaacccaggatgacacagccacttatttttgtgcacggcaaaaattcgcccgcggggatcagggatggtttttcgacctctggggcagaggcaccctgattgttgtgtcgtcagctagcacaaaggggcctagtgtctttccacagatctgc

SEQ ID NO: 25850 - RNA, 378 nt, synthetic construct
  misc_feature 1..378: note = derived and/or modified sequence opt3 from anti-HIV-1_HeavyChain
  source 1..378: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtttacagcgcatatggatatcaggggtttaactcagggggacaccgctacatacttctgtgcccggcaaaaatttgaacgcggaggccagggctggtatttcgatctgtgggggagaggaaccctaatttgcgtttcttcggca

SEQ ID NO: 25851 - RNA, 438 nt, synthetic construct
  misc_feature 1..438: note = derived and/or modified sequence opt3 from anti-HIV-1_HeavyChain
  source 1..438: mol_type = other RNA
cagggctacctggcccaaagcgggggaggtgtgaagaaacccggcacctccgcttctttctcatgcagaacaagtgacgatatctatgacaacgagtttttcgatagcgcatttatgcactgggtcaggctcattcctgggcagcggccagaatggatgggatggatgaatccgcgctccggcgccgttaactacgcgcgacagcttcagccccgtgtgtctatgtatagagacagggatctgtcgactgcttacttggacttaaattcactgacgagcgccgatagtggtacctatttctgtgcacggcaaacatttaagcctgacttctactttgccgatcaggggtggtccttcaacctatggggacgcggcgctcattttatagtatctagcgcatccactaaaggcccatcagtgctcccccacgacctgaga

SEQ ID NO: 25852 - RNA, 414 nt, synthetic construct
  misc_feature 1..414: note = derived and/or modified sequence opt3 from anti-HIV-1_HeavyChain
  source 1..414: mol_type = other RNA
caggcccacctggagcaaagcggctccggggtgaagaaacccggagcttctgtcagagtttcatgctggaccagtgaagacatcttcgagaggacagaactcactcattgggtgcggcaggcacctggtcagggccttgagtggattgggtgggtaaagatagtgagcggagccgtcaactttggctccccaaatttccgccagcgagtgtctctgacgcgtgatagagacttgtttaccgcgcacatggatatcaggggtttaacacaaggggacactgctacctacttctgtgcccggcagaaatttgaacgcggaggccagggctggattttcgatctgtgggggagaggaacactaatcgcagtttcgtcagccagcaccaagggtccgagtgtgtttcccaggtccgct

SEQ ID NO: 25853 - RNA, 414 nt, synthetic construct
  misc_feature 1..414: note = derived and/or modified sequence opt3 from anti-HIV-1_HeavyChain
  source 1..414: mol_type = other RNA
caggcccacctggagcaaagcggctccggggtgaagaaacccggagcttctgtcagagtttcatgctggaccagtgaagacatcttcgagaagaaagaactcattcattgggtgaggcaggcacctggtcagggccttgagtggatagggtgggtaaagacagtgactggagccgtcaactttggcagctccgatttccggcagcgcgtgtctctgacgcgagaccgtgatttgtttaccgcgcacatggacatcagaggtttaacacaaggggatactgctacctacttctgtgccaggcagaaattttatgcaggaggccagggctggtacttcgacctgtgggggcggggaacactaattgttgtgtcgtcagccagcaccaagggtccaagtgtctttccgcatgatctc

SEQ ID NO: 25854 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctccctggatttccggcaccgcatctctttgacgcgagaccgtgatttatttaccgcgcatatggacattagaggtctgacacagggggatactgctacctactattgtgccaggcaaaagttcgaatcgcggtacacaggaggccagggctggtattttgacctatgggggcgcggaacccacatcgtggtttcaagc

SEQ ID NO: 25855 - RNA, 414 nt, synthetic construct
  misc_feature 1..414: note = derived and/or modified sequence opt3 from anti-HIV-1_HeavyChain
  source 1..414: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctactattgtgccaggcagaagttctacgcaggaggccagggctggtattttgacctgtgggggcggggaacactaattgttgtgtcaagcgccagtaccaaaggtccatccgtcttcccgactatctgc

SEQ ID NO: 25856 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgtcgacggctcatatggacatcaggggtctaacccaggatgacacagccacttatttctgtgcacggcaaaaatttgaatcactctacagcgatgaccaggggagttatttcgatctgtggggacgcggcacccttattatcgtttcctct

SEQ ID NO: 25857 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggaccagtgaagacatcttcgagggtagcgaactcattcattgggtgaggcaggcacctggccaggggcttgagtggataggatgggtaaagacagtgactggcgccgtcaactttggttccgcgtacttccggcaccgcgtgtctctgacgcgagatcgtgacttgtttaccgctcatatggatatcagagggttaacacagggagacactgccacctatttctgtgcaaggcaaaaatttgaatcgcggtacacaggcggccaggggtggtatttcgatctgtggggacgcggtacccacattgttgtgtcaagcgccagtactaagggcccatccgtctttccgcatgacctaaga

SEQ ID NO: 25858 - RNA, 408 nt, synthetic construct
  misc_feature 1..408: note = derived and/or modified sequence opt3 from anti-HIV-1_HeavyChain
  source 1..408: mol_type = other RNA
caggtgcaactggtccacagcggcgccgaggttaagaaacccggggcttccatgaaggtgtcttgcaaaacctcaggatacagtttcacaggttattacatgcattgggtaagacaggcacctggccaggggctcgaatggatgggatggatcaacccaagctccaatgacactaactatgcccagaagtttcaaggcagggtgacgatgacccgggatacatctattaatactgcgtacatggagctttcgcgcctgcgatcaggtgacaccgctatatatttctgtgcccgtcagaaattttacgcagggggacagggctggtatttcgatttgtggggcagagggacattaatcgtcgtgagcagtgcctccaccaagggaccgtctgtttttcccactatttgc

SEQ ID NO: 25859 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggagtcaagaaacccggtgctagcgttaccctgtcctgcaagacagcagacgaagatgtgttcgacgccgcgtatatgcactgggtaagacaggctcctggccagacttttgagtggctcgggtggatgaaaccagtgacgggagccgtctcttacgcaaggcggttccagggccgcgtgtcattttatatgacccgagaacttggtatggcctacatggatctgcgtaacttgagattcgacgatacagctgtttatttttgtgcaaggaagactgccggggacgtgagtggagataatcggggctacttctttgacttatggggccgcgggagcagagtcatcgtgtcctct

SEQ ID NO: 25860 - RNA, 414 nt, synthetic construct
  misc_feature 1..414: note = derived and/or modified sequence opt3 from anti-HIV-1_HeavyChain
  source 1..414: mol_type = other RNA
cagggcaccctggagcaaagctggtccgaagtgaagaaactcggggcctctgtcagagtttcatgctggacaagtgaggacatcttcaagactgaacttattcactgggtgaggcaggctcccggacagggtctggagtggataggcgggatgaaagcagtaagcggagccgtgaactacggctccttggattttcggcatcgcgtctctttaacgcctgaccgagatctgtcgaccgcgcacatggacatccgtggtctaacacaggatgacactgctacctatttctgtgccagacaaaagtttgcaaggggagatcaggggtggttctttgacctctggggccggggcacactgattgtggtttcaagcgccagtaccaaagggccatccgtgttcccgcatgatcttcgc

SEQ ID NO: 25861 - RNA, 423 nt, synthetic construct
  misc_feature 1..423: note = derived and/or modified sequence opt3 from anti-HIV-1_HeavyChain
  source 1..423: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttgcgtccctggatttccggaatcgcatctctttgtcgcgagaccgtgatttatcaacggcttacatggacattagaggcctgacccaggatgacacagccacttatttttgtgcaaggcaaaagttcgccagccggtacagtggtgatcaggggtcctattttgacctatggggacgcggcaccctcatctgcgtgtctagcgcttccacaagagcacacaggctgccaccgcggtcagcc

SEQ ID NO: 25862 - RNA, 414 nt, synthetic construct
  misc_feature 1..414: note = derived and/or modified sequence opt3 from anti-HIV-1_HeavyChain
  source 1..414: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtttacagcgcatatggatatcaggggtttaactcagggggacaccgctacatacttctgtgcccggcaaaaatttgcacgcggagatcagggctggttctttgacctgtggggcagagggaccctaattgttgtgtcttcggcctcaccgagggctcaccggagcagtccccgctccgca

SEQ ID NO: 25863 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagttttatgcaggaggccagggctggtacttcgacctgtgggggcggggaacactaattgttgtgtcaagcgccagtaccaaaggtccatccgtctttccgcatgattctgct

SEQ ID NO: 25864 - RNA, 414 nt, synthetic construct
  misc_feature 1..414: note = derived and/or modified sequence opt3 from anti-HIV-1_HeavyChain
  source 1..414: mol_type = other RNA
caggcccacctggtgcaaagcggctccggggtcaagaaacccggagcttctgttagagtgtcatgctggaccagtgaggacatcttcaagagcgaactcattcattgggtaaggcaggcacctggtcagggccttgagtggatagggtgggtgaaaacagtcactggagccgtgaactttggctcctctgatttccggcagcgcgtttcgctgacgcgagaccgtgatttgtttaccgcgcacatggacatcagaggtttaacacaaggggatactgctacctacttctgtgccaggcagaagttttatgcaggaggccagggctggtacttcgacctgtgggggcggggaacactaattgtggtctcaagcgccagtaccaaaggtccatccgtgtttccgcatgatctccgc

SEQ ID NO: 25865 - RNA, 414 nt, synthetic construct
  misc_feature 1..414: note = derived and/or modified sequence opt3 from anti-HIV-1_HeavyChain
  source 1..414: mol_type = other RNA
caggcccaactggagcagagcggctccggggtgaagaaacccggagcttctgtcagagtttcatgctggaccagtgaagacatcttcaagacagagctcattcactgggtgaggcaggcacctggtcagggccttgaatggatagggtgggtaaaaactgtgacgggagccgtcaactttggcagcccaaatttccggcatcgcgtgtccctgacccgagatcgtgacttgtttacagcgcacatggatatcagaggtttaactcaaggggacaccgctacatacttctgtgccaggcagaagtttgagcggggaggccagggctggtatttcgatctgtgggggcgcggaaccctaattgttgtgtcttcggcatcaactaaaggtccgagcgtctttccccatgacctcaga

SEQ ID NO: 25866 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggcagagaagtgaagaaacccggggcttccgtcagggtttcttgctggacctcagaggacatcttcgaaaagagtgagctcattcattgggtgcggcaggcacctggacagggtcttgaatggataggctgggtaaaaacagtgactggggccgtcaactttggaagctccgatttccgccagcgagtgtctctgacgcgtgacagagatttgtttaccgcgcacatggacatcaggggcttaacacaaggtgatactgctacctacttctgtgcccggcagaagttttatgcagggggacagggctggtacttcgacctgtggggccgcgggacactaattgttgtgtcgtcagccagcaccaaaggaccaagtgtctttccgcatgatctcaga

SEQ ID NO: 25867 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgagcggagccgtcaactttggctccccaaatttccgccaccgaatctctctgacgcgtgatagagacttgtttaccgcgcatatggatattaggggtttaacacagggggacactgctacctactattgtgcccggcaaaaattcgaatcgcgctacacaggaggccagggctggtattttgatctgtgggggagaggaacccacatcgtggtttcaagc

SEQ ID NO: 25868 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagggtagcgaactcattcattgggtgaggcaggcacctggccaggggcttgagtggataggatgggtaaagacagtgactggcgccgtcaactttggttccgcgtacttccggcaccgcgtgtctctgacgcgagatcgtgacttgtttaccgctcatatggatatcagagggttaacacagggagacactgccacctattactgtgcaaggcaaaaattctataagggcggccaggggtggtactttgatctgtggggacggggtacactaattgttgtgtcgtca

SEQ ID NO: 25869 - RNA, 381 nt, synthetic construct
  misc_feature 1..381: note = derived and/or modified sequence opt3 from anti-HIV-1_HeavyChain
  source 1..381: mol_type = other RNA
caggtgcaactggtccagagcggcgccgaggttaagaaacccggggcttccgtgaaggtatcttgcaaagcatcaggatacaccttcacagactattacctccactgggtgagacaggcccctggtcagggccttgattgggtcgggtggatcaacccaaatagtggaggcactaactatgcgcaaaagtttcagggtagggtggctatgacgcgggacaccagcctgtcctctgtttacttggatttaaattcgctgacatcagccgacagcgggacttatttctgtgcacgccagacctttaaaccggatttctactttgccgaccagggatggagtttcaacctatggggccgaggcgctcattttattgtgtcctct

SEQ ID NO: 25870 - RNA, 414 nt, synthetic construct
  misc_feature 1..414: note = derived and/or modified sequence opt3 from anti-HIV-1_HeavyChain
  source 1..414: mol_type = other RNA
caggccgacctggagcaaagcggctccggggtgaagaaacccggagcttctgtcagagtttcatgctggaccagtgaagatatcttcgagaggacaaactacgtgcactgggtacggcaggcacctggtcgcggcctcgaatggattgggtggagcaagactgtgacgggagccgtcaattttggctccccaaacttccgacatcgtgtgtctcttaccagagacagggatctgtttacagcgcacatggacatacggggtttgactcagggggataccgctacatatttctgtgcccgccagaaatttgagagaggaggccaaggctggtacttcgacttatgggggaggggaaccctgatcgttgtgtcgtcagcaagcactaagggtccgagtgtctttccccatgatcta

SEQ ID NO: 25871 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggaatgaagaaacccggtgctagcatgaccgtctcctgcaagacagcagacgaagatatcttcgacgccgcgtatatgcactgggttagacaggctcctggccagacttttgagtggctggggtggatgaaaccagtgacgggagccgtaaactacgcaaggcagttccaaggccgggtgtctttttatcgcacccgagaactcggtattgcctacatggatcttcgtgacctgaagttcgatgacacagctgtctatttttgtgcaagaaaaactaagggggatgtgtcaggagacgataggggcttctttttcgacttgtggggccgggggacccgcgttatagtgagtagc

SEQ ID NO: 25872 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaagacatcttcgagaggacagaactcatttactgggttcggcaggcacctggacgcggtcttgagtggataggctgggtgaagactgtatccgggacggtgaactttggatcttcggatttccgaaatcgtatctcactgaccagagacagggatttgagcacagcccatatggacattcggggcttaactcaggatgacaccgcgacatatttttgtgctcgccagaaattcgaaagtctgtactccgatgaccaaggttcttattttgatctatgggggagaggaaccctcatcattgtcagctcc

SEQ ID NO: 25873 - RNA, 414 nt, synthetic construct
  misc_feature 1..414: note = derived and/or modified sequence opt3 from anti-HIV-1_HeavyChain
  source 1..414: mol_type = other RNA
caggcccacctggagcaaagcggctccggggtgaagaaactcggagcttctgtcagagtttcatgctggaccagtgaagacatcttcgagaggacaaaccttattcattgggtgcggcaggcacccggtcagggcctggaatggatagggtgggtaaaggccgtgagcggagcggtcaattacggctccttggattttcgccaccgagtgtctttaactcgtgacagagatctgtcgacggctcatatggacatcaggggtctaacccaggatgacacagccacttatttctgtgcacggcaaaaatttgcccgcggggatcagggatggttctttgacctctggggcagaggcaccctgattgttgtgtcaagcgctagtacaaaggggccttccgtcttcccacacgatctt

SEQ ID NO: 25874 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggagtcaagaaacccggtgctagcgttaccctgtcctgcaagacagcaggcgaagacgtgttcgatgccgcgtatatgcactgggtaagacaggctcctgggcagacttttgagtggctcggatggatgaaaccagtgacgggcgccgtcaactacgcaaggaagttccagggtcgggtgtctttttatcgcacccgagaacttgggatcgcctacatggacctgcgtaatttgagattcgatgacacagctgtttatttttgtgcaaggaaaactgccggagatgtgtcaggcgacaagcggggcttctttttcgatttatgggggcgcggaagtagagtcattgtgagctcc

SEQ ID NO: 25875 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaagacatcttcgagaggacagaactcatttactgggttcggcaggcacctggacgcggtcttgagtggataggctgggtgaagactgtatccgggacggtgaactttggatcttcggatttccgaaatcgtatctcactgaccagagacagggatttgagcacagcccatatggacattcggggcttaactcaggatgacaccgcgacatatttttgtgctcgccagaaattcgaaagtctgtactccgatgaccaaggttcttattttgatctatgggggagaggaaccctcatcactgtcagctcc

SEQ ID NO: 25876 - RNA, 429 nt, synthetic construct
  misc_feature 1..429: note = derived and/or modified sequence opt3 from anti-HIV-1_HeavyChain
  source 1..429: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgtcaactttggctccctggatttccgccaccgaatctctttgacgcgtgacagagatttatttaccgcgcatatggacattaggggtctgacacagggggatactgctacctacttctgtgcccggcaaaaatttgaatcgcgctatacaggaggccagggctggtacttcgacctatgggggagaggaacccacatcgtggtttcaagcgcaagtactaagggtccatccggcctcccgcccacaatttgcagg

SEQ ID NO: 25877 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagtttgcacggggagaccagggctggttctttgatctgtggggccgcgggacactaattgttgtgtcaagcgccagtaccaaaggaccatccgtcttcccgcatgacctcaga

SEQ ID NO: 25878 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggaacctctgtcagagtttcatgctggacaagtgaagacatcttcgagaggactgaactcattcattgggtgcggcaggctcctggtcagggccttgagtggatagggtgggtaaagacggtgaccggagcagtcaactttggcagcccaaatttccgccaccgagtgtccctgacacgtgatagagacttgtttactgcccatatggatatcaggggtttaacccagggggacacagcgacctacttctgtgctcggcaaaaatttgaacgcggaggccagggctggtatttcgatctgtgggggagaggaactctaattgttgtgtcttcggcctcaacaaagggtccgagcgtctttccccacgacctcagg

SEQ ID NO: 25879 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtggtagagatttgtttacagcgcatatggacatcagggggttaactcagggagataccgctacatactattgtgcccggcaaaaattcgaacgcggcggccaggggtggtactttgacctgtggggaagaggtaccctaattgttgtgtcttcggcatcaactaagggcccgagcgtcttcccccacgatctcagg

SEQ ID NO: 25880 - RNA, 411 nt, synthetic construct
  misc_feature 1..411: note = derived and/or modified sequence opt3 from anti-HIV-1_HeavyChain
  source 1..411: mol_type = other RNA
caggcccacctgggcgctaactggagcggggtgaagaaactcggagcatccgtcagagtttcttgctggacctcagaggacatcttcgaaaggacagagcttattcattgggtgcggcaagcccccggtcagggcctggaatggatagggtgggtaaaggcggtgagtggagctgtcaattacggcagcttggattttcgccaccgagtgtccttaactcgtgacagagatctgtctacggcccatatggacatcaggggtctaacccaggatgacacagcaacttatttctgtgcccggcagaaatttgctcgcggggatcaaggatggttctttgacctctggggcagaggcaccctgattgttgtgtcgtcagcaagcacaaaggggcctagtgtcttcccacagatc

SEQ ID NO: 25881 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagttttatgcaggaggccagggctggtacttcgacctgtgggggcggggaacactaattgttgtgtcaagc

SEQ ID NO: 25882 - RNA, 423 nt, synthetic construct
  misc_feature 1..423: note = derived and/or modified sequence opt3 from anti-HIV-1_HeavyChain
  source 1..423: mol_type = other RNA
caggcccaactggagcagagcggcgtgggggtcaagaaacccggagcttccgttagagtgtcttgcctcgcatcagaagacatcttcaagaccgagcttattcactgggtaaggcaggcccctggtcagggcctggaatggatagggtgggtgaaaacagtcactggagcggtgaactttggcagtcaaatcttccggcatcgcattagcttgacgcgagatcgtgacttatttaccgctcacatggatatcagaggtctgacacagggggacactgccacctacttctgtgcaaggcagaagtttgagtcccggtatacaggaggccagggctggtacttcgatctatgggggcgcggaacccatattgttgtgtcttcggcctcaactaaaggtccaagcgtctttccgcacgacctcaga

SEQ ID NO: 25883 - RNA, 411 nt, synthetic construct
  misc_feature 1..411: note = derived and/or modified sequence opt3 from anti-HIV-1_HeavyChain
  source 1..411: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttgcgcaccagatctccgatcgggtgtctctgacgcgcgaccgagatttgttcaccgctcatatggacattcgtggcttaacacaaggtgatactgccacctacttttgtgcaagacagaagttctatgccgggggacagggctggtactttgacctgtggggcagggggacactaatcgttgtgtcgtcagctagcaccaaaggaccaagtgtcttcccgactatttgc

SEQ ID NO: 25884 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggagcgaactcattcattgggtgcggcaggcacctggtcagggccttgagtggatagggtgggtaaagacagtgactggagccgtcaactttggctccccaaatttccgccaccgagtgtctctgacgcgtgatagagacttgtttaccgcgcatatggatatcaggggtttaacacagggggacactgctacctacttctgtgcccggcaaaaatattacgcaggaggccagggctggtattttgatctgtgggggcgcggaacactaatttgcgtttcgtca

SEQ ID NO: 25885 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgagcggagccgtcaactttggctccccaaatttccgccaccgagtgtctctgacgcgtgatagagacttgtttaccgcgcatatggatatcaggggtttaacacagggggacactgctacctacttctgtgcccggcaaaaatttgaacgcggaggccagggctggtatttcgatctgtgggggagaggaacactaattgttgtgtcgtca

SEQ ID NO: 25886 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcgcggcctggagtggatagggtgggtaaaggccgtgagcggagcggtcaactacggctccttggattttcgacaccgtgtgtctttaactagagacagggatctgttcacggctcatatggacatccggggtctaacccaggatgacacagccacttatttttgtgcacgccagaaattcgccagaggggatcaaggatggtttttcgacctctggggcaggggcaccctgattgttgtgtcgtca

SEQ ID NO: 25887 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggagtcaagaaacccggtgctagcgttaccctgtcctgcaagacagcagacgaaggcgtgttcgatgccgcgtatatgcactgggtaagacaggctcctgggcagacttttgagtggctcggatggatgaaaccagtgacgggcgccgtcaactacgcaaggaagttccagggtcgggtgtctttttatcgcacccgagaacttgggatcgcctacatggacctgcgtaatttgagattcgatgacacagctgtttatttttgtgcaaggaaaactgccggagatgtgtcaggcgacaagcggggcttctttttcgatttatgggggcgcggaagtagagtcattgtgagctcc

SEQ ID NO: 25888 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagggtagcgaactcattcattgggtgaggcaggcacctggccaggggcttgagtggataggatgggtaaagacagtgactggcgccgtcaactttggttccgcgtacttccggcaccgcgtgtctctgacgcgagatcgtgacttgtttaccgctcatatggatatcagagggttaacacagggagacactgccacctatttctgtgcaaggcaaaaatactatgccggcggccaggggtggtactttgatctgtggggacggggtacactaattgttgtgtcgtca

SEQ ID NO: 25889 - RNA, 378 nt, synthetic construct
  misc_feature 1..378: note = derived and/or modified sequence opt3 from anti-HIV-1_HeavyChain
  source 1..378: mol_type = other RNA
caggtgtacatggagcaacccggcgtcgaagttaccaagcctggggccagcgtgacactgtcctgcaaaactgctgaggacgtattcgatgcagcctatatgcactgggtgagacaggcgccaggacagacgtttgaatggctcggttggatcaagccggtcaccggcgctgtgaactacgccaggaaattccaggggcgggtttctttttatcgcacacgagagcttggaattgcatacatggacctgcgtaatttgagattcgatgacactgccgtgtatttttgtgctaggaagaccgcaggcgatgtctcaggtgacaaacgggggttctttttcgatttatggggacgcggcagtagagtgatagtaagctcc

SEQ ID NO: 25890 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagtttgaacggggaggccagggctggattttcgacctgtgggggcgcggaacactaatcattgtttcaagc

SEQ ID NO: 25891 - RNA, 384 nt, synthetic construct
  misc_feature 1..384: note = derived and/or modified sequence opt3 from anti-HIV-1_HeavyChain
  source 1..384: mol_type = other RNA
caggcccacctggtgcaaagcggctccgaggtcaagaaacccggggctttcgttagagtgtcttgctggacctcagaagacatctttgaggaaacagagctcattcattgggtaaggcaggcacctggacagggtcttgaatggataggctgggtgaagactgtcacgggggccgtgaacttcggaagtctggattttcggcaccgcatcagcttgacccgagaccgtgatttattcacagcgcatatggacattagaggcctgactcagggtgataccgctacatacttttgtgccaggcaaaaattcgagtcccggtataccgggggacagggctggtactttgacctatggggccgcgggactcacatcgttgtgtcttcg

SEQ ID NO: 25892 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgcaaggcaagtgaagacatcttcgagaggaccgaactcattcattgggtgcggcaggcccctggtcagggccttgagtggatagggtgggtaaaaacagtgactggagcggtcaactttggcagcccaaatttccgccaccgagtgtccctgacgcgtgatagagacttgtttaccgctcatatggatatcaggggtttaacacagggggacactgccacctacttctgtgcacggcaaaagtttgaacgcggaggccagggctggtatttcgatctgtgggggagaggaacactaattgttgtgtcttcg

SEQ ID NO: 25893 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccgaagtgaagaaacccggggcttctgtcagagtttcatgctggaccagtgaggacatcttcgaaaggacagagctcattcattgggtgcggcaggcacctggacagggtcttgaatggataggctgggtaaagactgtgagcggggccgtcaactttggatccccaaatttccgccaccgagtgtctctgacgcgtgatagagacttgtttaccgcgcatatggatatcaggggcttaacacagggtgacactgctacctacttctgtgcccggcaaaaatttgagcgcgggggacagggctggtatttcgatctgtggggcagagggacactaattgttgtgtcgtca

SEQ ID NO: 25894 - RNA, 375 nt, synthetic construct
  misc_feature 1..375: note = derived and/or modified sequence opt3 from anti-HIV-1_HeavyChain
  source 1..375: mol_type = other RNA
caggcccacctggtgcaaagcggctccggggtcaagaaacccggagcttctgttagagtgtcatgctggaccagtgaggacatcttcgaaaagagcgagctcattcattgggtaaggcaggcacctggtcagggccttgaatggatagggtgggtgaaaacagtcactggagccgtgaactttggctcctctgatttccggcagcgcgtttcgctgacgcgagaccgtgatttgtttaccgcgcacatggacatcagaggtttaacacaaggggatactgctacctacttctgtgccaggcagaagttttatgcaggaggccagggctggtacttcgacctgtgggggcggggaacactaattgtggtctcaagc

SEQ ID NO: 25895 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgtcgacggctcatatggacatcaggggtctaacccaggatgacacagccacttatttctgtgcacggcaaaaatttgaacgcgggggacagggctggtacttcgatctctggggcagagggaccctgatttgcgtttcaagc

SEQ ID NO: 25896 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccagagcttctgtcagggtttcatgctggaccagtgaagacatcttcgaaaagagcgagctcattcattgggtgcggcaggcacctggacagggtcttgagtggataggctgggtaaaaacagtgactggggccgtcaactttggatcctctgatttccgccagcgagtgtcgctgacgcgtgacagagatttgtttaccgcgcacatggacatcaggggcttaacacaaggtgatactgctacctacttctgtgcccggcagaagttttatgcagggggacagggctggtacttcgacctgtggggccgcgggacactaattgttgtgtcaagc

SEQ ID NO: 25897 - RNA, 381 nt, synthetic construct
  misc_feature 1..381: note = derived and/or modified sequence opt3 from anti-HIV-1_HeavyChain
  source 1..381: mol_type = other RNA
caggtgcaactggagcaggccggcgctggggtcaagaaacccggacctagcgttaccctctcctgcaagacagcagacgaagatgtgttcgacgccgcgtacatgcactgggtaagacaggctccaggtcagacttttgagtggcttggctggatgaaaccggtgacgggggccgtctcttatgcaaggaagttccaaggacgggtgtcattttacatgacccgcgaactgggcatggcctatatggatttgcgaaacttacgtttcgacgatacagctgtttacttttgtgcaagaaaaactgccggtgacgtgagtggggataataggggatatttctttgacctgtggggccggggcagccgcgtcatcgtgtcctct

SEQ ID NO: 25898 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgagcggagccgtcaactttggctccccaaatttccgccagcgagtgtctctgacgcgtgatagagacttgtttaccgcgcacatggatatcaggggtttaacacaaggggacactgctacctacttctgtgcccggcagaaattttatgcaggaggccagggctggtacttcgatctgtgggggcgcggaacactaattgttgtgtcgtca

SEQ ID NO: 25899 - RNA, 381 nt, synthetic construct
  misc_feature 1..381: note = derived and/or modified sequence opt3 from anti-HIV-1_HeavyChain
  source 1..381: mol_type = other RNA
caggtgttcatggagcaagccggcgctgggatgaagaaacccggagcaagcatgaccgtctcctgcaagacagccgacgaagatgtttttgacgcggcttacatgcactgggtgagacaggcccctggtcagactttcgagtggctgggctggatgaaaccagtaacgggggcagtgaactatgccaggaagtttcagggacgggtctctttctaccgcacccgagaactcggcatcgcttatatggatcttcgtaatctgagatttgacgatacagcagtgtacttctgtgccaggaaaactgctggtgacgtttcaggggataagcggggatttttctttgacttgtggggccgcggcagtagagtgattgtcagctcc

SEQ ID NO: 25900 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagcatcatgctggaccagtgaagacatcttcgagaggacagaactcattcattgggttcggcaggcccctggtcagggccttgagtggatagggtgggtgaagatcgtaagcggagcggtgaactttggctccccaaatttccgccagcgagtctctctgactcgtgatagagacttgtttacggctcacatggatattaggggtttaacccaaggggacacagccacttacttctgtgcacggcagaaatttgaacgcggaggccagggctggatcttcgatctgtgggggagaggaaccctaattgccgtgtcgtca

SEQ ID NO: 25901 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggaatgaagaaacccggtgctagcatgaccgtctcctgcaagacagcagacgaagatatcttcgacgccgcgtatatgcactgggttagacaggctaggggccagacttttgagtggctggggtggatgaaacctgtgacgggagccgtaaactacgcacggcagttccaaggccgcgtgtctttttatcgaacccgtgaactcggtattgcctacatggatcttagagacctgaagttcgatgacacagctgtctatttttgtgcaaggaaaactaagggggatgtgtcaggagacgatcggggcttctttttcgacttgtggggccgcgggaccagagttatagtgagtagc

SEQ ID NO: 25902 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggcgctggggtgaaggaacccggagcatccgtcagagtttcttgctggtcaagtgaggacatcttcgaaaggaccgagctcattcattgggtgcggcaggcccctggtcagggccttgaatggatagggtgggtaaaaacagtgactggagcggtcaactttggcagcctggatttccgccaccgaatctccttgacgcgtgacagagatttactgaccgctcatatggacattaggggtctaacacagggggatactgccacctacttttgtgcacggcaaaagttcgagtctcgctatacaggaggccagggctggtactttgacctctgggggagaggaacccacatcgtggtttcgtca

SEQ ID NO: 25903 - RNA, 384 nt, synthetic construct
  misc_feature 1..384: note = derived and/or modified sequence opt3 from anti-HIV-1_HeavyChain
  source 1..384: mol_type = other RNA
caggtgcaactggtccagagcggctccgccatgaagaaacccggggcttctgttagagtgtcatgctggaccagtgaggacatcttcgaaaggacagagctcatttactgggtacggcaggcacctggacgcggtcttgaatggataggctgggtgaagactgtcagcgggacggtgaactttggatcctctgatttccgaaatcgtatctcgctgaccagagacagggatttgtcaacagcccacatggacattcggggcttaactcaggatgacaccgcgacatatttttgtgctcgccaaaaattcgagagcctgtacagtgatgaccagggttcctattttgatctatgggggagaggaaccctcatcattgtttctagc

SEQ ID NO: 25904 - RNA, 384 nt, synthetic construct
  misc_feature 1..384: note = derived and/or modified sequence opt3 from anti-HIV-1_HeavyChain
  source 1..384: mol_type = other RNA
caggcccacctggtgcaaagcgcttccggcgtcaagagacccggggcatctgttagggtgtcatgctggaccagtgaggacatcttcgaacggacagagctcatttactgggtacgccaggcccctggacagggtcttgaatggataggctgggtgaaaactgtcagcggggcggtgaactttggatcccaggatttccgacatcgtatctctctgacgagagacagggatttgtttaccgctcacatggacattcggggcttaacacaaggtgatactgccacctatttctgtgcacgccagaagtttgagtcgagatacacagggggacagggctggtatttcgacctgtggggcagggggacccatatcgttgtgtcaagc

SEQ ID NO: 25905 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggagtcaagaaacccggtgctagcgttaccctgtcctgcaagacagcagacgaagatgtgttcgacgccgcgtatatgcactgggtaagacaggctcctggccagacttttgagtggctcgggtggatgaaaccagtgacgggagccgtctcttacgcaaggaagttccagggccgggtgtcattttatatgacccgcgaacttggtatggcctacatggatctgcgaaacttgcgtttcgacgatacagctgtttatttttgtgcaagaaaaactgccggggacgtgagtggagataagaggggcttctttttcgacttatggggccgggggagccgcgtcatcgtgtcctct

SEQ ID NO: 25906 - RNA, 372 nt, synthetic construct
  misc_feature 1..372: note = derived and/or modified sequence opt3 from anti-HIV-1_HeavyChain
  source 1..372: mol_type = other RNA
caggcccacctggagcaaagcggctccggggtgaagaaacccggagcttctgtcagagtttcatgctggaccagtgaagacatcttcgagggttacatgattcattgggtgaggcaggcacctggccaggggctcgaatggataggatgggtaaagacagtgactggcgccgtcaactttggtagcgcgtatttccggcaccgcgtgtcccttacgcgagatcgtgacctgtttaccgctcatatggatatcagagggttgacacagggagacactgccacctacttctgtgcaaggcaaaaattttataagggcggccaggggtggtacttcgatttatggggacggggtacactgattgttgtgtcttcg

SEQ ID NO: 25907 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcgcggcctggagtggatagggtgggtaaaggccgtgagcggagcggtcaactacggctccttggattttcgacaccgtgtgtctttaactagagacagggatctgttcacggctcatatggacatccggggtctaacccaggatgacacagccacttatttttgtgcacgccagaaattcgccagaggggatcaaggatggtttttcgacctctggggcaggggcaccctgatttgcgtttcgtca

SEQ ID NO: 25908 - RNA, 375 nt, synthetic construct
  misc_feature 1..375: note = derived and/or modified sequence opt3 from anti-HIV-1_HeavyChain
  source 1..375: mol_type = other RNA
caggcccacctggtgcaaagcggctccggggtcaagaaatctggagcttcagttagagtgagttgctggaccagcgaggacatcttcgaaaagtccgagctcattcattgggtaaggcaggcacccggtcagggccttgaatggatagggtgggtgaaaacagtcactggagccgtgaactttggttcttcggatttccggcagcgcgtttcactgacgcgagaccgtgatttgtttaccgcgcacatggacatcagaggcttaacacaaggggatactgctacctacttctgtgccaggcagaagttttatgcaggaggccagggctggtacttcgacctgtgggggcggggaacactaattgtggtcagcagt

SEQ ID NO: 25909 - RNA, 378 nt, synthetic construct
  misc_feature 1..378: note = derived and/or modified sequence opt3 from anti-HIV-1_HeavyChain
  source 1..378: mol_type = other RNA
caggtgtacatggagagagccggcgctggggtcaagaaacccggagcaagcgttaccctgtcctgcaagacagccgacgaagatgtgttcggtgcgtatatgcactgggtaaggcaagctcctggccagacttttgagtggctcgggtggatgaaaccagtgacgggagccgtctcttacgcacggaagttccagggccgcgtgtcattttatatgacccgagaacttggtatggcctacatggacctgcgtaacttgagattcgatgacacagctgtttatttttgtgcaaggaaaactgccggggatgtgagtggagacaatcggggctacttctttgatttatggggccgcgggagcagagtcatcgtgtcctct

SEQ ID NO: 25910 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagggtagcgaactcattcattgggtgaggcaggcacctggccaggggcttgagtggataggatgggtaaagacagtgactggcgccgtcaactttggttccgcgtacttccggcaccgcgtgtctctgacgcgagatcgtgacttgtttaccgctcatatggatatcagagggttaacacagggagacactgccacctatttctgtgcaaggcaaaaattttacaagggcggccaggggtggtatttcgatctgtggggacggggtacactaattgttgtgtcgtca

SEQ ID NO: 25911 - RNA, 375 nt, synthetic construct
  misc_feature 1..375: note = derived and/or modified sequence opt3 from anti-HIV-1_HeavyChain
  source 1..375: mol_type = other RNA
cagagccacctggagcaatccggctctgccatgaagaaacccggggcttcagtgagagtcagttgctggaccagcgaagacatcttcgagaggacagaactcatttactgggttcggcaggcacctggacgcggtcttgagtggataggctgggtgaagactgtatccgggacggtgaactttggatcttcggatttccgaaatcgtgtctcactgaccagagacagggatttgtttacagcccatatggacatccggggcttaactcaggatgacaccgcgacatatttctgtgctcgccagaaatttgccagaggtgatcaagggtggttctttgacctgtggggaaggggcaccctaattgtggttagcagt

SEQ ID NO: 25912 - RNA, 384 nt, synthetic construct
  misc_feature 1..384: note = derived and/or modified sequence opt3 from anti-HIV-1_HeavyChain
  source 1..384: mol_type = other RNA
caggcccacctggtgcaaagcggctccggggtcaagaaacccggagcttctgttagagtgtcatgctggaccagtgaggacatcttcgaaaggacagagctcattcattgggtacggcaggcacctggtcagggccttgaatggatagggtgggtgaagactgtcgccggagcggtgaactttagctccctggatttccgccaccgaatctctttgacgcgtgacagagatttatttaccgctcatatggacattaggggcctgacacagggtgatactgccacctacttctgtgcacggcaaaaatttgagtcgcgctatacagggggacagggctggtacttcgacctatggggcagagggacccacatcgttgtgtcaagc

SEQ ID NO: 25913 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaatctggagcttcagcaagagtcagttgctggagctccgaagacatcttcgagaggaccgaactcattcattgggttcggcaggcccccggtcagggccttgagtggatagggtgggtgaagacagtaactggagcggtgaactttggctctctggatttccgccaccgaatctcgttgacgcgtgacagagatttatttaccgctcatatggacattaggggtctgacacagggggatactgccacctacttctgtgcacggcaaaaatttgaatcacgctatacaggaggccagggctggtacttcgacctatgggggagaggaacccacatcgtcgtgagcagt

SEQ ID NO: 25914 - RNA, 369 nt, synthetic construct
  misc_feature 1..369: note = derived and/or modified sequence opt3 from anti-HIV-1_HeavyChain
  source 1..369: mol_type = other RNA
ctgctccagcttgtgcaaagcggcgccgaggtcaagaaacccggggcttccgttaaggtgacctgcaaagcatctggatacacattcactggttatatccactgggtaagacaggcccctggccaggggctggaatggattggatgggtgaaggcggtctcaggcgctgtgaactacggtagtttggactttaggcatcgggttagcttaacgcacgatcgcgacctgtccaccgcccatatggatatacgagggctaacacaggacgatactgcaacctatttctgtgcccgtcaaaaatttgctagaggagaccagggctggttctttgatctctggggcagggggacactgatcgtggtctcttcg

SEQ ID NO: 25915 - RNA, 369 nt, synthetic construct
  misc_feature 1..369: note = derived and/or modified sequence opt3 from anti-HIV-1_HeavyChain
  source 1..369: mol_type = other RNA
caggtgcaactggtccagagcggcgccgaggttaagaaacccggggcttccgtgaaggtatcttgcaaagcatcaggatgtaccttcacaggttactatatgcactgggtgagacaggcccctggccaggggctcgaatggatgggatggatcaacccaaatagtggcggtactaactacgcgcaaaagtttcaggggagggtcacgatgacccgggacacaagcatttccactgcttatatggagctttctcgcctgcgatcggatgacaccgccgtgtactattgcgcacgtcagaaattcgccagaggagatcagggctggtttttcgacttgtggggcagggggacattaatagttgtgtcaagc

SEQ ID NO: 25916 - RNA, 369 nt, synthetic construct
  misc_feature 1..369: note = derived and/or modified sequence opt3 from anti-HIV-1_HeavyChain
  source 1..369: mol_type = other RNA
caggtgcaactggtccagagcggcaccgagctcagaaagcccggggcctccgttaaagtgtcttgcaaggcttcaggatacacattcagtggtagctatatccactgggtaaggcaggcacctggccaggggcttgaatgggtgggatggattaacccatcctctggcgccactcaatgtgcgaaaaagtttcaggacaaagtcacgatgacccgggatacaactaataacaccgtgtacatggaggttaatcgcctgatatcggacgatacagctacctatttctgcgcccgacagaagtttgcacgtggtgaccaggggtggttctttgatttgtggggaagaggcactttaatcgtggtctcaagc

SEQ ID NO: 25917 - RNA, 372 nt, synthetic construct
  misc_feature 1..372: note = derived and/or modified sequence opt3 from anti-HIV-1_HeavyChain
  source 1..372: mol_type = other RNA
caggtgctgctcgtccaaagcggcgccgaggttaagaaacccgggtcctctgtgaaggtatcatgcaaaaccagtggagacagccttacaaagtacgctctgcactgggcaagacaggcccctggtcagggcttggaatggatcgggtgggtgaaaactgtcacgggagcggtgaacttcggctcctctgattttaggcagcgggtttcgttaacccgcgaccgagatctgttcacagctcatatggacattcgtggtctaactcaaggggataccgccacatatttttgtgcaagacagaagttctacgccggaggccagggctggtattttgacctctgggggaggggaaccctgatagtggtctcaagc

SEQ ID NO: 25918 - RNA, 372 nt, synthetic construct
  misc_feature 1..372: note = derived and/or modified sequence opt3 from anti-HIV-1_HeavyChain
  source 1..372: mol_type = other RNA
caggtgcaactggtccagagcggcaccgaggttaagacacccggggcctccgtgaaagtatcttgcaaggcttcaggatacactttcacgaactatgacatcaattgggtgagacaggcacctggtcagggcctcgaatggattgggtgggtcaaaaccgtgacaggagccgttaactttggcagtagcgatttcaggcaacgggtgtcccttactcgcgaccgagatctgtttaccgcgcacatggacatacgtggtttgacacagggggataccgctacttacttctgtgccagacagaagttttatgcaggaggccagggctggtacttcgacttatgggggaggggaacactgatcgtcgtgtcttcg

SEQ ID NO: 25919 - RNA, 372 nt, synthetic construct
  misc_feature 1..372: note = derived and/or modified sequence opt3 from anti-HIV-1_HeavyChain
  source 1..372: mol_type = other RNA
caggtgcaactggtccagagcggcgacgaggttaagaaacccggggcctccgtgaaggtatcttgcaaggcttcaggaaaaggtttccctaccagtctcgtgacatgggtcagacaggcaccaggccaggggcttgaatggatcggatgggtgaaagccgttagcggcgcggtgaactacggttccctggattttaggcaccgggtctctttgactcgcgaccgagatttattcacggctcatatggacattcgtgggctgacccaagatgacacagccacttatttttgtgcaagacagaagttcgccaggggagatcagggctggtttttcgacctatggggccgggggaccctcatagtggtatcgtca

SEQ ID NO: 25920 - RNA, 372 nt, synthetic construct
  misc_feature 1..372: note = derived and/or modified sequence opt3 from anti-HIV-1_HeavyChain
  source 1..372: mol_type = other RNA
caggtgcaactggtccagagcggcgccgaggttaagaaacccgggtcctctgtgaaggtatcatgcaaaaccagtggagacatcctcacaaactacggtcttaattgggtgagacaggctcctggccaggggctggaatggattggatgggtcaaggcagtgagcggcgccgttaactatggttccttggatttcaggcaccgggtgtctttaactcgcgaccgagatctgtcgacggcgcatatggacatacgtgggctaacccaagatgacacagctacttacttttgtgccagacagaaattcgcaaggggagatcagggctggtttttcgacctctggggccgggggaccctgatcgtcgtgtcaagc

SEQ ID NO: 25921 - RNA, 372 nt, synthetic construct
  misc_feature 1..372: note = derived and/or modified sequence opt3 from anti-HIV-1_HeavyChain
  source 1..372: mol_type = other RNA
caggtgcaactggtccagagcggcgccgaggttaagaaacccggggcttccgtgagagtatcttgcaagacctcaggataccctttcagtaggtatggtatcagctgggtgcggcaggcaccaggccaggggctcgtctggatggcctgggtgaaagcggtttccggagctgtgaactacggctctcttgactttcgccaccgagtctcgctgacacgtgatagagacttgtcaactgcccatatggatattaggggtttaacgcaagacgataccgcaacatatttctgtgcccggcagaagtttgctcgcggggaccagggatggttctttgatctgtggggcagaggcactctaatagtggtaagcagt

SEQ ID NO: 25922 - RNA, 372 nt, synthetic construct
  misc_feature 1..372: note = derived and/or modified sequence opt3 from anti-HIV-1_HeavyChain
  source 1..372: mol_type = other RNA
agagagcagctggtgcaaagcggcgccgaagtcaagaaacccggggcttccgttaaggtgtcttgcaaaacctcaggaaacacattcggtagttacgactttaattgggtaaggcaggcacctggccaggggctcgagtggatcggatgggtgaagattgtcagcggcgccgtgaacttcggttccccaaattttcggcagcgcgtttctcttactcgagatcgtgacctgttcacggcgcacatggatataagagggttgacccaaggagacacagctacttatttttgtgccaggcagaaattcgaacggggcggccaggggtggatctttgatttatggggacgcggtaccctgattgcagtgtcgtca

SEQ ID NO: 25923 - RNA, 372 nt, synthetic construct
  misc_feature 1..372: note = derived and/or modified sequence opt3 from anti-HIV-1_HeavyChain
  source 1..372: mol_type = other RNA
caggtgcaactggtccagagcggcgccgaggttaagaaacccggggcttccgtgaaggtatcttgcaaagcatcaggatacaccttcacaagttattacatgcactgggtgagacaggcccctggtcagggcctcgaatggatcgggtgggtcaagactgtgacgggagcggttaactttggcagcccaaatttcaggcatcgggtgtcccttacccgcgaccgagatctgtttacagctcacatggacattcgtggtttgactcaaggggataccgccacatatttctgtgcaagacagaaatactatgccggaggccagggctggtactttgacttatgggggaggggaaccctgatagtcgtgtcttcg

SEQ ID NO: 25924 - RNA, 372 nt, synthetic construct
  misc_feature 1..372: note = derived and/or modified sequence opt3 from anti-HIV-1_HeavyChain
  source 1..372: mol_type = other RNA
caggtgcaactggtccagagcggcgccgaggttaagaaacccggggcttccgtgaaggtatcttgcaaagcatcaggatacaccttcacaagttattacatgcactgggtgagacaggcccctggtcagggcctcgaatggatcgggtgggtcaagactgtgacgggaaccgttaactttggcagccttaatttcaggcaacgggtgtccctgacacgcgaccgagatttgtttactgcgcatatggacattcgtggtttaacccagggggatacagctacctatttctgtgccagacagaaatttgagaggggaggccagggctggtacttcgacctgtgggggcggggaactctaatagtcgtgtcttcg

SEQ ID NO: 25925 - RNA, 372 nt, synthetic construct
  misc_feature 1..372: note = derived and/or modified sequence opt3 from anti-HIV-1_HeavyChain
  source 1..372: mol_type = other RNA
caggtgcaactgggccagagcggggccgagatgaagaaacccggatcctctgtcaaggtttcatgcaaagctagtggtggcaccttcagacacagccctatctcctgggtgaggcaggcaccagggcagggactcgaatggattggctgggtaaaggccgtgtctggtgcggtcaactacgggtcgcttgactttcggcatcgcgtgtcactgacacgagatcgtgacttgagcactgctcacatggatataagaggattaacgcaagacgataccgccacatatttctgtgcaaggcagaaatttgcccggggcgaccagggctggttctttgatctgtgggggcgcggaactctaatcgttgtgagttcc

SEQ ID NO: 25926 - RNA, 369 nt, synthetic construct
  misc_feature 1..369: note = derived and/or modified sequence opt3 from anti-HIV-1_HeavyChain
  source 1..369: mol_type = other RNA
caggtgcaactggtccagagcggcgccgaggttagaacccccggggcttccgtgaaggtatcttgcaaagcatcaggatacaacttcatcgcctatcacgtgcattgggtcaggcaggcgcctggtcagggcctcacatggatggggtggattaatccagacagtggagatactgtgtacgctcaaaactttgttgaccgggtgatgatgacgcgcaataccagcatacagacagtctatcttgaactgaacgtgttgactttagaggataccgccacatacttctgtgcacgacagaagtttgcccgtggcgaccagggttggttctttgatctgtgggggagaggaaccctaatcgtagtttcctct

SEQ ID NO: 25927 - RNA, 372 nt, synthetic construct
  misc_feature 1..372: note = derived and/or modified sequence opt3 from anti-HIV-1_HeavyChain
  source 1..372: mol_type = other RNA
caggtgcaactggtccagagcggcgccgaggttaagaaacccggggcttccgtgaaggtatcttgcaaagcatcaggatacaccttcacagtgtattacatgcactgggtcagacaggcccctggtaggggcctcgaatggatcgggtgggtgaaggcggttagtggagctgtgaactatggcagccttgactttcggcatcgcgtctccctgactcgagatcgtgacttgttcacggcccacatggatattagaggtttaacccaggacgatacagcaacttacttttgtgccaggcaaaaattcgctcgcggggaccagggatggtttttcgatctgtggggccggggcaccctaatagtggtatcttcg

SEQ ID NO: 25928 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgttcacggctcatatggacatcaggggtctaacccagggggatacagccacttatttttgtgcacggcaaaaattcgaacgcggaggccagggctggtactttgacctctgggggagaggaaccctgattgttgtgtcgtca

SEQ ID NO: 25929 - RNA, 372 nt, synthetic construct
  misc_feature 1..372: note = derived and/or modified sequence opt3 from anti-HIV-1_HeavyChain
  source 1..372: mol_type = other RNA
caggtgcaactggtccagagcggcgccgaggttaagaaacccggggcttccgtgaaggtatcttgcaaagcatcaggatacaccttcatcggttattacatgcactgggtgagacaggcccctggccaggggctcgaatggatgggatgggtcaagacagtgactggcgcggttaactttggtagtccaaatttcaggcatcgggtgagccttacgcgcgaccgagatctgtttaccgctcacatggacattcgtgggttgacacaaggagatactgccacctatttctgtgcaagacagaaatttgagaggggcggccaggggtggtacttcgacttatggggacggggtacactgatagtcgtgtcctct

SEQ ID NO: 25930 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgagcggagccgtcaactttggctccctgaatttccgccaccgagtgtctttgacgcgtgatagagacttatttaccgcgcatatggatatcaggggtctgacacagggggacactgctacctacttctgtgcccggcaaaaatttgcacgcggagatcagggctggttctttgacctatggggcagagggacactcattgttgtgtcgtca

SEQ ID NO: 25931 - RNA, 372 nt, synthetic construct
  misc_feature 1..372: note = derived and/or modified sequence opt3 from anti-HIV-1_HeavyChain
  source 1..372: mol_type = other RNA
caggcccacctggagcaaagcggctccggggtgaagaaactcggagcttctgtcagagtttcatgctggaccagtgaagacatcttcaaggataggattgaccattgggtgcggcaggcacccggtcagggccttgagtggatagggtgggtaaaagccgtgagcggagcggtcaactacggctccctggattttcgccaccgagtgtctttgacacgtgacagagatttattcactgctcatatggacatcaggggtctgacgcaggatgacaccgccacatatttttgtgcacggcaaaagttcgcccgcggggatcagggatggtttttcgacctatggggcagaggcactctcattgttgtgtcgtca

SEQ ID NO: 25932 - RNA, 375 nt, synthetic construct
  misc_feature 1..375: note = derived and/or modified sequence opt3 from anti-HIV-1_HeavyChain
  source 1..375: mol_type = other RNA
caggtgcaactggcccagagcggcgctgaggtcaagaaactcggggcatccgttagagtgtcttgctggacctcagaagacatcttcgagaggacagaacttattcactgggtacggcaggcccccggacagggtctggagtggataggctgggtgaaggcggtcagtggggctgtgaactacggcagcttggattttcgccatcgagtttccttaactcgtgacagagatctgttcacggcccacatggacatcaggggactaacccaagatgacacagcaatttatttttgtgcccggcagaaattcgctcgcggtgatcaggggtggtttttcgacctctggggaagaggcactctgatcgtggtctcttcg

SEQ ID NO: 25933 - RNA, 372 nt, synthetic construct
  misc_feature 1..372: note = derived and/or modified sequence opt3 from anti-HIV-1_HeavyChain
  source 1..372: mol_type = other RNA
caggcccacctggagcaaagcggctccggggtgaagaaacccggagcttctgtcagagtttcatgctggaccagtgaagacatcagcaaggcagagctcattcattgggtgaggcaggcccctggtcagggccttgaatggatagggtgggtaaaaacagtgtccggagcggtcaacttcggctctccaaattttcggcaccgcgtgtcgctgactcgagatcgtgacttgttcacggctcatatggatatcagaggtttaacccagggggacacagccacttacttttgtgcaaggcaaaagttcgagcggggaggccagggctggtattttgatctgtgggggcgcggaaccctaattgttgtgtcaagc

SEQ ID NO: 25934 - RNA, 372 nt, synthetic construct
  misc_feature 1..372: note = derived and/or modified sequence opt3 from anti-HIV-1_HeavyChain
  source 1..372: mol_type = other RNA
accgcccacctggagcagagcggctccggggtgagaaggcccggagcttctgtccgggtttcatgctggacaagtggtgacatcttcaagagcgaactcattcattgggtgcgccaagcacctggccaggggcttgagtggataggatgggtaaaaactgtgacgggcgccgtcaactttggttcctctgatttccgacagcgtgtgtcgctgaccagagacagggatttgtttacagcgcacatggacatccgggggttaactcagggagataccgctacatacttctgtgcccgccaaaagttttatgcaggcggccaggggtggtacttcgacctgtggggaagaggtaccctaattgttgtgtcaagc

SEQ ID NO: 25935 - RNA, 372 nt, synthetic construct
  misc_feature 1..372: note = derived and/or modified sequence opt3 from anti-HIV-1_HeavyChain
  source 1..372: mol_type = other RNA
caggcccacctggagcaaagcggctccggggtgaagagacccggagcttctgtcagggtttcatgctggaccagtgaagacatcttcaacacagagctcattcattgggtgcggcaggcacctggtcagggccttgaatggatagggtgggtaaaaactgtgagcggagccgtcaattttggctccctgaacttccgccaccgagtgtctttgacgcgtgatagagacttatttaccgcgcatatggatatcaggggtctgacacagggggacactgctacctacttctgtgcccggcaaaagtttgcacgcggagatcagggctggttctttgacctatggggcagagggacactcattgttgtgtcgtca

SEQ ID NO: 25936 - RNA, 372 nt, synthetic construct
  misc_feature 1..372: note = derived and/or modified sequence opt3 from anti-HIV-1_HeavyChain
  source 1..372: mol_type = other RNA
caggcccacctggagcaaagcggctccggggtgaagaaacccggagcttctgtcagagtttcatgctggaccagtgaagacatcttcaagacagagctcattcattgggtgaggcaggcacctggtcagggccttgaatggatagggtgggtaaaagccgtgagcggagcggtcaactacggctccctggattttcggcaccgcgtgtctttgactcgagaccgtgatttatcgacggctcatatggacatcagaggtctgacccaggatgacacagccacttatttctgtgcaaggcaaaagtttgcccgcggggatcagggatggttctttgacctatggggccggggcaccctcattgttgtgtcaagc

SEQ ID NO: 25937 - RNA, 372 nt, synthetic construct
  misc_feature 1..372: note = derived and/or modified sequence opt3 from anti-HIV-1_HeavyChain
  source 1..372: mol_type = other RNA
caggtgcaactggtccagagcggcgccgaggttaagaaacccggggcttccgtgagagtatcttgcaaggcatcaggatacaccttcacagcctattacatccactgggtgaggcaggcgcctggtcagggcctcgaatggattgggtgggtcaaaactgtgagtggagctgttaactttggcagcccaaatttccggcatcgcgtgtcccttacgcgagaccgtgatctgtttaccgcccacatggacataagaggtttgacacaaggggatactgcaacctatttctgtgccaggcagaagtttgagcggggaggccagggctggtacttcgacttatgggggcgcggaacactgatcgtcgtgtcttcg

SEQ ID NO: 25938 - RNA, 372 nt, synthetic construct
  misc_feature 1..372: note = derived and/or modified sequence opt3 from anti-HIV-1_HeavyChain
  source 1..372: mol_type = other RNA
caggcccacctggagcaaagcggctccgaatctaagaaacccggggcttcagtgagagtcagttgctggagctccgaggacatcttcaagaccgaactcattcattgggttaggcaggcacctggacagggtcttgagtggataggctgggtgaaaatcgtatctggggccgtgaactttggatcgccaaatttccggcagcgcgtctcactgacacgagatcgtgacttgtttactgcgcacatggatattagaggcttaacgcaaggtgacaccgctacatacttctgtgccaggcagaagtttgaacgcgggggacagggctggatcttcgatctgtggggccgggggactctaattgcagtgagcagt

SEQ ID NO: 25939 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccgaagtgaagaaacccggggcttctgtcagagtttcatgctggaccagtgaggacatcttcgaaaagagcgagctcattcattgggtgaggcaggcacctggacagggtcttgaatggataggctgggtaaaaacagtgactggggccgtcaactttggatcctctgatttccggcagcgcgtgtcgctgacgcgagaccgtgatttgtttaccgcgcacatggacatcagaggcttaacacaaggtgatactgctacctacttctgtgccaggcagaagttttatgcagggggacagggctggtacttcgacctgtggggccgggggacactaattgttgtgtcaagc

SEQ ID NO: 25940 - RNA, 372 nt, synthetic construct
  misc_feature 1..372: note = derived and/or modified sequence opt3 from anti-HIV-1_HeavyChain
  source 1..372: mol_type = other RNA
caggcccacctggagcaagtgtgggctggcgtcaagaaactcggggcaagcgttagagtgtcctgctggacctctgaagacatcttcaagacagagcttattcattgggtaaggcaggcccccggacagggtctggaatggataggctgggtgaaagcggtctcaggggctgtgaactacggaagtttggattttcggcaccgcgttagcttaactcgagaccgtgatctgtccacggcccatatggacatcagaggcctaacccaggatgacacagcaacttatttctgtgccaggcaaaagtttgctcggggtgatcaggggtggttctttgacctctggggacgcggcaccctgattgtggtctcttcg

SEQ ID NO: 25941 - RNA, 372 nt, synthetic construct
  misc_feature 1..372: note = derived and/or modified sequence opt3 from anti-HIV-1_HeavyChain
  source 1..372: mol_type = other RNA
caggcccacctggagcaaagcggctccggggtgaagaaacccggagcttctgtcagagtttcatgctggaccagtgaagacatcttcgagaggagcgaactcattcattgggtgcggcaggcacctggtcagggccttgagtggatagggtgggtaaagacagtgactggagccgtcaactttggctccaatttccgccagcgagtgtctctgacgcgtgatagagacttgtttaccgcgcacatggatatcaggggtttaacacaaggggacactgctacctacttctgtgcccggcagaaattttatgcaggaggccagggctggtacttcgatctgtgggggcgcggaacactaattgttgtgtcgtca

SEQ ID NO: 25942 - RNA, 375 nt, synthetic construct
  misc_feature 1..375: note = derived and/or modified sequence opt3 from anti-HIV-1_HeavyChain
  source 1..375: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggcatcgcgtctcgttgacccgagatcgtgacttatcaacagcgcacatggatattagaggactgactcaggacgataccgctacatatttttgtgccaggcaaaaattcgcacggggcgaccagggttggtttttcgatctatgggggcgcggaaccctcatcgtggttagcagt

SEQ ID NO: 25943 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggaacctctgtcagagtttcatgctggacaagtgaagacatcttcgagaggactgaactcattcattgggtgcggcaggctcctggtcagggccttgagtggatagggtgggtaaagacggtgaccggagcagtcaactttggcagcccaaatttccgccaccgagtgtccctgacacgtgatagagacttgtttactgcccatatggatatcaggggtttaacccagggggacacagcgacctacttctgtgctcggcaaaaatttgcccgcggagatcagggctggttctttgacctgtggggcagagggactctaattgttgtgtcttcg

SEQ ID NO: 25944 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtggtggcatcttcgaaaggacagagctcattcattgggtgcggcaggcacctgggcagggacttgaatggataggctgggtaaagactgtgacgggtgccgtcaactttgggagcccaaatttccgccaccgagtgtccctgacccgtgacagagatttgtttacagcgcatatggacatcaggggattaactcagggcgataccgctacatacttctgtgcccggcaaaaatttgagcgcggcgggcagggatggtatttcgacctgtggggtagaggcaccctaattgttgtgtcttcg

SEQ ID NO: 25945 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgtcaactttggctccctggatttccgccaccgaatctctttgacgcgtgacagagatttatttaccgcgcatatggacattaggggtctgacacaggatgacactgctacctacttctgtgcccggcaaaaatttgcacgcggggatcagggatggttctttgacctatggggcagaggcacactcatcgtggtttcgtca

SEQ ID NO: 25946 - RNA, 372 nt, synthetic construct
  misc_feature 1..372: note = derived and/or modified sequence opt3 from anti-HIV-1_HeavyChain
  source 1..372: mol_type = other RNA
caggcccacctggagcaaagcggctccggggtgaagaaacccggagcttctgtcagagtttcatgctggaccagtgaagacatcttcaagagcgagctcattcattgggtgaggcaggcacctggtcagggccttgaatggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagtttgagcggggaggccagggctggattttcgacctgtgggggcgcggaacactaatcgcagtttcaagc

SEQ ID NO: 25947 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagagacccggagcttctgtcagggtttcatgctggaccagtgaagacatcttcgagacaactgaactcattcattgggtgcggcaggcacctggtcagggccttgagtggatagggtgggtaaaaacggtgagcggagccgtcaactttggctccctgaatttccgccaccgagtgtctttgacccgtgatagagacttatttacagcgcatatggatatcaggggtctgactcagggggacaccgctacatacttctgtgcccggcaaaagtttgcacgcggagatcagggctggttctttgacctatggggcagagggaccctcattgttgtgtcgtca

SEQ ID NO: 25948 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccagcgagtgtctttaactcgtgacagagatctgttcacggctcacatggacatcaggggtctaacccaaggggatacagccacttatttttgtgcacggcagaaattctacgccggaggccagggctggtattttgacctctgggggcgcggaaccctgattgttgtgtcgtca

SEQ ID NO: 25949 - RNA, 372 nt, synthetic construct
  misc_feature 1..372: note = derived and/or modified sequence opt3 from anti-HIV-1_HeavyChain
  source 1..372: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaacctggtgcaccagatctccgatcgggtttctttgacgcgcgaccgagatttatttaccgcgcatatggacattcgtggcctgacacaaggtgatactgctacctacttctgtgccagacagaagttttatgcagggggacagggctggtacttcgacctatggggcagggggacactcatcgtggtctcgtca

SEQ ID NO: 25950 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgaggtcgtgacttgtttaccgcgcacatggatatcagagggttaacacaaggagacactgctacctacttctgtgccaggcagaagttttatgcaggcggccaggggtggtacttcgatctgtggggacggggtacactaattgttgtgtcaagc

SEQ ID NO: 25951 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggcgctggggtgaagaaacccggagcatccgtcagagtttcttgctggacctcagaagacatcttcgagaggacagaactcattcattgggtgcggcaggcccctggtcagggccttgagtggatagggtgggtaaagactgtgacgggagcggtcaactttggcagtccaaatttccgccaccgagtgagcctgacccgtgatagagacttgtttacagctcatatggatatcaggggtttaactcagggggacaccgccacatacttctgtgcacggcaaaaatttgaacgcggaggccagggctggtatttcgatctgtgggggagaggaaccctaattgttgtgtcctct

SEQ ID NO: 25952 - RNA, 375 nt, synthetic construct
  misc_feature 1..375: note = derived and/or modified sequence opt3 from anti-HIV-1_HeavyChain
  source 1..375: mol_type = other RNA
cagagccacctggagcaatccggctctgccatgaagaaacccggggcttcagtgagagtcagttgctggaccagcgaagacatcttcgatacaactgagctcattcattgggttaggcaggcacctggacagggtcttgaatggataggctgggtgaaggccgtatccggggcggtgaactacggatctctggactttcggcaccgcgtctcgttgacgcgagatcgtgacttatcaaccgctcatatggatatcagaggcctgacacaggacgatactgccacctatttctgtgcaaggcaaaaatttgcccggggtgaccaggggtggttctttgatctatggggacgcggcacactcattgtggttagcagt

SEQ ID NO: 25953 - RNA, 372 nt, synthetic construct
  misc_feature 1..372: note = derived and/or modified sequence opt3 from anti-HIV-1_HeavyChain
  source 1..372: mol_type = other RNA
caggcccacctggagcaaagcggctccggggtgaagaaacccggagcttctgtcagagtttcatgctggaccagtgaagacatcttcaagacagagctcattcattgggtgaggcaggcacctggtcagggccttgaatggatagggtgggtaaaaactgtgagcggagccgtcaactttggctccccaaatttccggcaccgcgtgtctctgacgcgagatcgtgacttgtttaccgcgcatatggatatcagaggtttaacacagggggacactgctacctacttctgtgccaggcaaaagtttgagcggggaggccagggctggtatttcgatctgtgggggcgcggaacactaattgttgtgtcgtca

SEQ ID NO: 25954 - RNA, 375 nt, synthetic construct
  misc_feature 1..375: note = derived and/or modified sequence opt3 from anti-HIV-1_HeavyChain
  source 1..375: mol_type = other RNA
caggtgcacctggagcaaagcggctccggggtcaagaaactcggagcctctgttagagtgtcatgctggaccagtgaagacatcttcgagaggacagaacttattcattgggtacggcaggctcccggtcagggcctggagtggatagggtgggtgaaggcagtcagcggagccgtgaactacggctccttggattttcgccaccgagtttctttaactcgtgacagagatctgttcacggcgcatatggacatcaggggtctaacccaggatgacacagctacttatttttgtgcccggcaaaaattcgcacgcggggatcagggatggtttttcgacctctggggcagaggcaccctgattgtggtctcgtca

SEQ ID NO: 25955 - RNA, 372 nt, synthetic construct
  misc_feature 1..372: note = derived and/or modified sequence opt3 from anti-HIV-1_HeavyChain
  source 1..372: mol_type = other RNA
caggcccacctggagcaaagcgcttccggcgtgaagagacccggggcatctgtcagggtttcatgctggaccagtgaagacatcttcgagcggagcgaactcatttactgggtgcgccaggcccctggacagggtcttgagtggataggctgggtaaaaacagtgtccggggcggtcaacctggctccaaattttcgacagcgtgtgtctttgactagagatagggacttattcacggcccatatggatatccggggactgacccaaggcgacacagcaacttatttttgtgcccgccagaagttcgaaagaggtgggcagggatggatttttgatctatggggcaggggcaccctcatcgctgtttcgtca

SEQ ID NO: 25956 - RNA, 372 nt, synthetic construct
  misc_feature 1..372: note = derived and/or modified sequence opt3 from anti-HIV-1_HeavyChain
  source 1..372: mol_type = other RNA
caggcccacctggagcaaagcggctccggggtgaagaaacccggagcttctgtcagagtttcatgctggaccagtgaagacatcttcaagagcgagctcattcattgggtgaggcaggcacctggtcagggccttgaatggatagggtgggtaaaaacagtgactggagccgtcaactttggctcctctgatttccggcagcgcgtgtcgctgacgcgagacggtgatttgtttaccgcgcacatggacatccgtgggttaacacaaggagatactgctacctacttctgtgccagacagaagttttatgcaggcggccaggggtggtacttcgacctgtggggaaggggtacactaattatcgtttcaagc

SEQ ID NO: 25957 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaacttcggaccgtgatctgtcaacggctcatatggacatcagaggtctaacccaggatgacacagccacttatttctgtgcaaggcaaaaatttgcccgcggggatcagggatggttctttgacctctggggccggggcaccctgattgttgtgagcagt

SEQ ID NO: 25958 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtcaaccgcgcacatggacatcagaggtttaacacaagatgacactgctacctacttttgtgccaggcagaagttcgcacgcggggatcagggatggtttttcgacctgtggggccggggcacactaattgttgtgagcagt

SEQ ID NO: 25959 - RNA, 372 nt, synthetic construct
  misc_feature 1..372: note = derived and/or modified sequence opt3 from anti-HIV-1_HeavyChain
  source 1..372: mol_type = other RNA
caggcccacctggagcaaagcggctccggggtgaagaaacccggagcttctgtcagagtttcatgctggaccagtgaagacatcttcaagagcgagctcattcattgggtgaggcaggcacctggtcagggccttgaatggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagtttgagcggggaggccagggctggtatttcgacctgtgggggcgcggaacactaattgttgtgtcaagc

SEQ ID NO: 25960 - RNA, 372 nt, synthetic construct
  misc_feature 1..372: note = derived and/or modified sequence opt3 from anti-HIV-1_HeavyChain
  source 1..372: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggccaccagatctccgatcgggtgtctctgacgcgcgaccgagatttgttcaccgcgcatatggacattcgtggtttaacacaaggggatactgctacctacttttgtgccagacagaagttctatgcaggaggccagggctggtactttgacctgtgggggaggggaacactaatcgttgtgtcgtca

SEQ ID NO: 25961 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaagatgacactgctacctacttctgtgccaggcagaagtttgcacgcggggatcagggatggttctttgacctgtggggccggggcacactaattgttgtgtcaagc

SEQ ID NO: 25962 - RNA, 372 nt, synthetic construct
  misc_feature 1..372: note = derived and/or modified sequence opt3 from anti-HIV-1_HeavyChain
  source 1..372: mol_type = other RNA
caggcccacctggagcaaagcggctccggggtgaagaaactcggagcttctgtcagagtttcatgctggaccagtgaagacatccttaagacagagctgattcattgggtgaggcaggcacccggtcagggcttggaatggatagggtgggtaaaagccgtgagcggagcggtcaactacggctccttagatttccggcaccgcgtgtctctgactcgagaccgtgatctatttacggctcatatggacatcagaggtctcacccaggatgacacagccacttatttctgtgcaaggcaaaagtttgcccgcggggatcagggatggttctttgacctgtggggccggggcacccttattgttgtgtcgtca

SEQ ID NO: 25963 - RNA, 372 nt, synthetic construct
  misc_feature 1..372: note = derived and/or modified sequence opt3 from anti-HIV-1_HeavyChain
  source 1..372: mol_type = other RNA
gtgagaagcgtcgttcagtgcgaggccggcgtgaagaaacccggggcttccgtaaagatctcttgtgcaacctcaggatacgccttcacactgtattacctccactgggtgaggcaagcgcctggtcagggccttgaatggattgggtgggtcaaaactgtgacgggagctgttaactttggcagtgcctatttccggcatcgcgtgagcctgaccccagaccgagatttgtttacagcacacatggacatacgtggtttaactcagggggataccgccacatacttctgcgctagacagaagttttataaaggaggccaaggctggtacttcgacctgtgggggaggggaaccctaatcgtcgtgtcctct

SEQ ID NO: 25964 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgccttgacagtgaagatatcttcgagaggaccgaactgattcattgggtgcggcaggcacccggtcagggcttggagtggatagggtgggtaaaggccgtgagcggagcggtcaactacggctccttagactttcgccaccgagtgtctctgacacgtgatagagacctattcactgctcatatggatatcaggggtctcacgcaggacgataccgccacatatttttgtgcacggcaaaaattcgcccgcggggaccagggatggtttttcgatctgtggggcagaggcactcttattgttgtgtcgtca

SEQ ID NO: 25965 - RNA, 375 nt, synthetic construct
  misc_feature 1..375: note = derived and/or modified sequence opt3 from anti-HIV-1_HeavyChain
  source 1..375: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgcatatggatatcagaggactgacacaggacgatactgctacctatttttgtgccaggcaaaaattcgcacggggcgaccagggttggtttttcgatctatgggggcgcggaacactcattgtcgtgagttcc

SEQ ID NO: 25966 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcaagtcaagttgctggaccagcgaagacatcttcgagagaacagaacttattcattgggttaggcaggcacccggtcagggcctggagtggatagggtgggtgaaagccgtatccggagcggtgaactacggctctttggattttcggcaccgcgtctcgttaactcgagaccgtgatctgtcaacggctcatatggacatcagaggtctaacccaggatgacacagccacttatttctgtgcaaggcaaaagtttgcccgcggggatcagggatggttctttgacctctggggccggggcaccctgattgtggttagcagt

SEQ ID NO: 25967 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggcgctggggtgaagaaacccggagcatccgtcagagtttcttgctggacctcagaagacatcttcgagaggacagaactcattcattgggtgcggcaggcccctggtcagggccttgagtggatagggtgggtaaagatcgtgagtggagcggtcaactttggcagcccaaatttccgccagcgagtgtccctgactcgtgatagagacttgtttacggctcacatggatattaggggtttaacccaaggggacacagccacttacttctgtgcacggcagaaatttgaacgcggaggccagggctggatcttcgatctgtgggggagaggaaccctaattgccgtttcttcg

SEQ ID NO: 25968 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtggatgaagactgtaacgggagccgtgaactttggcagcccaaatttccgccaccgagtctccctgacccgtgatagagacttgtttacagcgcatatggatatcaggggtttaactcagggggacaccgctacatacttctgtgcccggcaaaaatttgaacgcggaggccagggctggtatttcgatctgtgggggagaggaaccctaattgtggtttcttcg

SEQ ID NO: 25969 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccgaagtgaagaaacccggggcttctgtcagagtttcatgctggaccagtgaggacatcttcgaaaggacagagctcattcattgggtgcggcaggcacctggacagggtcttgaatggataggctgggtaaagactgtgacgggggccgtcaactttggaagcccaaatttccgccaccgagtgtccctgacccgtgatagagacttgtttacagcgcatatggatatcaggggcttaactcagggtgacaccgctacatacttctgtgcccggcaaaaatttgagcgcgggggacagggctggtatttcgatctgtggggcagagggaccctaattgttgtgtcttcg

SEQ ID NO: 25970 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggcgctggggtgaagaaactcggagcatccgtcagagtttcttgctggacctcaggtgacatcttcgaaaggacagagcttattcattgggtgcggcaggcccccggccaggggctggaatggataggatgggtaaaggcggtgagtggcgctgtcaactacggtagcttggattttcgccagcgagtgtccttaactcgtgacagagatctgttcacggcccacatcgacattagggggctaacccaaggagatacagcaacttatttttgtgcccggcagaaattcgagcgcggcggccaggggtggatctttgacctctggggaagaggtaccctgattgctgtttcttcg

SEQ ID NO: 25971 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctgggcaagtgaagacatcttcgagaggaccgaacttattcattgggtgcggcaggcccccggtcagggcctggagtggatagggtgggtaaaggcggtgagcggagctgtcaactacggctccttggattttcgccaccgagtgtctttaacacgtgacagagatctgtcgactgcccatatggacatcaggggtctaacgcaggatgacaccgcaacatatttctgtgcccggcaaaaatttgctcgcggggatcagggatggttctttgacctctggggcagaggcactctgattgttgtgtcaagc

SEQ ID NO: 25972 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggaaccgtcaactttggcagccagaatttccgccaacgagtgtccctgacacgtgatagagacttgtttactgcccacatggatatcaggggtttaacccagggggacacagcgacctacttctgtgctcggcagaaatttgaacgcggaggccagggctggattttcgatctgtgggggagaggaactctaatcgccgtttcttcg

SEQ ID NO: 25973 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagagacccggagcttctgtcagggtttcatgctggaccagtgaagacatcttcgagacaactgaactcattcattgggtgcggcaggcacctggtcagggccttgagtggatagggtgggtaaaaacggtgaccggagccgtcaactttggcagcccaaatttccgccaccgagtgtccctgacacgtgatagagacttgtttactgcgcatatggatatcaggggtttaacccagggggacacagctacctacttctgtgcccggcaaaagtttgaacgcggaggccagggctggtatttcgatctgtgggggagaggaactctaattgttgtgtcttcg

SEQ ID NO: 25974 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcctcaggaaaagcgagcttattcattgggtgcggcaggcacctggtcagggcctggaatggatagggtgggtaaagacagtgactggagccgtcaacttcggctcctctgattttcgccagcgagtgtcgttgacgcgtgacagagatttattcaccgcgcacatggacatcaggggtctgacacaaggggatactgctacctacttttgtgcccggcagaagttctatgcaggaggccagggctggtactttgacctatgggggcgcggaacactcattgttgtgtcaagc

SEQ ID NO: 25975 - RNA, 372 nt, synthetic construct
  misc_feature 1..372: note = derived and/or modified sequence opt3 from anti-HIV-1_HeavyChain
  source 1..372: mol_type = other RNA
caggcccacctggagcaaagcggctccggggtgaagaaacccggagcttctgtcagagtttcatgctggaccagtgaagacatcttcaagacagagctcattcattgggtgaggcaggcacctggtcagggccttgaatggatagggtgggtaaaaactgtgacgggaaccgtcaactttggcagcctgaatttccggcagcgcgtgtccttgacacgagatcgtgacttatttactgcccacatggatatcagaggtctgacccaaggggacacagcgacctacttctgtgctaggcagaagttttatgccggaggccagggctggtacttcgatctatgggggcggggaactctcattgttgtgtcttcg

SEQ ID NO: 25976 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgttcacggctcatatggacatcaggggtctaacccaggatgacacagccacttatttttgtgcacggcaaaaattcgcccgcggggatcagggatggtttttcgacctctggggcagaggcaccctgattgttgtgtcgtca

SEQ ID NO: 25977 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagctccgatttccgccagcgagtgtctctgacccgtgacagagatttgtttacagcgcacatggacatcaggggtttaactcaaggggataccgctacatacttctgtgcccggcagaaattttatgcaggaggccagggctggtacttcgacctgtgggggcgcggaaccctaattgttgtgtcgtca

SEQ ID NO: 25978 - RNA, 375 nt, synthetic construct
  misc_feature 1..375: note = derived and/or modified sequence opt3 from anti-HIV-1_HeavyChain
  source 1..375: mol_type = other RNA
caggtgcaactggtccagagcggcgccgaggttaagaaacccggggcttccgtgagagtatcttgctggacctcagaagacatcttcgagaggagtgaactcatttactgggtgcggcaggcacctggacgcggtcttgagtggataggctggatcaagctggtcagcggggccgtgaactttggatccgttgatttccgagaccgtgtgtctttgacaagagatagggacttatttactgcgcacatggatattcggggcctgacgcaggacgataccgctacatatttctgtgcccgccaaaaatttgcaagaggtgaccaggggtggttctttgatctatggggaaggggcactctcatcgtcgtgtcgtca

SEQ ID NO: 25979 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcagatccggcgtgaagaaacccggggcttctgtcagggtttcatgctggaccagtgaagacatcttcgagcggacagaactcattcattgggtgcgccaggcacctggacagggtcttgagtggataggctgggtaaaggccgtgagcggggcggtcaactttggatccccaaatttccgacaccgtgtgtctctgactagagatagggacttgtcgacggctcatatggatatccggggcttaacccaggacgatacagccacttacttttgtgcacgccaaaaattcgccagaggtgaccaggggtggtttttcgatctgtggggaaggggcaccctaattgttgtgtcaagc

SEQ ID NO: 25980 - RNA, 375 nt, synthetic construct
  misc_feature 1..375: note = derived and/or modified sequence opt3 from anti-HIV-1_HeavyChain
  source 1..375: mol_type = other RNA
cagagctacctggagcaatccggctctgcaatgaagaaacccggggcttcagtgagagtcagttgctggaccagcgaagacatcttcgatacaactgagctcatttattgggttaggcaggcacctggacagggtcttgaatggataggctgggtgaagatcgtatccgggacggtgaactttgcctctctggacttccggaatcgcatttcgttgtcacgagatcgtgacttatttaccgcgcacatggatatcagaggactgacacagggcgacactgctacctacttctgtgccaggcaaaaattttatgccggtgggcagggatggtacttcgatctatggggccggggcacactcattgtcgtgagcagt

SEQ ID NO: 25981 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaagacagaactcattcattgggtgaggcaggcacctggtcagggccttgagtggatagggtgggtaaaagccgtgagcggagcggtcaactacggctccctggattttcggcaccgcgtgtctttgactcgagaccgtgatttattcacggctcatatggacatcagaggtctgacccaggatgacacagccacttatttttgtgcaaggcaaaagttcgcccgcggggatcagggatggtttttcgacctatggggccggggcaccctcattgttgtgtcgtca

SEQ ID NO: 25982 - RNA, 372 nt, synthetic construct
  misc_feature 1..372: note = derived and/or modified sequence opt3 from anti-HIV-1_HeavyChain
  source 1..372: mol_type = other RNA
caggcccacctggagcaaagcggctccggggtgaagaaacccggagcttctgtcagagtttcatgctggaccagtgaagacatcttcaagagcgagctcattcattgggtgaggcaggcacctggtcagggccttgaatggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagttttatgcaggaggccagggctggtacttcgacctgtgggggcggggaacactaattgttgtgtcaagc

SEQ ID NO: 25983 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgagcggagccgtcaactttggctccccaaatttccgccaccgagtgtctctgacgcgtgatagagacttgtttaccgcgcatatggatatcaggggtttaacacaggacgatactgctacctacttctgtgcccggcaaaaatttgcacgcggggaccagggatggttctttgatctgtggggcagaggcacactaattgttgtgtcgtca

SEQ ID NO: 25984 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagatcgtgagcggagccgtcaactttggctccccaaatttccgccagcgagtgtctctgactcgtgatagagacttgtttacggcgcacatggatattaggggtttaacccaaggggacacagctacttacttctgtgcccggcagaaatttgcacgcggagatcagggctggttctttgacctgtggggcagagggaccctaatcgttgtgtcgtca

SEQ ID NO: 25985 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgttcacggctcatatggacatcaggggtctaacccagggggatacagccacttatttttgtgcacggcaaaaattctacgccggaggccagggctggtattttgacctctgggggcgcggaaccctgattgttgtgtcgtca

SEQ ID NO: 25986 - RNA, 375 nt, synthetic construct
  misc_feature 1..375: note = derived and/or modified sequence opt3 from anti-HIV-1_HeavyChain
  source 1..375: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgcatatggatatcagaggactgacacagggcgacactgctacctatttttgtgccaggcaaaaattcgagcggggtgggcagggatggtactttgatctatggggccgcggcacactcattgtcgtgagttcc

SEQ ID NO: 25987 - RNA, 375 nt, synthetic construct
  misc_feature 1..375: note = derived and/or modified sequence opt3 from anti-HIV-1_HeavyChain
  source 1..375: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggcagcgcgtctcgttgacccgagatcgtgacttatttacagcgcatatggatattagaggactgactcaaggcgacaccgctacatatttctgtgccaggcagaaatttgagcggggtgggcagggatggatcttcgatctatggggccgcggcaccctcattgcagtgtcaagc

SEQ ID NO: 25988 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggaaccgtcaactttggcagcctgaatttccgccagcgagtgtccttgacacgtgatagagacttatttactgcccacatggatatcaggggtctgacccaaggggacacagcgacctacttctgtgctcggcagaaatttgaacgcggaggccagggctggattttcgatctatgggggagaggaactctcatcgccgtttcttcg

SEQ ID NO: 25989 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtttacagcgcatatggatatcaggggtttaactcagggggacaccgctacatacttctgtgcccggcaaaaatttgaacgcggaggccagggctggtatttcgatctgtgggggagaggaaccctaattgttgtgtcttcg

SEQ ID NO: 25990 - RNA, 375 nt, synthetic construct
  misc_feature 1..375: note = derived and/or modified sequence opt3 from anti-HIV-1_HeavyChain
  source 1..375: mol_type = other RNA
agacacaccgtggagcagagcggctccggggtcaagaaacccggagcctctgttagggtgtcatgctggacaagtgaagacatcttcgagcggactgaactgattcattgggtacgccaagctcctggtcagggcctcgagtggatagggtgggtgaagacggtcagcggagcagtgaactttggctccccaaatttccgacaccgtgtttctcttaccagagatagggacctgtttacagcccatatggatatccggggtttgactcagggggacaccgcgacatacttctgtgctcgccagaaatttgaaagaggaggccaaggctggtatttcgatttatgggggaggggaaccctgattgtggtctcgtca

SEQ ID NO: 25991 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagtttgaacggggaggccagggctggtatttcgacctgtgggggcgcggaacactaattgttgtgtcaagc

SEQ ID NO: 25992 - RNA, 375 nt, synthetic construct
  misc_feature 1..375: note = derived and/or modified sequence opt3 from anti-HIV-1_HeavyChain
  source 1..375: mol_type = other RNA
agacacacctgggagcagagcggctccggggtgaagaaactgggagcctctgtcagggtttcatgctggacaagtgaagacatcttcgagcggactgaactcattcattgggtgcgccaagctcccggtcagggccttgagtggatagggtggatgaaggcagtaagcggagccgtgaactacggctccctggattttcgacaccgtgtctctttgacgagagacagggatttatcgaccgcgcatatcgacattcggggtctgacacaggatgacactgctacctatttctgtgcccgccagaaatttgcaagaggggatcaaggatggttctttgacctatggggcaggggcacactcatcgtggtttcaagc

SEQ ID NO: 25993 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaagactgtgacgggagccgtcaactttggcagccctaatttccgccaccgagtgtccttgacccgtgatagagacttatttacagcgcatatggatatcaggggtctgactcagggggacaccgctacatacttctgtgcccggcaaaaatttgaacgcggaggccagggctggtatttcgatctatgggggagaggaaccctcattgttgtgtcttcg

SEQ ID NO: 25994 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtttacagcgcatatggatatcaggggtttaactcagggggacaccgctacatacttctgtgcccggcaaaaatttgaacgcggaggccagggctggattttcgatctgtgggggagaggaaccctaatcgcagtttcttcg

SEQ ID NO: 25995 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcaccgcgtgtcgctgacgcgagaccgtgatttgtttaccgcgcatatggacatcagaggtttaacacagggggatactgctacctacttctgtgccaggcaaaagtattacgcaggaggccagggctggtattttgacctgtgggggcggggaacactaattgttgtgtcaagc

SEQ ID NO: 25996 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatgggtatcagagggttaacacaaggagacactgctacctacttctgtgccaggcagaagttttatgcaggcggccaggggtggtacttcgatctgtggggacggggtacactaattgttgtgtcaagc

SEQ ID NO: 25997 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtttctgacgcgagaccgtgatttgttcaccgcgcacatggacatcagaggtttaacacaaggggatactgctacctacttttgtgccaggcagaagttctatgcaggaggccagggctggtactttgacctgtgggggcggggaacactaattgttgtgtcgtca

SEQ ID NO: 25998 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaaggccgtgagcggagcggtcaactacggctccctggattttcgccaccgagtgtctttgactcgtgacagagatttatcgacggctcatatggacatcaggggtctgacccaggatgacacagccacttatttctgtgcacggcaaaaatttgcccgcggggatcagggatggttctttgacctatggggcagaggcaccctcattgttgtgtcaagc

SEQ ID NO: 25999 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcccaggatttccgggaccgcttttctctgacgcgagatcgtgacttgttcaccgcgcacatggatatcagaggtttaacacaaggggacactgctacctacttttgtgccaggcagaagttctatgcaggaggccagggctggtactttgatctgtgggggcggggaacactaattgtggtttcgtca

SEQ ID NO: 26000 - RNA, 375 nt, synthetic construct
  misc_feature 1..375: note = derived and/or modified sequence opt3 from anti-HIV-1_HeavyChain
  source 1..375: mol_type = other RNA
cagagccacctggagcaatccggctctgccatgaagaaacccggggcttcagtgagagtcagttgctggaccagcgaagacatcttcgatgcaacaggactcatttactgggttaggcaggcccctggtcagggccttgagtggatagggtgggtgaagatcgtatccggaactgtgaactttgcgtctctggacttccggcagcgcgtctcgttgacgcgagatcgtgacttatttaccgctcatatggatattagaggcctgacacaaggtgacactgccacctatttctgtgcaaggcagaaattttacgccgggggacagggctggtatttcgatctatggggccgggggacactcatcgtggtttcaagc

SEQ ID NO: 26001 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgtcgacggcttatatggacatcaggggtctaacccaggatgacacagccacttacttctgtgcacggcaaaaatttgcccgcggggatcagggatggttctttgacctctggggcagaggcaccctgattgttgtgtcaagc

SEQ ID NO: 26002 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgttcacggctcatatggacatcaggggtctaacccaggatgacacagccatttatctctgtgcacggcaaaaatttgcccgcggggatcagggatggttctttgacctgtggggcagaggcactcttatcgttgtgtcgtca

SEQ ID NO: 26003 - RNA, 375 nt, synthetic construct
  misc_feature 1..375: note = derived and/or modified sequence opt3 from anti-HIV-1_HeavyChain
  source 1..375: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgcatatggatatcagaggactgacacagggcgacactgctacctatttttgtgccaggcaaaaattcgagcggggtgggcagggatggatttttgatctatggggccgcggcacactcatcgcagtcagttcc

SEQ ID NO: 26004 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctccccaaatttccggcaccgcgtgtctctgacgcgagatcgtgacttgtttaccgcgcatatggatatcagaggtttaacacagggggacactgctacctacttctgtgccaggcaaaagtttgaacggggaggccagggctggtatttcgatctgtgggggcgcggaacactaattgttgtgtcgtca

SEQ ID NO: 26005 - RNA, 375 nt, synthetic construct
  misc_feature 1..375: note = derived and/or modified sequence opt3 from anti-HIV-1_HeavyChain
  source 1..375: mol_type = other RNA
caggcccaccccgagcaaagcggctccggggtgaagaaacctggagcttctgtcagagtttcatgctggaccagtgaagacatcttcgaaaagagcgagctgattcattgggtgaggcaggcaccaggtcagggcctcgagtggatagggtgggtaaaaacagtgactggagccgtcaactttggctcctctgatttccggcagcgcgtgtcgcttacgcgagaccgtgatctgtttaccgcgcacatggacatcagaggtttgacacaaggggatactgctacctacttctgtgccaggcagaagttttatgcaggaggccagggctggtacttcgacttatgggggcggggaacactgattgttgtgtcaagc

SEQ ID NO: 26006 - RNA, 375 nt, synthetic construct
  misc_feature 1..375: note = derived and/or modified sequence opt3 from anti-HIV-1_HeavyChain
  source 1..375: mol_type = other RNA
agagcccacctggagcagagcggctccggggtgaggaagcccggagcttctgtccgggtttcatgctggaccagtgaagacatcttcgagaaaagcgaactcattcattgggtgcgccaagcacctggtcagggccttgagtggatagggtgggtaaagacagtgactggagccgtcaactttggctcctctgatttccgacagcgtgtgtcgctgacgagagacagggatttgtttaccgcgcacatggacatccggggtttaacacagggggatactgctacctacttctgtgcccgccaaaaattttatgcaggaggccagggctggtacttcgacctgtgggggagaggaacactaattgttgtgtcaagc

SEQ ID NO: 26007 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgagcggagccgtcaactttggctccccaaatttccgccaccgagtgtctctgacgcgtgatagagacttgtttaccgcgcatatggatatcaggggtttaacacagggggacactgctacctacttctgtgcccggcaaaaatttgaacgcggaggccagggctggattttcgatctgtgggggagaggaacactaatcgcagtttcgtca

SEQ ID NO: 26008 - RNA, 375 nt, synthetic construct
  misc_feature 1..375: note = derived and/or modified sequence opt3 from anti-HIV-1_HeavyChain
  source 1..375: mol_type = other RNA
cagagccacctggagcaatccggctctgccatgaagaaacccggggcttcagtgagagtcagttgctggaccagcgaagacatcttcgagaagtccgaactcattcattgggttaggcaggcacctggacagggtcttgagtggataggctgggtgaaaacagtaactggggccgtgaactttggatcttcggatttccggcagcgcgtctcactgacgcgagaccgtgatttgtttaccgcgcacatggacatcagaggcttaacacaaggtgatactgctacctacttctgtgccaggcagaagttttatgcagggggacagggctggtacttcgacctgtggggccgggggacactaattgtggttagcagt

SEQ ID NO: 26009 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagttttatgcaggaggccagggctggtacttcgacctgtgggggcggggaacacatattgttgtgtcaagc

SEQ ID NO: 26010 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagatcgtgagcggagccgtcaactttggctccccaaatttccgccagcgagtgtctctgactcgtgatagagacttgtttacggcgcacatggatattaggggtttaacccaaggggacacagctacttacttctgtgcccggcagaaatttgaacgcggaggccagggctggatcttcgatctgtgggggagaggaaccctaattgcagtttcgtca

SEQ ID NO: 26011 - RNA, 375 nt, synthetic construct
  misc_feature 1..375: note = derived and/or modified sequence opt3 from anti-HIV-1_HeavyChain
  source 1..375: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctcttcggacttccggcatcgcgtctcactgacccgagatcgtgacttgagcacagcgcacatggatattagaggattaactcaggacgataccgctacatatttttgtgccaggcaaaaattcgcacggggcgaccagggttggtttttcgatctgtgggggcgcggaaccctaatcgtggttagttcc

SEQ ID NO: 26012 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagatcgtgagcggagccgtcaactttggctccccaaatttccgccagcgagtgtctctgactcgtgatagagacttgtttacggcgcacatggatattaggggtttaacccaaggggacacagctacttacttctgtgcccggcagaaattttatgcaggaggccagggctggtacttcgatctgtgggggcgcggaaccctaatcgttgtgtcgtca

SEQ ID NO: 26013 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggagcgaactcattcattgggtgcggcaggcacctggtcagggccttgagtggatagggtgggtaaagacagtgactggagccgtcaactttggctccccaaatttccgccagcgagtgtctctgacgcgtgatagagacttgtttaccgcgcacatggatatcaggggtttaacagaaggggacactgctacctacttctgtgcccggcaaaaattttatgcaggaggccagggctggtacttcgatctgtgggggcgcggaacactaattgttgtgtcgtca

SEQ ID NO: 26014 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggctaactacggctccttggattttcgccaccgagtctctttaactcgtgacagagatctgttcacggcccatatggacatcaggggtctaacccaggatgacacagcaacttatttttgtgcccggcaaaaattcgctcgcggggatcagggatggtttttcgacctctggggcagaggcaccctgattgtggtttcgtca

SEQ ID NO: 26015 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgtccggagccgtcaactttggctctccaaatttccggcaccgcgtgtcgctgactcgagatcgtgacttgtttacggcgcatatggatatcagaggtttaacccagggggacacagctacttacttctgtgccaggcaaaagtttgaacggggaggccagggctggtatttcgatctgtgggggcgcggaaccctaattgttgtgtcaagc

SEQ ID NO: 26016 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactttggctcccctaatttccgccaccgagtgtctttgactcgtgatagagacttatttacggctcatatggatatcaggggtctgacccagggggacacagccacttacttctgtgcacggcaaaaatttgaacgcggaggccagggctggtatttcgatctatgggggagaggaaccctcattgttgtgtcgtca

SEQ ID NO: 26017 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagatcgtgagcggagccgtcaactttggctccccaaatttccgccagcgagtgtctctgactcgtgatagagacttgtttacggcgcacatggatattaggggtttaacccaaggggacacagctacttacctgtgtgcccggcagaaattcgaacgcggaggccagggctggatctttgatctatgggggagaggaaccctcattgcagtttcgtca

SEQ ID NO: 26018 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgtccggagccgtcaactttggctctccaaatttccgccaccgagtgtcgctgactcgtgatagagacttgtttacggcgcatatggatatcaggggtttaacccagggggacacagctacttacttctgtgcccggcaaaaatttgaacgcggaggccagggctggtatttcgatctgtgggggagaggaaccctaattgttgtgtcaagc

SEQ ID NO: 26019 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggaaccgtcaactttggcagcctgaatttccgccagcgagtgtccttgacacgtgatagagacttatttactgcccacatggatatcaggggtctgacccaaggggacacagcgacctacttctgtgctcggcagaaattttatgccggaggccagggctggtacttcgatctatgggggcgcggaactctcattgttgtgtcttcg

SEQ ID NO: 26020 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcgcttccggcgtgaagagacccggggcatctgtcagggtttcatgctggaccagtgaagacatcttcgagcggagcgaactcatttactgggtgcgccaggcccctggacagggtcttgagtggataggctgggtaaaaacagtgtccggggcggtcaactttggatctactgatttccgagaacgtgtgtcgctgacgagagacagggatttgtttaccgctcatatggacatccggggcttaacacagggtgatactgccacctatttctgtgcacgccaaaagtttgccagaggggaccagggatggttctttgatctgtggggcaggggcacactaattgttgtgtcaagc

SEQ ID NO: 26021 - RNA, 375 nt, synthetic construct
  misc_feature 1..375: note = derived and/or modified sequence opt3 from anti-HIV-1_HeavyChain
  source 1..375: mol_type = other RNA
caggtgcacctggagcaaagcggctccggggtcaagaaacccggagcctctgttagagtgtcatgctggaccagtgaagacatcttcgagaggagcgaactcattcattgggtacggcaggctcctggtcagggccttgagtggatagggtgggtgaagacagtcactggagcagtgaactttggctccccaaatttccgccaccgagtttctctgacgcgtgatagagacttgtttaccgcccatatggatatcaggggtttaacacagggggacactgcgacctacttctgtgctcggcaaaaatattacgccggaggccagggctggtattttgatctgtgggggcgcggaacactaattgtggtctcgtca

SEQ ID NO: 26022 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatctgtggtttaacacaaggggatactgctacctacttctgcgccagacagaagttttatgcaggaggccagggctggtacttcgacctgtgggggaggggaacactaattgttgtgtcaagc

SEQ ID NO: 26023 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccgaggcttctgtcagagtttcatgctggaccagtgaagacatcttcgaaaagagcgagctcattcattgggtgaggcaggcacctggacagggtcttgaatggataggctgggtaaaaacagtgactggggccgtcaactttggatcctctgatttccggcagcgcgtgtcgctgacgcgagaccgtgatttgtttaccgcgcacatggacatcagaggcttaacacaaggtgatactgctacctacttctgtgccaggcagaagttttatgcagggggacagggctggtacttcgacctgtggggccgggggacactaattgttgtgtcaagc

SEQ ID NO: 26024 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccagcgagtgtccctgacccgtgatagagacttgtttacagcgcacatggatatcaggggtttaactcaaggggacaccgctacatacttctgtgcccggcagaaatttgaacgcggaggccagggctggattttcgatctgtgggggagaggaaccctaatcgcagtttcttcg

SEQ ID NO: 26025 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcgcttccggcgtgaagagacccggggcatctgtcagggtttcatgctggaccagtgaagacatcttcgagcggacagaactcatttactgggtgcgccaggcccctggacagggtcttgagtggataggctgggtaaaaactgtgagcggggcggtcaactttggatcccaggatttccgagaccgtttttctctgacgagagatagggacttgttcaccgctcatatggatatccggggcttaacacaaggtgacactgccacctatttttgtgcacgccagaagttcgaaagagggggacagggctggtactttgatctgtggggcagggggacactaattgtggtttcgtca

SEQ ID NO: 26026 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaatcgtgtccggagccgtcaactttggctctccaaatttccggcagcgcgtgtcgctgacacgagatcgtgacttgtttactgcgcacatggatattagaggtttaacgcaaggggacaccgctacatacttctgtgccaggcagaagtttgaacggggaggccagggctggatcttcgatctgtgggggcgcggaactctaattgcagtttcaagc

SEQ ID NO: 26027 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacccgtttacagcgcatatggatatcaggggtttgactcagggggacaccgctacatacttctgtgcccggcaaaaatttgaacgcggaggccagggctggtatttcgatttatgggggagaggaaccctgattgttgtgtcttcg

SEQ ID NO: 26028 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcggtctcattcattgggtgaggcaggcacctggccaggggcttgagtggataggatgggtaaaaacagtgactggcgccgtcaactttggttcctctgatttccggcagcgcgtgtcgctgacgcgagaccgtgatttgtttaccgcgcacatggacatcagagggttaacacaaggagatactgctacctacttctgtgccaggcagaagttttatgcaggcggccaggggtggtacttcgacctgtggggacggggtacactaattgttgtgtcaagc

SEQ ID NO: 26029 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaagccgtgtccggaacagtcaactacggctctctggattttcggcaccgcgtgtcgttgactcgagaccgtgatttattcacggcgcatatggacatcagaggtctgacccaggatgacacagctacttatttttgtgccaggcaaaagttcgcacgcggggatcagggatggtttttcgacctatggggccggggcaccctcattgttgtgtcaagc

SEQ ID NO: 26030 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagggtagcgaactcattcattgggtgaggcaggcacctggccaggggcttgagtggataggatgggtaaagacagtgactggcgccgtcaactttggttccgcgtacttccggcaccgcgtgtctctgacgcgagatcgtgacttgtttaccgctcatatggatatcagagggttaacacagggagacactgccacctatttctgtgcaaggcaaaaattttacgccggcggccaggggtggtatttcgatctgtggggacggggtacactaattgttgtgtcgtca

SEQ ID NO: 26031 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgtcaactttggctccctggatttccgccaccgaatctctttgacgcgtgacagagatttatttaccgcgcatatggacattaggggtctgacacagggggatactgctacctacttctgtgcccggcaaaaattttatgcaggaggccagggctggtacttcgacctatgggggcgcggaacactcatcgtggtttcgtca

SEQ ID NO: 26032 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaaggccgtgtccggagcggtcaactacggctctctggattttcgccaccgagtgtcgttgacacgtgacagagatttatcaactgctcatatggacatcaggggtctgacgcaggatgacaccgccacacacttctgtgcacggcaaaaatttgcccgcggggatcagggatggttctttgacctatggggcagaggcactctcattgttgtgagcagt

SEQ ID NO: 26033 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagggtacagaactcattcattgggtgaggcaggcacctggccaggggcttgagtggataggatgggtaaagatcgtgagcggcgccgtcaactttggttccccaaatttccggcagcgcgtgtctctgactcgagatcgtgacttgtttacggcgcacatggatattagagggttaacccaaggagacacagctacttacttctgtgccaggcagaaatttgaacggggcggccaggggtggatcttcgatctgtggggacgcggtaccctaattgcagtttcgtca

SEQ ID NO: 26034 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccagcgagtgtccctgacccgtgatagagacttgtttacagcgcacatggatatcaggggtttaactcaaggggacaccgctacatacttctgtgcccggcagaaattttatgcaggaggccagggctggtacttcgatctgtgggggcgcggaaccctaattgttgtgtcttcg

SEQ ID NO: 26035 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagggtagcgaactcattcattgggtgaggcaggcacctggccaggggcttgagtggataggatgggtaaagacagtgactggcgccgtcaactttggttccccaaatttccggcaccgcgtgtctctgacgcgagatcgtgacttgtttaccgcgcatatggatatcagagggttaacacagggagacactgctacctacttctgtgccaggcaaaaatttgaacggggcggccaggggtggtatttcgatctgtggggacgcggtacactaattgttgtgtcgtca

SEQ ID NO: 26036 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgagcggagccgtcaactttggctccccaaatttccgccaccgagtgtctctgacgcgtgatagagacttgtttaccgcgcatatggatatcaggggtttaacacagggggacactgctacctacttctgtgcccggcaaaaatttgcacgcggagatcagggctggttctttgacctgtggggcagagggacactaattgttgtgtcgtca

SEQ ID NO: 26037 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaaggtatcttcgagaggacagaactcattcattgggtgcggcaggcacctggccaggggcttgagtggataggatgggtaaagatcgtgagcggcgccgtcaactttggttccccaaatttccgccagcgagtgtctctgactcgtgacagagatttgtttgcggctcacatggacattagggggttaacgcaaggagataccgccacatacttctgtgcacggcagaaatttgaacgcggcggccaggggtggatcttcgacctgtggggaagaggtactctaattgccgtttcgtca

SEQ ID NO: 26038 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagagggcagaacttattcattgggtgcggcaggcccccggtcagggcctggagtggatagggtgggtaaaggcggtgagcggagctgtcaactacggctccttggattttcgccaccgagtgtctttaacacgtgacagagatctgttcactgcccatatggacatcaggggtctaacgcaggatgacaccgcaatttatttttgtgcccggcaaaaattctacgctgggggacagggctggtattttgatctctggggccgcgggacactgatcgttgtgtcgtca

SEQ ID NO: 26039 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctcccctaattttcgccagcgagtgtctttgactcgtgatagagacttattcacggctcacatggatatcaggggtctgacccaaggggacacagccacttatttttgtgcacggcagaaattcgaacgcggaggccagggctggatttttgatctatgggggagaggaaccctcatcgccgtttcgtca

SEQ ID NO: 26040 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactacggcagcctgaattttcgctcccgaatctctttgacccgtgatagagacttattcacagcgcacatggatattaggggtctgactgaaggggacaccgctacatatttttgtgcccggcagaaattctacgcaggaggccaaggctggtattttgatctatgggggcgcggaaccctcatcgtggtttcgtca

SEQ ID NO: 26041 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgtccggagccgtcaactttggctctccaaatttccggcagcgcgtgtcgctgactcgagatcgtgacttgtttacggcgcacatggatatcagaggtttaacccaaggggacacagctacttacttctgtgccaggcagaagtttgaacggggaggccagggctggattttcgatctgtgggggcgcggaaccctaatcgcagtttcaagc

SEQ ID NO: 26042 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatacgctgggtaaaggccgtgagcggggcggtcaactacggatccttggattttcgacaccgtgtgtctttaactagagacagggatctgtcgacggctcatatggacatccggggcctaacccaggatgacacagccacttatttctgtgcacgccaaaaatttgccagaggtgatcaggggtggttctttgacctctggggaaggggcaccctgattgttgtgtcaagc

SEQ ID NO: 26043 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaagactgtgacgggagccgtcaactttggcagctccgatttccgccagcgagtgtctttgacccgtgacagagatttatttacagcgcaaatggacatcaggggtctgactcagggggataccgctacatacttctgtgcccggcagaaattttatgcaggaggccagggctggtacttcgacctatgggggcgcggaaccctcattgttgtgtcgtca

SEQ ID NO: 26044 - RNA, 372 nt, synthetic construct
  misc_feature 1..372: note = derived and/or modified sequence opt3 from anti-HIV-1_HeavyChain
  source 1..372: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttgcgcaccagatctccgatcgggtgtctctgacgcgcgaccgagatttgttcaccgctcatatggacattcgtggcttaacacaaggtgatactgccacctacttttgtgcaagacagaagttctatgccgggggacagggctggtactttgacctgtggggcagggggacactaatcgttgtgtcgtca

SEQ ID NO: 26045 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaaggtggtcagcggagccgtgaactttggctccccaaatttccgccagcgagtttctctgactcgtgatagagacttgtttacggcgcacatggatatcaggggtttaacccaaggggacacagctacttacttctgtgcccggcagaaatttgaacgcggaggccagggctggattttcgatctgtgggggagaggaaccctaatcgcagtgtcgtca

SEQ ID NO: 26046 - RNA, 375 nt, synthetic construct
  misc_feature 1..375: note = derived and/or modified sequence opt3 from anti-HIV-1_HeavyChain
  source 1..375: mol_type = other RNA
caggtgcacctggagcaaagcggctccggggtcaagaaacccggagcctctgttagagtgtcatgctggaccagtgaagacatcttcgaaaagagcgagctcattcattgggtaaggcaggctcctggtcagggccttgagtggatagggtgggtgaaaacagtcactggagcagtgaactttggctcctctgatttccggcagcgcgtttcgctgacgcgagaccgtgatttgtttaccgcccacatggacatcagaggtttaacacaaggggatactgcgacctacttctgtgctaggcagaagttttatgccggaggccagggctggtacttcgacctgtgggggcggggaacactaattgtggtctcaagc

SEQ ID NO: 26047 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgtcaactttggctccctggatttccgccaccgaatctctttgacgcgtgacagagatttatttaccgcgcatatggacattaggggtctgacacagggggatactgctacctacttctgtgcccggcaaaaatttgaacgcggaggccagggctggatcttcgacctatgggggagaggaacactcattgcagtgtcgtca

SEQ ID NO: 26048 - RNA, 375 nt, synthetic construct
  misc_feature 1..375: note = derived and/or modified sequence opt3 from anti-HIV-1_HeavyChain
  source 1..375: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgtatatggatatcagaggactgacacaggacgatactgctacctacttttgtgccaggcaaaaattcgcacggggcgaccagggttggtttttcgatctatgggggcgcggaacactcattgtcgtgagttcc

SEQ ID NO: 26049 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtttacagcgcatatggatatcaggggtttaactcagggggacaccgctacatacctgtgtgcccggcaaaaattcgaacgcggaggccagggctggtattttgatctatgggggagaggaaccctcattgttgtgtcttcg

SEQ ID NO: 26050 - RNA, 372 nt, synthetic construct
  misc_feature 1..372: note = derived and/or modified sequence opt3 from anti-HIV-1_HeavyChain
  source 1..372: mol_type = other RNA
agacacacctgggagcagagcggctccggggtgaagaaacccggagcctctgtcagggtttcatgctggacaagtgaagacatcttcaagagcgagctgattcattgggtgcggcaagctcctggtcagggcctcgaatggatagggtgggtaaaaactgtgacgggagcagtcaactttggctcctctgatttccgccagcgagtgtcgcttacccgtgacagagatctgtttacagcccacatggacatcaggggtttgactcagggggataccgcgacatacttctgtgctcggcaaaagttttatgccggaggccagggctggtacttcgacttatgggggcgcggaaccctgattgttgtgtcaagc

SEQ ID NO: 26051 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtttacagcgcatatggatatcaggggtttaactgaaggggacaccgctacatacttctgtgcccggcagaaattttatgcaggaggccaaggctggtacttcgatctgtgggggcgcggaaccctaattgttgtgtcttcg

SEQ ID NO: 26052 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcgcgtacttccgccaccgagtgtccctgacccgtgatagagacttgtttacagctcatatggatatcaggggtttaactcagggggacaccgccacatatttctgtgcacggcaaaaattttacaagggaggccagggctggtatttcgatctgtgggggcgcggaaccctaattgttgtgtcttcg

SEQ ID NO: 26053 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggccccggggtgaagaaactcggagcttccgtcagagtttcttgctggacctcagaagacatcttcgagaggacagaacttattcattgggtgcggcaggcacctggtcagggcctggagtggatagggtgggtaaaggccgtgagtggagcggtcaactacggcagcttggattttcgccaccgagtgtccttaactcgtgacagagatctgttcacggctcatatggacatcaggggtctaacccaggatgacacagccacttatttttgtgcacggcaaaaattcgcccgcggggatcagggatggtttttcgacctctggggcagaggcaccctgattgttgtgtcttcg

SEQ ID NO: 26054 - RNA, 375 nt, synthetic construct
  misc_feature 1..375: note = derived and/or modified sequence opt3 from anti-HIV-1_HeavyChain
  source 1..375: mol_type = other RNA
agagcccacctggagcagagcggctccggggtgaagaaacccggagcttctgtcagggtttcatgctggaccagtgaagacatcttcgagcggacagaactcattcattgggtgcgccaagcacctggtcagggccttgagtggatagggtgggtaaagatcgtgagcggagccgtcaactttggctccccaaatttccgacagcgtgtgtctctgactagagatagggacttgtttacggcgcacatggatattcggggtttaacccagggggacacagctacttacttctgtgcccgccaaaaatttgaaagaggaggccagggctggatcttcgatctgtgggggaggggaaccctaattgcagtttcgtca

SEQ ID NO: 26055 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaagactgtgacgggagccgtcaactttggcagctccgatttccgccagcgagtgtctttgacccgtgacagagatttatttacagcgcacatggacatcaggggtctgactcaaggggataccgctacatacttctgtgcccggcagaaattttatgcaggaggccagggctggtacttcgacctatgggggcgcggaaccctcattgttgtgtcgtca

SEQ ID NO: 26056 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaaggccgtgtccggagcggtcaactacggctctctggattttcgccaccgagtgtcgttgacacgtgacagagatttattcactgctcatatggacatcaggggtctgacgcaggatgacaccgccatttatttttgtgcacggcaaaaattcgcccgcggggatcagggatggtttttcgacctatggggcagaggcacactcatcgttgtgtcaagc

SEQ ID NO: 26057 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaagtcggagcttctgttagagtgtcatgctggaccagtgaagacatcttcgagaggacagaactcattcattgggtacggcaggcacccggtcagggccttgagtggatagggtgggtgaaggccgtcagcggagcggtgaactacggctccctggattttcgccaccgagtttctttgactcgtgacagagatttattcacggctcatatggacatcaggggtctgacccaggatgacacagccatttatttttgtgcacggcaaaaattcgcccgcggggatcagggatggtttttcgacctatggggcagaggcactctcatcgtggtctcgtca

SEQ ID NO: 26058 - RNA, 375 nt, synthetic construct
  misc_feature 1..375: note = derived and/or modified sequence opt3 from anti-HIV-1_HeavyChain
  source 1..375: mol_type = other RNA
caggtgcaactggtccagagcggcgccgagctcaagaaacccgggtcctctgttagagtgtcatgctggaccagtgaagacatcttcgagggaagcgaacttattcactgggtaaggcaggctcctggtcagggcctggagtggatagggtgggtgaagacagtcactggagcagtgaactttggctccgcctacttccggcatcgcgtttctttgacgcgagatcgtgacttatttaccgcgcacatggatatcagaggtctgacacaaggggacactgctacctatttctgtgccaggcagaaattttacaagggaggccagggctggtatttcgatctatgggggcggggaacactcattgtggtctcgtca

SEQ ID NO: 26059 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagtctctgttagagtgtcatgctggaccagtgaagacatcttcgagaggacagaactcattcattgggtacggcaggctcctggtcagggccttgagtggatagggtgggtgaagatcgtcagcggagcagtgaactttggctccccaaatttccgccagcgagtttctctgactcgtgatagagacttgtttacggcccacatggatattaggggtttaacccaaggggacacagcgacttacttctgtgctcggcagaaatttgaacgcggaggccagggctggatcttcgatctgtgggggagaggaaccctaattgccgtgtcgtca

SEQ ID NO: 26060 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggtggtcagcggagccgtgaactacggctccttggattttcgccaccgagtttctttaactcgtgacagagatctgttcacggcgcatatggacatcaggggtctaacccaggatgacacagctacttatttttgtgcccggcaaaaattcgcacgcggggatcagggatggtttttcgacctctggggcagaggcaccctgattgtggtctcgtca

SEQ ID NO: 26061 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgttcacggctcatatggacatcaggggtctaacccaggatgacacagccgcatatttttgtgcccggcaaaaattcgctcgcggggatcagggatggtttttcgacctctggggcagaggcactctgattgttgtgtcgtca

SEQ ID NO: 26062 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgagaaagcccggagcttctgtcagggtttcatgctggaccagtgaagacatcttcgagaaaagcgaactcattcattgggtgcggcaggcacctggtcagggccttgagtggatagggtgggtaaagacagtgactggagccgtcaactttggctcctctgatttccgccagcgagtgtcgctgacgcgtgacagagatttgtttaccgcgcacatggacatcaggggtttaacacaaggggatactgctacctacttctgtgcccggcagaaattttatgcaggaggccagggctggtacttcgacctgtgggggcgcggaacactaattgttgtgtcaagc

SEQ ID NO: 26063 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggaaccgtcaactttggcagcctgaatttccgccagcgagtgtccttgacacgtgatagagacttatttactgcccacatggatatcaggggtctgacccaaggggacacagcgacctacttctgtgctcggcagaaattttataagggaggccagggctggtacttcgatctatgggggcgcggaactctcattgttgtgtcttcg

SEQ ID NO: 26064 - RNA, 375 nt, synthetic construct
  misc_feature 1..375: note = derived and/or modified sequence opt3 from anti-HIV-1_HeavyChain
  source 1..375: mol_type = other RNA
cagagccacctggagcaatccggctctgccatgaagaaacccggggcttcagtgagagtcagttgctggaccagcgaagacatcttcgagaggacagaactcattcattgggttcggcaggcacctggacagggtcttgagtggataggctgggtgaaggccgtatccggggcggtgaactacggatctctggattttcgccaccgagtctcgttgactcgtgacagagatttattcacggctcatatggacatcaggggcctgacccaggatgacacagccacttatttttgtgcacggcaaaaattcgcccgcggtgatcaggggtggtttttcgacctatggggaagaggcaccctcattgtggtttcaagc

SEQ ID NO: 26065 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgtcaactttggctccctggatttccgccaccgagtgtctttgacgcgtgacagagatttatttaccgcgcatatggacatcaggggtctgacacagggggatactgctacctacttctgtgcccggcaaaaatttgcacgcggagaccagggctggttctttgatctatggggcagagggacactcattgttgtgtcgtca

SEQ ID NO: 26066 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagagacccggagcttctgtcagggtttcatgctggaccagtgaagacatcttcgagacaactgaactcattcattgggtgcggcaggcacctggtcagggccttgagtggatagggtgggtaaaaacggtgagcggagccgtcaactttggctccctgaatttccgccaccgagtgtctttgacccgtgatagagacttatttacagcgcatatggatatcaggggtctgactcagggggacaccgctacatacttctgtgcccggcaaaagttttataaaggaggccagggctggtacttcgatctatgggggcgcggaaccctcattgttgtgtcgtca

SEQ ID NO: 26067 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcgcttccggcgtgagaaggcccggggcatctgtccgggtttcatgctggaccagtgaagacatcttcgagcgcagcgaactcatttactgggtgcgacaggcccctggacgtggtcttgagtggataggctggatcaagctggtatccggggcggtgaactttggatctgtcgatttcagagacagggtgtcgttgacacgggatcgcgacttatttactgctcatatggatattagaggcctgacgcagggtgacaccgccacatatttctgtgcaaggcagaaattttacgccgggggacaaggctggtatttcgatctatggggccgggggactctcatcgttgtgtcaagc

SEQ ID NO: 26068 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagatcgtgtccggagccgtcaactttggctctccaaatttccgccagcgagtgtcgctgacacgtgatagagacttgtttactgcgcacatggatattaggggtttaacgcaaggggacaccgctacatacttctgtgcccggcagaaatttgaacgcggaggccagggctggatcttcgatctgtgggggagaggaactctaattgcagtttcaagc

SEQ ID NO: 26069 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaagactgtgagcggagccgtcaactttggctcccctaatttccgccaccgagtgtctttgacgcgtgatagagacttatttaccgcgcatatggatatcaggggtctgacacagggggacactgctacctacttctgtgcccggcaaaaatttgaacgcggaggccagggctggtatttcgatctatgggggagaggaacactcattgttgtgtcgtca

SEQ ID NO: 26070 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagagacccggagcttctgtcagggtttcatgctggaccagtgaagacatcttcgagaaaagcgaactcattcattgggtgcggcaggcacctggtcagggccttgagtggatagggtgggtaaagacagtgactggagccgtcaactttggctcctctgatttccgccagcgagtgtcgctgacgcgtgacagagatttgtttaccgcgcacatgggtatcagggggttaacacaaggagacactgctacctacttctgtgcccggcagaaattttatgcaggcggccaggggtggtacttcgatctgtggggacgcggtacactaattgttgtgtcaagc

SEQ ID NO: 26071 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaaggccgtgagcggagcggtcaactacggctccctggattttcgccaccgagtgtctttgactcgtgacagagatttattcacggctcatatggacatcaggggtctgacccaggatgacacagccatttatttttgtgcacggcaaaaattcgcccgcggggatcagggatggtttttcgacctatggggcagaggcactctcatcgttgtgtcgtca

SEQ ID NO: 26072 - RNA, 375 nt, synthetic construct
  misc_feature 1..375: note = derived and/or modified sequence opt3 from anti-HIV-1_HeavyChain
  source 1..375: mol_type = other RNA
cagagccacctggagcaatccggctctgccatgaagaaactcggggcttcagtgagagtcccctgctggaccagtgaagacatcttcgagaggacagaacttattcattgggttcggcaggcacctggacagggtctggagtggataggctgggtgaaggccgtaagcggggcggtgaactacggatccttggattttcgccaccgagtctctttaactcgtgacagagatctgttcacggctcatatggacatcaggggcctaacccaggatgacacagccacttatttttgtgcacggcaaaaattcgcccgcggtgatcaggggtggtttttcgacctctggggaagaggcaccctgattgtggtttcgtca

SEQ ID NO: 26073 - RNA, 375 nt, synthetic construct
  misc_feature 1..375: note = derived and/or modified sequence opt3 from anti-HIV-1_HeavyChain
  source 1..375: mol_type = other RNA
caggtgcacctggagcaaagcggctccggggtcaagaaacccggagcctctgttagagtgtcatgctggaccagtgaagacatcttcgagaggacagaactcattcattgggtacggcaggctcctggtcagggccttgagtggatagggtgggtgaagatcgtcagcggagcagtgaactttggctccccaaatttccgccagcgagtttctctgactcgtgatagagacttgtttacggcccacatggatattaggggtttaacccaaggggacacagcgacttacttctgtgctcggcagaaatttgaacgcggaggccagggctggatcttcgatctgtgggggagaggaaccctaattgccgtgtcgtca

SEQ ID NO: 26074 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaaggccgtgagcggagcggtcaactacggctccctggattttcgccaccgagtgtctttgactcgtgacagagatttattcacggctcatatggacatcaggggtctgacccaggatgacacagccacttatttttgtgcacggcaaaaattcgcccgcggggatcagggatggtttttcgacctatggggcagaggcaccctcattgttgtgtcgtca

SEQ ID NO: 26075 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcgcttccggcgtgagaaggcccggggcatctgtccgggtttcatgctggaccagtgaagacatcttcgagcgcagcgaactcatttactgggtgcgacaggcccctggacgtggtcttgagtggataggctgggtaaagacagtgtccggggcggtcaactttggatctccaaatttcagacatagggtgtcgctgactcgggatcgcgacttgtttacggctcacatggatatcagaggcttaacccagggtgacacagccacttatttctgtgcaaggcagaaatttgaacgcgggggacaaggctggtacttcgatctgtggggccgggggaccctaattgttgtgtcaagc

SEQ ID NO: 26076 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccagcgagtgtccctgacccgtgatagagacttgtttacagcgcacatggatatcaggggtttaactcaaggggacaccgctacatacttctgtgcccggcagaaatttgaacgcggaggccagggctggtatttcgatctgtgggggagaggaaccctaattgttgtgtcttcg

SEQ ID NO: 26077 - RNA, 375 nt, synthetic construct
  misc_feature 1..375: note = derived and/or modified sequence opt3 from anti-HIV-1_HeavyChain
  source 1..375: mol_type = other RNA
cagagccacctggagcaatccggctctgccatgaagaaacccggggcttcagtgagagtcagttgctggaccagcgaagacatcttcgagaggacagaactcatttactgggttcggcaggcacctggacgcggtcttgagtggataggctgggtgaagactgtatccgggacggtgaactttggatcttcggatttccgaaatcgtatctcactgaccagagacagggatttgagcacagcccatatggacattcggggcttaactcaggatgacaccgcgacatatttttgtgctcgccagaaattctacgccggtgggcaaggatggtattttgatctgtggggcagaggcaccctaatcgtcgtgagttcc

SEQ ID NO: 26078 - RNA, 375 nt, synthetic construct
  misc_feature 1..375: note = derived and/or modified sequence opt3 from anti-HIV-1_HeavyChain
  source 1..375: mol_type = other RNA
caggtgcaactggagcagagcggctccggggtcaagaaacccggagcctctgttagagtgtcatgctggaccagtgaagacatcttcgaaaagagcgagctcattcactgggtaaggcaggctcctggtcagggccttgagtggatagggtgggtgaaaacagtcactggagcagtgaactttggctcctctgatttccggcaacgcgtttcgctgacgcgagaccgtgatttgtttaccgcccatatggacatcagaggtttaacacagggggatactgcgacctacttctgtgctaggcagaagttttatgccggaggccagggctggtacttcgacctgtgggggcggggaacactaattgtggtctcaagc

SEQ ID NO: 26079 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcgcggccttgagtggatagggtgggtaaaggccgtgagcggagcggtcaactacggctccctggattttcgacaccgtgtgtctttgactagagacagggatttattcacggctcatatggacatccggggtctgacccaggatgacacagccacttatttttgtgcacgccagaaattcgccagaggggatcaaggatggtttttcgacctatggggcaggggcaccctcattgttgtgtcgtca

SEQ ID NO: 26080 - RNA, 375 nt, synthetic construct
  misc_feature 1..375: note = derived and/or modified sequence opt3 from anti-HIV-1_HeavyChain
  source 1..375: mol_type = other RNA
cagagccacctggagcaatccggctctgccatgaagaaacccggggcttcagtgagagtcagttgctggaccagcgaagacatcttcgagaggacagaactcattcattgggttcggcaggcacctggacagggtcttgagtggataggctgggtgaagactgtaacgggggccgtgaactttggatccccaaatttccgccaccgagtctctctgacccgtgatagagacttgtttacagcgcatatggatatcaggggcttaactcagggtgacaccgctacatacttctgtgcccggcaaaaatttgaacgcgggggacagggctggtatttcgatctgtggggcagagggaccctaattgtggtttcgtca

SEQ ID NO: 26081 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcgcttccggcgtgaagagacccggggcatctgtcagggtttcatgctggaccagtgaagacatcttcgagcggagcgaactcatttactgggtgcgccaggcccctggacagggtcttgagtggacaggctgggtaaaaactgtgtccggggcggtcaactttggatctacggatttccgagaacgtgtgtcgctgaccagagacagggatttgtttacagctcatatggacatacggggcttaactcagggtgataccgccacatatttctgtgcacgccaaaagtttgccagaggggaccagggatggttctttgatctgtggggcaggggcaccctaatcgttgtgtcaagc

SEQ ID NO: 26082 - RNA, 375 nt, synthetic construct
  misc_feature 1..375: note = derived and/or modified sequence opt3 from anti-HIV-1_HeavyChain
  source 1..375: mol_type = other RNA
caggtgcacctggagcaaagcggctccggggtcaagaaactcggagcctctgttagagtgtcatgctggaccagtgaagacatcttcgagaggacagaacttattcattgggtacggcaggctcccggtcgcggcctggagtggatagggtgggtgaaggcagtcagcggagccgtgaactacggctccttggattttcgacaccgtgtttctttaactagagacagggatctgttcacggcgcatatggacatccggggtctaacccaggatgacacagctacttatttttgtgcccgccagaaattcgcaagaggggatcaaggatggtttttcgacctctggggcaggggcaccctgattgtggtctcgtca

SEQ ID NO: 26083 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggagcgaactcattcattgggtgcggcaggcacctggtcagggccttgagtggatagggtgggtaaagacagtgactggagccgtcaactttggctccccaaatttccgccaccgagtgtctctgacgcgtgatagagacttgtttaccgcgcatatggatatcaggggtttaacacagggggacactgctacctacttctgtgcccggcaaaaatattacgcaggaggccagggctggtattttgatctgtgggggcgcggaacactaattgttgtgtcgtca

SEQ ID NO: 26084 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtttacagcgcatatggatatcaggggtttaactcagggggacaccgctacatacttctgtgcccggcaaaaattttatgcaggaggccagggctggtacttcgatctgtgggggcgcggaaccctaattgttgtgtcttcg

SEQ ID NO: 26085 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaagggggaactgctacctacttctgtgccaggcagaagttttatgcaggcggccaggggtggtacttcgatctgtggggacggggtacactaattgttgtgtcaagc

SEQ ID NO: 26086 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgagcggagccgtcaactttggctccccaaatttccgccaccgagtgtctctgacgcgtgatagagacttgtttaccgcgcatatggatatctgtggtttaacacagggggacactgctacctacttctgcgccaggcaaaaatttgaacggggaggccagggctggtatttcgatctgtgggggcgcggaacactaattgttgtgtcgtca

SEQ ID NO: 26087 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgagaaaggtcggagcttctgttagggtgtcatgctggaccagtgaagacatcttcgagcggacagaactcattcattgggtacgccaggcacccggtcagggccttgagtggatagggtgggtgaaagccgtcagcggagcggtgaactacggctccctggattttcgacaccgtgtttctttgactagagacagggatttattcacggctcatatggacatccggggtctgacccaggatgacacagccatttatttttgtgcacgccaaaagttcgccagaggggatcagggatggtttttcgacctatggggcaggggcactctcatcgtggtctcgtca

SEQ ID NO: 26088 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtttacagcgcatatggatatcaggggtttaactcagggggacaccgctacatacttctgtgcccggcaaaaatattacgcaggaggccagggctggtattttgatctgtgggggcgcggaaccctaattgttgtgtcttcg

SEQ ID NO: 26089 - RNA, 375 nt, synthetic construct
  misc_feature 1..375: note = derived and/or modified sequence opt3 from anti-HIV-1_HeavyChain
  source 1..375: mol_type = other RNA
caggtgcaactggtccagagcggcgccgaggttaagaaacccggggcttccgtgagagtatcttgctggacctcagaagacatcttcgagaggacagaactcattcactgggtgcggcaggcacctggacagggtcttgagtggataggctgggtcaagactgtgacgggggccgttaactttggaagtccaaatttccgccatcgagtgagcctgacccgtgatagagacttgtttacagcgcacatggatatcaggggcttaactcaaggtgacaccgctacatacttctgtgcccggcagaaatttgaacgcgggggacagggctggtatttcgatctgtggggcagagggaccctaattgtcgtgtcctct

SEQ ID NO: 26090 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggcctgtccgatttccggcagcgcgtgtctttgacgcgagaccgtggtttatttaccgcgcacatggatatcagagggctgacacaaggagacactgctacctacttctgtgccaggcagaagttttatgcaggcggccaggggtggtacttcgatctatggggacggggtacactcattgttgtgtcgtca

SEQ ID NO: 26091 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggaacctctgtcagagtttcatgctggacaagtgaagacatcttcgagaggactgaactcattcattgggtgcggcaggctcctggtcagggccttgagtggatagggtgggtaaagacggtgaccggagcagtcaactttggcagcccaaatttccgccagcgagtgtccctgacacgtgatagagacttgtttactgcccacatggatatcaggggtttaacccaaggggacacagcgacctacttctgtgctcggcagaaatttgaacgcggaggccagggctggattttcgatctgtgggggagaggaactctaatcgccgtttcttcg

SEQ ID NO: 26092 - RNA, 375 nt, synthetic construct
  misc_feature 1..375: note = derived and/or modified sequence opt3 from anti-HIV-1_HeavyChain
  source 1..375: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgcatatggatatcagaggactgacacaggacgatactgctacctatttttgtgccaggcaaaaattcgagcggggcggtcaggggtggtactttgacctatggggacgcggcacactcattgtcgtgagttcc

SEQ ID NO: 26093 - RNA, 375 nt, synthetic construct
  misc_feature 1..375: note = derived and/or modified sequence opt3 from anti-HIV-1_HeavyChain
  source 1..375: mol_type = other RNA
caggtgcaactggtccagagcggcgccgaggttaagaaacccggggcttccgtgagagtatcttgctggacctcagaagacatcttcgagggaagtgaactcattcactgggtgaggcaggcacctggtcagggccttgagtggatagggtgggtcaagacagtgactggagccgttaactttggcagcgcgtacttccggcatcgcgtgtccctgacgcgagatcgtgacttgtttaccgctcacatggatatcagaggtttaacacaaggggacactgccacctatttctgtgcaaggcagaaattttacaagggaggccagggctggtatttcgatctgtgggggcggggaacactaattgtcgtgtcttcg

SEQ ID NO: 26094 - RNA, 375 nt, synthetic construct
  misc_feature 1..375: note = derived and/or modified sequence opt3 from anti-HIV-1_HeavyChain
  source 1..375: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctcttcggacttccggaatcgcatttcactgagccgagatcgtgacttgagtaccgcgcatatggatatcagaggattaacacaggacgatactgctacctatttttgtgccaggcaaaaattcgagcggggcggtcaggggtggatttttgacctgtggggacgcggcacactaatcgcagtctcctct

SEQ ID NO: 26095 - RNA, 375 nt, synthetic construct
  misc_feature 1..375: note = derived and/or modified sequence opt3 from anti-HIV-1_HeavyChain
  source 1..375: mol_type = other RNA
caggtgcaactggtccagagcggcaccgaggttaagaaacccggggcctccgtgagagtatcttgcaaggcttcaggatacacattcgagaaaagtgaactcatccactgggtgaggcaggcacctggtcagggccttgaatggattgggtgggtcaagactgtgacgggagccgttaactttggcagctccgacttccggcaacgcgtgtctctgacccgagatcgtgacttgtttacagcgcatatggatataagaggtttaactcagggggacaccgctacatatttctgtgccaggcagaaattttacgcaggaggccagggctggtatttcgatctgtgggggcggggaaccctaatcgtcgtgtcgtca

SEQ ID NO: 26096 - RNA, 375 nt, synthetic construct
  misc_feature 1..375: note = derived and/or modified sequence opt3 from anti-HIV-1_HeavyChain
  source 1..375: mol_type = other RNA
cagagccacctggagcaatccggctctgccatgaagaaacccggggcttcagtgagagtcagttgctggaccagcgaagacatcttcgagaggacagaactcatttactgggttcggcaggcacctggacgcggtcttgagtggataggctgggtgaagactgtatccgggacggtgaactttggatcttcggatttccgaaatcgtatctcactgaccagagacagggatttgagcacagcccatatggacattcggggcttaactcaggatgacaccgcgacatatttttgtgctcgccagaaattcgaaagaggtgggcaaggatggatctttgatctgtggggcaggggcaccctaattgccgtcagttcc

SEQ ID NO: 26097 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaaggccgtgtccggagcggtcaactacggctctctggattttcgccaccgagtgtcgttgacacgtgacagagatttatcaactgctcatatggacatcaggggtctgacgcaggatgacaccgccacatatttctgtgcacggcaaaaatttgcccgcggggatcagggatggttctttgacctatggggcagaggcactctcattgttgtgagcagt

SEQ ID NO: 26098 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaagatgacactgctatttacttctgtgccaggcagaagtttgcacgcggggatcagggatggttctttgacctgtggggccggggcaccctaatcgttgtgtcaagc

SEQ ID NO: 26099 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcctggatttccgccaccgaatctccttgacccgtgacagagatttatttacagcgcatatggacattaggggtctgactcagggggataccgctacatacttctgtgcccggcaaaaattttatgcaggaggccagggctggtacttcgacctatgggggcgcggaaccctcatcgtggtttcttcg

SEQ ID NO: 26100 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcgagctcgtgcattgggtaaggcaggcacctggtcagggccttgagtggattgggtgggtgaaaacagtcactggagccgtgaactttggctcctctgatttccggcagcgcgtttcgctgacgcgagaccgtgatttgtttaccgcgcacatggacataagaggtttaacacaaggggatactgctacctacttctgtgccaggcagaagtttgaacggggaggccagggctggatcttcgacctgtgggggcgcggaacactaattgcagtgtcaagc

SEQ ID NO: 26101 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgttcacggctcatatggacatcaggggtctaacccagggggatacagccacttatttttgtgcacggcaaaaattcgcccgcggagaccagggctggtttttcgatctctggggcagagggaccctgattgttgtgtcgtca

SEQ ID NO: 26102 - RNA, 375 nt, synthetic construct
  misc_feature 1..375: note = derived and/or modified sequence opt3 from anti-HIV-1_HeavyChain
  source 1..375: mol_type = other RNA
caggcccacagagagcaaagcggctccggggtgaagaaacccggagcttctgtcagggtttcatgctggaccagtgaagacatcttcgagcggacagaactgattcattgggtgcgccaggcacctggtcagggcctcgagtggatagggtgggtaaagactgtgacgggagccgtcaactttggcagctccgatttccgacagcgtgtgtctcttaccagagacagggatctgtttacagcgcacatggacatccggggtttgactcaaggggataccgctacatacttctgtgcccgccagaaattttatgcaggaggccagggctggtacttcgacttatgggggagaggaaccctgattgttgtgtcgtca

SEQ ID NO: 26103 - RNA, 372 nt, synthetic construct
  misc_feature 1..372: note = derived and/or modified sequence opt3 from anti-HIV-1_HeavyChain
  source 1..372: mol_type = other RNA
caggcccacctggagcaaagcggctccggggtgaagaaacccggagcttctgtcagagtttcatgcctcgcaagtgaagacatcttcaagaccgagcttattcattgggtgaggcaggcccctggtcagggcctggaatggatagggtgggtaaaaatcgtgagcggagcggtcaactttggctccccaaatttccggcagcgcgtgtctttgacacgagatcgtgacttatttactgctcacatggatattagaggtctgacgcaaggggacaccgccacatacttctgtgcaaggcagaagtttgagcggggaggccagggctggatcttcgatctatgggggcgcggaactctcattgccgtttcgtca

SEQ ID NO: 26104 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaagtcggagcttctgttagagtgtcatgctggaccagtgaagacatcttcgagaggacagaactcattcattgggtacggcaggcacccggtcagggccttgagtggatagggtgggtgaaggccgtcagcggagcggtgaactacggctccctggattttcgccaccgagtttctttgactcgtgacagagatttattcacggctcatatggacatcaggggtctgacccaggatgacacagccatttatttttgtgcacggcaaaaattcgaacgcgggggacagggctggatctttgatctatggggcagagggactctcattgccgtgtcgtca

SEQ ID NO: 26105 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagtttgcacggggagaccagggctggttctttgatctgtggggccgcgggacactaattgttgtgtcaagc

SEQ ID NO: 26106 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcgcttccggcgtgaagagacccggggcatctgtcagggtttcatgctggaccagtgaagacatcttcgagcggagcgaactcatttactgggtgcgccaggcccctggacagggtcttgagtggataggctgggtaaaaacagtgactggggcggtcaactttggatcctctgatttccgacagcgtgtgtcgctgacgagagacagggatttgtttaccgctcatatggacatccggggcttaacacaaggtgatactgccacctatttctgtgcacgccagaagttttacgccgggggacagggctggtatttcgacctgtggggcagagggacactaattgttgtgtcaagc

SEQ ID NO: 26107 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaagactgtgacgggagccgtcaactttggcagccctaatttccgccaccgagtgtccttgacccgtgatagagacttatttacagcgcatatggatatcaggggtctgactcagggggacaccgctacatacttctgtgcccggcaaaaatattacgcaggaggccagggctggtattttgatctatgggggcgcggaaccctcattgttgtgtcttcg

SEQ ID NO: 26108 - RNA, 375 nt, synthetic construct
  misc_feature 1..375: note = derived and/or modified sequence opt3 from anti-HIV-1_HeavyChain
  source 1..375: mol_type = other RNA
caggtgcaactggtccagagcggctccggggttaagaaacccggagcctctgtgagagtatcatgctggaccagtgaggacatcttcgaaaggacagagctcattcactgggtgcggcaggctcctggtcagggccttgaatggatagggtgggtcaagatcgtgagcggagcagttaactttggctccccaaatttccgccaacgagtgtctctgactcgtgatagagacttgtttacggcccatatggatattaggggtttaacccagggggacacagcgacttacttctgtgctcggcagaaatttgagcgcggaggccagggctggatcttcgatctgtgggggagaggaaccctaattgccgtctcgtca

SEQ ID NO: 26109 - RNA, 375 nt, synthetic construct
  misc_feature 1..375: note = derived and/or modified sequence opt3 from anti-HIV-1_HeavyChain
  source 1..375: mol_type = other RNA
agacacacctgggagcagagcggctccggggtgaagaaacccggagcctctgtcagggtttcatgctggacaagtgaagacatcttcgagcggactgaactgattcattgggtgcgccaagctcctggtcagggcctcgagtggatagggtgggtaaagatcgtgagcggagcagtcaactttggctccccaaatttccgacagcgtgtgtctcttacgagagatagggacctgtttaccgcccacatggatattcggggtttgacacagggggacactgcgacctacttctgtgctcgccaaaaatttgaaagaggaggccagggctggatcttcgatttatgggggaggggaacactgattgccgtttcgtca

SEQ ID NO: 26110 - RNA, 372 nt, synthetic construct
  misc_feature 1..372: note = derived and/or modified sequence opt3 from anti-HIV-1_HeavyChain
  source 1..372: mol_type = other RNA
agacacacctgggagcagagcggctccggggtgaagaaacccggagcctctgtcagggtttcatgctggacaagtgaagacatcttcgagcggactgaactgattcattgggtgcgccaagctcctggtcagggcctcgagtggatagggtgggtaaagacggtgaccggagcagtcaaccttgccccaaattttcgacaccgtgtgagcctgacaagagatagggacttgttcactgcgcatatggatatccggggcttaacccagggtgacacagctacctacttttgtgcccgccagaaattcgaaagagggggacaaggctggtattttgatctgtggggcagggggactctaattgttgtgtcctct

SEQ ID NO: 26111 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagggtagcgaactcattcattgggtgaggcaggcacctggccaggggcttgagtggataggatgggtaaagacagtgactggcgccgtcaactttggttcctctgatttccggcagcgcgtgtcgctgacgcgagaccgtgatttgtttaccgcgcacatggacatcagagggttaacacaaggagatactgctacctacttctgtgccaggcagaaattttatgcaggcggccaggggtggtacttcgacctgtggggacggggtacactaattgttgtgtcaagc

SEQ ID NO: 26112 - RNA, 375 nt, synthetic construct
  misc_feature 1..375: note = derived and/or modified sequence opt3 from anti-HIV-1_HeavyChain
  source 1..375: mol_type = other RNA
cagagccacctggagcaatccggctctgcaatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctcttcggacttccggaatcgcatttcactgagccgagatcgtgacttgagtaccgcgcatatggatatcagaggattaacacagggcgacactgctacctatttttgtgccaggcaaaaatactatgccggtgggcagggatggtacttcgatctgtggggccggggcacactaattgtcgtgtcctct

SEQ ID NO: 26113 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaagatcgtgagcggagccgtcaactttggctcccctaatttccgccagcgagtgtctttgactcgtgatagagacttatttacggcgcacatggatattaggggtctgacccaaggggacacagctacttacttctgtgcccggcagaaatttgaacgcggaggccagggctggatcttcgatctatgggggagaggaaccctcattgcagtttcgtca

SEQ ID NO: 26114 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagttttataaaggaggccagggctggtacttcgacctgtgggggcggggaacactaattgttgtgtcaagc

SEQ ID NO: 26115 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtttacagcgcatatggatatcaggggtttaactcagggggacaccgctacatacttctgtgcccggcaaaaatttgcacgcggagatcagggctggttctttgacctgtggggcagagggaccctaattgttgtgtcttcg

SEQ ID NO: 26116 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcgcggcctggagtggatagggtgggtaaaggccgtgagcggagcggtcaactacggctccttggattttcgacaccgtgtgtctttaactagagacagggatctgttcacggctcatatggacatccggggtctaacccagggggatacagccacttatttttgtgcacgccagaaattcgaaagaggaggccaaggctggtactttgacctctgggggaggggaaccctgattgttgtgtcgtca

SEQ ID NO: 26117 - RNA, 375 nt, synthetic construct
  misc_feature 1..375: note = derived and/or modified sequence opt3 from anti-HIV-1_HeavyChain
  source 1..375: mol_type = other RNA
caggccagacccggcaccagcgggtccggagtgaagaaacctggtgcttctgtcagggtttcatgctggagtagcgaggacatcttcgaacggacagagctgattcactgggtgcgccaagcaccaggccaggggctcgaatggataggatgggtaaagactgtgacgggcgccgtcaactttggttcccttgatttccgacagcgtgtgtctctgaccagagacagggatttgtttacagcgcatatggacatccgggggttaactcagggagataccgctacatacttctgtgcccgccaaaaatttgagagaggcggccaggggtggattttcgacctgtggggaaggggtaccctaatcgcagtttcgtca

SEQ ID NO: 26118 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtttacagcgcatatggatatcaggggtttaactgaaggggacaccgctacatacttctgtgcccggcagaaatttgagcgcggaggccaaggctggattttcgatctgtgggggagaggaaccctaatcgcagtttcttcg

SEQ ID NO: 26119 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaaggccatcagcggagcggtgaactacggctccctggattttcgccaccgagtctctttgactcgtgacagagatttattcacggctcatatggacattaggggtctgacccaggatgacacagccacttatttttgtgcacggcaaaaattcgcccgcggggatcagggatggtttttcgacctatggggcagaggcaccctcatcgtggtttcgtca

SEQ ID NO: 26120 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactccggctctccaaattttcggcaccgcgtgtcgctgacgcgagatcgtgacttgttcaccgcgcatatggatatcagaggtttaacacagggggacactgctacctacttttgtgccaggcaaaagttcgaacggggaggccagggctggtattttgatctgtgggggcgcggaacactaattgttgtgtcaagc

SEQ ID NO: 26121 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagagggcagaactcattcattgggtgcggcaggcccctggtcagggccttgagtggatagggtgggtaaagacagtgagcggagcggtcaactttggctccctgaatttccgccaccgagtgtctttgactcgtgatagagacttatttacggctcatatggatatcaggggtctgacccagggggacacagccacttacttctgtgcacggcaaaaatttgcccgcggagatcagggctggttctttgacctatggggcagagggaccctcattgttgtgtcgtca

SEQ ID NO: 26122 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgtcgacggctcatatggacatcaggggtctaacccaggatgacacagccacttatttctgtgcacggcaaaaatttgcccgcggggatcagggatggttctttgacctctggggcagaggcaccctggttacagtgtcaagc

SEQ ID NO: 26123 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcctgaatttccgccaccgagtgtccttgacccgtgatagagacttatttacagcgcatatggatatcaggggtctgactcagggggacaccgctacatacttctgtgcccggcaaaaatttgaacgcggaggccagggctggtatttcgatctatgggggagaggaaccctcattgttgtgtcttcg

SEQ ID NO: 26124 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtctacagcgcatatggatatcaggggtttaactcaggacgataccgctacatacttttgtgcccggcaaaaattcgcacgcggggaccagggatggtttttcgatctgtggggcagaggcaccctaattgttgtgtcgtca

SEQ ID NO: 26125 - RNA, 375 nt, synthetic construct
  misc_feature 1..375: note = derived and/or modified sequence opt3 from anti-HIV-1_HeavyChain
  source 1..375: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagacggtaaccggggccgtgaactttggatccccaaatttccggcatcgcgtctctctgacacgagaccgtgatttgtttactgcgcacatggacatcagaggcttaacccagggtgatacagctacctatttctgtgccaggcaaaaatactatgcagggggacagggctggtactttgacctgtggggccgggggactctaattgtggtttcgtca

SEQ ID NO: 26126 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgccagcggagcggtgaactttggctccccaaatttccgccaccgagtctctctgacgcgtgatagagacttgtttaccgctcatatggatatcaggggtttaacacagggggacactgccacctacttctgtgcacggcaaaaatttgaacgcggaggccagggctggtatttcgatctgtgggggagaggaacactaattgtggtttcgtca

SEQ ID NO: 26127 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgttcacggctcatatggacatcaggggtctaacccaggatgacacagccacttatttttgtgcacggcaaaaattcgaacgcgggggacagggctggtactttgatctctggggcagagggaccctgattgttgtgtcgtca

SEQ ID NO: 26128 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcgcttccggcgtgaagagacccggggcatctgtcagggtttcatgctggaccagtgaagacatcttcgagcggagcgaactcatttactgggtgcgccaggcccctggacagggtcttgagtggataggctgggtaaaaacagtgtccggggcggtcaactttggatctactgatttccgagaacgtgtgtcgctgacgagagacagggatttgtttaccgctcatatggacatccggggcttaacacagggtgatactgccacctatttctgtgcacgccaaaagtttgagagagggggacagggctggtacttcgacctgtggggcagggggacactaattgttgtgtcaagc

SEQ ID NO: 26129 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagtcgtgaactacggctccttggattttcgccaccgagtttctttaactcgtgacagagatctgtcgacggcgcatatggacatcaggggtctaacccaggatgacacagctacttatttctgtgcccggcaaaaatttgcacgcggggatcagggatggttctttgacctctggggcagaggcaccctgattgtggtctcaagc

SEQ ID NO: 26130 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaagtcggagcttctgttagagtgtcatgctggaccagtgaagacatcttcgagaggacagaactcattcattgggtacggcaggcacccggtcagggccttgagtggatagggtgggtgaagactgtcagcggagccgtgaactttggctcccctaatttccgccaccgagtttctctgacgcgtgatagagacttgtttaccgcgcatatggatatcaggggtttaacacagggggacactgctacctacttctgtgcccggcaaaaatttgaacgcggaggccagggctggtatttcgatctgtgggggagaggaacactaattgtggtctcgtca

SEQ ID NO: 26131 - RNA, 375 nt, synthetic construct
  misc_feature 1..375: note = derived and/or modified sequence opt3 from anti-HIV-1_HeavyChain
  source 1..375: mol_type = other RNA
caggcctacctggagcaaagcggctccatcatgaagaaacccggggcttctgtgagagtctcatgctggaccagtgaagacattttcgataggacagagctcatacactgggttcggcaggcacctggacagggtcttgaatggatcggctgggtgaagactgtaacgggggccgtgaactttggaagctccgacttccgccagcgagtctctctgacccgtgatagagacttgtttacagcgcatatggatattaggggcttaactcaaggtgacaccgctacatatttctgtgcccggcagaaattttacgcagggggacagggctggtatttcgatctgtggggccgcgggaccctaatcgtggtttcgtca

SEQ ID NO: 26132 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcgagctcattcattgggtgaggcttgcacctggtcagggcctggagtggatagggtgggtaaaaacagtgactggagccgtcaactttggctcctctgatttccggcagcgcgtgtcgttgacgcgagaccgtgatttatttaccgcgcacatggacatcagaggtctgacacagggggatactgctacctacttctgtgccaggcaaaagttttatgcaggaggccagggctggtacttcgacctatgggggcggggaacactcattgttgtgtcaagc

SEQ ID NO: 26133 - RNA, 375 nt, synthetic construct
  misc_feature 1..375: note = derived and/or modified sequence opt3 from anti-HIV-1_HeavyChain
  source 1..375: mol_type = other RNA
gaggcccacctggaacagagcggctccggggtgaagaaacccggagcttctgtcagagtttcatgctggaccagtgaggacatcttcgaaaggacagagctcactcattgggtgcggcaagcacctggtcagggccttgaatggattgggtgggtaaagacggtgaccggagccgtcaactttggcagcccaaatttccgccagcgagtgtccctgacacgtgatagagacttgtttactgcgcacatggatataaggggtttaacccagggggacacagctacctacttctgtgcccggcaaaaatttgagcgcggaggccagggctggatcttcgatctgtgggggagaggaactctaattgcagtttcttcg

SEQ ID NO: 26134 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatctacgagaggacagaactcattcattgggtgcggcaggcacctggtcagggccttgagtggatagggtgggtaaaggccgtgagcggagcggtcaactatggctccctggatttccgccaccgagtgtctttgactcgtgacagagatttatttacggctcatatggacatcaggggtctgacccaggatgacacagccatttacttctgtgcacggcaaaaatttgcccgcggggatcagggatggttctttgacctatggggcagaggcactctcatcgttgtgtcgtca

SEQ ID NO: 26135 - RNA, 375 nt, synthetic construct
  misc_feature 1..375: note = derived and/or modified sequence opt3 from anti-HIV-1_HeavyChain
  source 1..375: mol_type = other RNA
caggtgcacctggagcaaagcggctccggggtcaagaaacccggagcctctgttagagtgtcatgctggaccagtgaagacatcttcgagaggacagaactcattcattgggtacggcaggctcctggtcagggccttgagtggatagggtgggtgaagactgtcacgggagcagtgaactttggcagcccaaatttccgccaccgagtttccctgacccgtgatagagacttgtttacagcccatatggatatcaggggtttaactcagggggacaccgcgacatacttctgtgctcggcaaaaatttgaacgcggaggccagggctggtatttcgatctgtgggggagaggaaccctaattgtggtctcttcg

SEQ ID NO: 26136 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaagtcggagcttctgttagagtgtcatgctggaccagtgaagacatcttcgagaggacagaactcattcattgggtacggcaggcacccggtcagggccttgagtggatagggtgggtgaaggccgtcagcggagcggtgaactacggctccctggattttcgccaccgagtttctttgactcgtgacagagatttatcgacggctcatatggacatcaggggtctgacccaggatgacacagccacttatttctgtgcacggcaaaaatttgcccgcggggatcagggatggttctttgacctatggggcagaggcaccctcattgtggtctcaagc

SEQ ID NO: 26137 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgagcggagccgtcaactttggcccaccgaatttccgccaccgagtgtccctgacgcgtgatagagacttgtttaccgcgcatatggatatcaggggtttaacacagggggacactgctacctacttctgtgcccggcaaaaatttgaacgcggaggccagggctggtatttcgatctgtgggggagaggaacactaattgttgtgtcttcg

SEQ ID NO: 26138 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgtcgacggctcatatggacatcaggggtctaacccaggatgacacagccacttatttctgtgcacggcaaaaatttgaacgcgggggacagggctggattttcgatctctggggcagagggaccctgatcgccgtttcaagc

SEQ ID NO: 26139 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgagaaagcccggagcttctgtcagggtttcatgctggaccagtgaagacatcttcgagcggacagaactcattcattgggtgcgccaggcacctggtcagggccttgagtggatagggtgggtaaaaactgtgacgggagccgtcaactttggcagctccgatttccgacagcgtgtgtctctgaccagagacagggatttgtttacagcgcacatggacatccggggtttaactcaaggggataccgctacatacttctgtgcccgccagaagttttatgcaggaggccagggctggtacttcgacctgtgggggagaggaaccctaattgttgtgtcgtca

SEQ ID NO: 26140 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcgcggcctggagtggatagggtgggtaaaggccgtgagcggagcggtcaactacggctcccctaattttcgacaccgtgtgtctttgactagagatagggacttattcacggctcatatggatatccggggtctgacccagggggacacagccacttatttttgtgcacgccagaaattcgaaagaggaggccaaggctggtactttgatctatgggggaggggaaccctcattgttgtgtcgtca

SEQ ID NO: 26141 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgagcggagccgtcaactttggctccccaaatttccgccaccgagtgtctctgacgcgtgatagagacttgtttaccgcgcatatggatatcaggggtttaacacagggggacactgctacctacttctgtgcccggcaaaaatttgaacgcggaggccagggctggtatttcgatctgtgggggagaggagcactaattgttgtgtcgtca

SEQ ID NO: 26142 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctccgcgtacttccggcaccgcgtgtctctgacgcgagatcgtgacttgtttaccgctcatatggatatcagaggtttaacacagggggacactgccacctatttctgtgcaaggcaaaagttttacaaaggaggccagggctggtatttcgatctgtgggggcggggaacactaattgttgtgtcgtca

SEQ ID NO: 26143 - RNA, 375 nt, synthetic construct
  misc_feature 1..375: note = derived and/or modified sequence opt3 from anti-HIV-1_HeavyChain
  source 1..375: mol_type = other RNA
cagagccacctggagcaatccggctctgccatgaagaaacccggggcttcagtgagagtcagttgctggaccagcgaagacatcttcgagaggacagaactcatttactgggttcggcaggcacctggacgcggtcttgagtggataggctgggtgaagactgtatccgggacggtgaactttggatctctggatttccgacatcgtgtctcgttgaccagagacagggatttatcaacagcccacatggacatccggggcctgactcaggatgacaccgcgacatatttttgtgctcgccagaaattcgccagaggtgatcaagggtggtttttcgacctatggggaaggggcaccctcattgtggttagcagt

SEQ ID NO: 26144 - RNA, 375 nt, synthetic construct
  misc_feature 1..375: note = derived and/or modified sequence opt3 from anti-HIV-1_HeavyChain
  source 1..375: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctcttcggacttccggaatcgcatttcactgagccgagatcgtgacttgagtaccgcgcatatggatatcagaggattaacacaggacgatactgctacctatttttgtgccaggcaaaaattctacgcaggcggtcaggggtggtattttgacctgtggggacggggcacactaattgtcgtgtcctct

SEQ ID NO: 26145 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgactggagcggtcaactttggcagctccgatttccgccagcgagtgtctttgacgcgtgacagagatttatttaccgctcacatggacatcaggggtctgacacaaggggatactgccacctacttctgtgcacggcagaaattttatgccggaggccagggctggtacttcgacctatgggggcgcggaacactcattgttgtgtcgtca

SEQ ID NO: 26146 - RNA, 375 nt, synthetic construct
  misc_feature 1..375: note = derived and/or modified sequence opt3 from anti-HIV-1_HeavyChain
  source 1..375: mol_type = other RNA
cagagccacctggagcaatccggctctgccatgaagaaacccggggcttcagtgagagtcagttgctggaccagcgaagacatcttcgagaggacagaactcatttactgggttcggcaggcacctggacgcggtcttgagtggataggctgggtgaagactgtatccggggccgtgaactttggatcttcggatttccgacagcgtgtctcactgacgagagacagggatttgtttaccgcgcatatggacatccggggcttaacacagggtgatactgctacctatttctgtgcccgccaaaaattttacgcagggggacagggctggtatttcgacctgtggggcagagggacactaattgtggttagcagt

SEQ ID NO: 26147 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtttacagcgcatatggatatcaggggtttaactcagggggacgctgccacctacttctgtgcacggcaaaaatttgaacgcggaggccagggctggtatttcgatctgtgggggagaggaacactaattgttgtgtcttcg

SEQ ID NO: 26148 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcgcggcctggagtggatagggtgggtaaaggccgtgagcggagcggtcaactacggctccttggattttcgacaccgtgtgtctttaactagagacagggatctgttcacggctcatatggacatccggggtctaacccaggatgacacagccacttatttttgtgcacgccagaaattctacgccgggggacaaggctggtattttgatctctggggcagagggaccctgattgttgtgtcgtca

SEQ ID NO: 26149 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagatcgtgagcggagccgtcaactttggctccccaaatttccgccagcgagtgtctctgactcgtgatagagacttgtttgcggctcacatggatattaggggtttaacgcaaggggacaccgccacatacttctgtgcacggcagaaatttgaacgcggaggccagggctggatcttcgatctgtgggggagaggaactctaattgccgtttcgtca

SEQ ID NO: 26150 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtttacagcgcatatggatatcaggggtttagctcagggggacactgccacctacttctgtgcacggcaaaaatttgaacgcggaggccagggctggtatttcgatctgtgggggagaggaacactaattgttgtgtcttcg

SEQ ID NO: 26151 - RNA, 375 nt, synthetic construct
  misc_feature 1..375: note = derived and/or modified sequence opt3 from anti-HIV-1_HeavyChain
  source 1..375: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctcttcggacttccggaatcgcatttcactgagccgagatcgtgacttgagtaccgcgcatatggatatcagaggattaacacaggacgatactgctacctatttttgtgccaggcaaaaattcgagcggggcggtcaggggtggtactttgacctgtggggacgcggcacactaattgtcgtgtcctct

SEQ ID NO: 26152 - RNA, 375 nt, synthetic construct
  misc_feature 1..375: note = derived and/or modified sequence opt3 from anti-HIV-1_HeavyChain
  source 1..375: mol_type = other RNA
cagagccacctggagcaatccggctctgcaatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcgtctcgttgacccgagatcgtgacttatttacagcgcatatggatattagaggactgactcagggcgacaccgctacatatttctgtgccaggcaaaaattttacgccggtgggcagggatggtatttcgatctatggggccggggcaccctcatcgtggtttcaagc

SEQ ID NO: 26153 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagatcgtgagcggagccgtcaactttggctccccaaatttccgccaccgagtgtctctgactcgtgatagagacttgtttacggcgcatatggatattaggggtttaacccagggggacacagctacttacttctgtgcccggcaaaaatttgaacgcggaggccagggctggtatttcgatctgtgggggagaggaaccctaatcgttgtgtcgtca

SEQ ID NO: 26154 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcgagctcattcattgggtgaggcgggcacctggtcagggccttgagtggatagggtgggtaaaaacagtgactggagccgtcaactttggctcctctgatttccgccagcgagtgtcgctgacgcgtgacagagatttgtttaccgcgcacatggacatcaggggtttaacacagggggatactgctacctacttctgtgcccggcaaaagttttatgcaggaggccagggctggtacttcgacctgtgggggcgcggaacactaattgttgtgtcaagc

SEQ ID NO: 26155 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccagcgagtgtctttaactcgtgacagagatctgttcacggctcacatggacatcaggggtctaacccaaggggatacagccacttatttttgtgcacggcagaaattcgaacgcggaggccagggctggatttttgacctctgggggagaggaaccctgatcgccgtttcgtca

SEQ ID NO: 26156 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgtcaactttggctccctggatttccgccaccgaatctctttgacgcgtgacagagatttatttaccgcgcatatggacattaggggtctgacacagggggatactgctacctacttctgtgcccggcaaaaattttataagggaggccagggctggtacttcgacctatgggggcgcggaacactcatcgtggtttcgtca

SEQ ID NO: 26157 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggaacctctgtcagagtttcatgctggacaagtgaagacatcttcgaaaagagcgagctcattcattgggtgaggcaggctcctggtcagggccttgagtggatagggtgggtaaaaactgtgacgggagcagtcaactttggctcctctgatttccggcagcgcgtgtcgctgacccgagaccgtgatttgtttacagcccacatggacatcagaggtttaactcaaggggataccgcgacatacttctgtgctaggcagaagttttatgccggaggccagggctggtacttcgacctgtgggggcggggaaccctaattgttgtgtcaagc

SEQ ID NO: 26158 - RNA, 375 nt, synthetic construct
  misc_feature 1..375: note = derived and/or modified sequence opt3 from anti-HIV-1_HeavyChain
  source 1..375: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgcatatggatatcagaggactgacacaggacgatactgctacctatttttgtgccaggcaaaaattctacgcaggcggtcaggggtggtattttgacctatggggacggggcacactcattgtcgtgagttcc

SEQ ID NO: 26159 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacaggtcttattcattgggtgcggcaggcacccggccaggggctggaatggataggatgggtaaaggccgtgagcggcgcggtcaactacggttccttggattttcgccaccgagtgtctttaactcgtgacagagatctgttcacggctcatatggacatcagggggctaacccaggatgacacagccacttatttttgtgcacggcaaaaattcgcccgcggagatcagggctggtttttcgacctctggggcagagggaccctgattgttgtgtcgtca

SEQ ID NO: 26160 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggaacctctgtcagagtttcatgctggacaagtgaagacgtgttcgagaggactgaactcatccattgggtacggcaggctcctggtcagggccttgagtggattgggtgggtgaagacggtcataggagcagtgaactttggcagcccaaatttccgccaccgagtttccctgacccgtgatagagacttgtttacagcccatatggatatcaggggtttaactcagggggacaccgcgacatacttctgtgctcggcaaaaatttgaacgcggaggccagggctggtatttcgatctgtgggggagaggaaccctaattgtggtctcttcg

SEQ ID NO: 26161 - RNA, 372 nt, synthetic construct
  misc_feature 1..372: note = derived and/or modified sequence opt3 from anti-HIV-1_HeavyChain
  source 1..372: mol_type = other RNA
caggcccacctggagcaaagcggcgctggggtgaagaaacccggagcatccgtcagagtttcttgctggacctcagaagacatcttcaagacagagctcattcattgggtgaggcaggcccctggtcagggccttgaatggatagggtgggtaaaaatcgtgagtggagcggtcaactttggcagcccaaatttccggcagcgcgtgtccctgactcgagatcgtgacttgtttacggctcacatggatattagaggtttaacccaaggggacacagccacttacttctgtgcaaggcagaagtttgagcggggaggccagggctggatcttcgatctgtgggggcgcggaaccctaattgccgtttcttcg

SEQ ID NO: 26162 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgagcggagccgtcaactttggctccccagatttccgccaccgagtgtctctgacgcgtgacagagatttgtttaccgcgcatatggacatcaggggtttaacacagggggatactgctacctacttctgtgcccggcaaaaatttgcacgcggagaccagggctggttctttgatctgtggggcagagggacactaattgttgtgtcgtca

SEQ ID NO: 26163 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagagacccggagcttctgtcagggtttcatgctggaccagtgaagacatcttcgagacaactgaactcattcattgggtgcggcaggcacctggtcagggccttgagtggatagggtgggtaaaaacggtgagcggagccgtcaactttggctccctgaatttccgccaccgaatctctttgacccgtgatagagacttatttacagcgcatatggatattaggggtctgactcagggggacaccgctacatacttctgtgcccggcaaaagtttgcacgcggagatcagggctggttctttgacctatggggcagagggaccctcatcgtggtttcgtca

SEQ ID NO: 26164 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgtcgacggctcatatggacatcaggggtctaacccaggatgacacagccatttatttctgtgcacggcaaaaatttgcccgcggggatcagggatggttctttgacctctggggcagaggcactctgatcgttgtgtcaagc

SEQ ID NO: 26165 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggactgggtgggtaaaggccgtgagcggagcggtcaactacggctccttggattttcgccaccgagtgtctttaacgcgtgacagagatctgtcgaccgctcatatggacataaggggtctaacacaggatgacactgccacctatttctgtgcacggcaaaaatttgcccgcggggatcagggatggttctttgacctctggggcagaggcacactgatcgttgtgtcaagc

SEQ ID NO: 26166 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgttcacggctcatatggacatcaggggtcctacccaggatgacacagccacttatttttgtgcacggcaaaaattcgcccgcggggatcagggatggtttttcgacctatggggcagaggcaccctcattgttgtgtcgtca

SEQ ID NO: 26167 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgtcgacggctcatatggacatcaggggtctaacccagggggatacagccacttatttctgtgcacggcaaaaatttgaacgcggaggccagggctggtacttcgacctctgggggagaggaaccctgattgttgtgtcaagc

SEQ ID NO: 26168 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgtcaactttggctccccaaatttccgccaccgagtgtctctgacgcgtgatagagacttgtttaccgcgcatatggatatcaggggtttaacacagggggacactgctacctacttctgtgcccggcaaaaatttgaacgcggaggccagggctggtatttcgatctgtgggggagaggaacactaattgttgtgtcgtca

SEQ ID NO: 26169 - RNA, 375 nt, synthetic construct
  misc_feature 1..375: note = derived and/or modified sequence opt3 from anti-HIV-1_HeavyChain
  source 1..375: mol_type = other RNA
agacacacctggaacgagagcggctccggggtgaagaaacccggagcctctgtcagggtttcatgctggacaagtgaagacatcttcgagcggactgaactgattcattgggtgcgccaggctcctggtcaaggcctcgagtggatagggtgggtaaagacggtgaccggaacagtcaattttggcagccttaacttccgacagcgtgtgtccctgactagagatagggacttgtttaccgcacacatggatatccggggtttaacacagggggacaccgccacttacttctgtgcgcgccagaaattttatgctggaggccaaggctggtacttcgatctgtgggggagaggaacactaattgttgtgtcttcg

SEQ ID NO: 26170 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggcgctggggtgaagagacccggagcatccgtcagggtttcttgctggacctcagaagacatcttcgagacaactgaactcattcattgggtgcggcaggcccctggtcagggccttgagtggatagggtgggtaaaaacggtgagtggagcggtcaactttggcagcccaaatttccgccaccgagtgtccctgacccgtgatagagacttgtttacagctcatatggatatcaggggtttaactcagggggacaccgccacatacttctgtgcacggcaaaagtttgaacgcggaggccagggctggtatttcgatctgtgggggagaggaaccctaattgttgtgtcttcg

SEQ ID NO: 26171 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaaggccgtgagcggagcggtcaactttggctccccaaatttccgccaccgagtgtctctgactcgtgatagagacttgtttacggctcatatggatatcaggggtttaacccagggggacacagccacttacttctgtgcacggcaaaaatttgaacgcggaggccagggctggtatttcgatctgtgggggagaggaaccctaattgttgtgtcgtca

SEQ ID NO: 26172 - RNA, 375 nt, synthetic construct
  misc_feature 1..375: note = derived and/or modified sequence opt3 from anti-HIV-1_HeavyChain
  source 1..375: mol_type = other RNA
caggcccacctgggcaccatcctcgggcttgagagcaagaaacccggagcttccgtgagagtctcttgctggacatcagaagacattttcgagaggactgaactgatacattgggttcggcaagcacctggtcagggcttggagtggatcgggtgggtgaagacggtaaccggagccagtattttagcgccaaactttcgccaccgagtgagcctgacacgtgatagagacctattcactgctcatatggatatcaggggcctcacccagggtgacacagccacctacttttgtgcacggcagaaattcgaacgcgggggacaaggctggtattttgatctgtggggcagagggactcttattgtcgtgtcctct

SEQ ID NO: 26173 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagcgttgtttacagctcatatggacatcaggggtttaactcagggggataccgccacatacttctgtgcacggcaaaaatttgcccgcggagaccagggctggttctttgatctgtggggcagagggaccctaattgttgtgtcttcg

SEQ ID NO: 26174 - RNA, 375 nt, synthetic construct
  misc_feature 1..375: note = derived and/or modified sequence opt3 from anti-HIV-1_HeavyChain
  source 1..375: mol_type = other RNA
agagtgcacctggagcagagcggctccggggtcaagaaacccggagcctctgttagggtgtcatgctggaccagtgaagacatcttcgagcggacagaactcattcattgggtacgccaagctcctggtcagggccttgagtggatagggtgggtgaagactgtcacgggagcagtgaactttggcagcccaaatttccgacaccgtgtttccctgaccagagatagggacttgtttacagcccatatggatatccggggtttaactcagggggacaccgcgacatacttctgtgctcgccagaaatttgaaagaggaggccaaggctggtatttcgatctgtgggggaggggaaccctaattgtggtctcttcg

SEQ ID NO: 26175 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggcgctggggtgaagaaacccggagcatccgtcagagtttcttgctggacctcagaagacatcttcgagaggacagaactcattcattgggtgcggcaggcccctggtcagggccttgagtggatagggtgggtaaagactgtgacgggagcggtcaactttggcagtccaaatttccgccagcgagtgagcctgacccgtgatagagacttgtccacagctcacatggatatcaggggtttaactcaagacgataccgccacatacttttgtgcacggcagaaattcgcccgcggggaccagggatggtttttcgatctgtggggcagaggcaccctaattgttgtgtcttcg

SEQ ID NO: 26176 - RNA, 375 nt, synthetic construct
  misc_feature 1..375: note = derived and/or modified sequence opt3 from anti-HIV-1_HeavyChain
  source 1..375: mol_type = other RNA
caggtgcaactggtccagagcggcgccgaggttaagagacccggggcttccgtgaaagtatcttgctggacctcagaagacatcttcgagaggacagaactcattcactgggtgcggcaggcacctggacagggtcttgagtggataggctgggtcaagactgtgagtggggccgttaactttggaagcccaaatttccgccatcgagtgtccctgacgcgtgatagagacttgtttaccgcgcacatggatatcaggggcttaacacaaggtgacactgctacctacttctgtgcccggcagaaatttgaacgcgggggacagggctggtatttcgatctgtggggcagagggacactaattgtcgtgtcttcg

SEQ ID NO: 26177 - RNA, 375 nt, synthetic construct
  misc_feature 1..375: note = derived and/or modified sequence opt3 from anti-HIV-1_HeavyChain
  source 1..375: mol_type = other RNA
agacacgacctggagcagagcggctccggggtgaagaaacccggagcctctgtcagggtttcatgctggaccagtgaagatatcttcgagcggacagaactcattcattgggtgcgccaagctcctggtcagggccttgagtggatagggtgggtaaagatcgtgagcggagcagtcaactttggctccccaaatttccgacagcgtgtgtctctgactagagacagggatttgtttacggcccacatggacattcggggtttaacccagggggatacagcgacttacttctgtgctcgccaaaaatttgaaagaggaggccagggctggatcttcgacctgtgggggaggggaaccctaattgccgtttcgtca

SEQ ID NO: 26178 - RNA, 375 nt, synthetic construct
  misc_feature 1..375: note = derived and/or modified sequence opt3 from anti-HIV-1_HeavyChain
  source 1..375: mol_type = other RNA
agacacacctgggaacaggtgtggagcggcgtcaagaaacccggggcctccgttagggtgtcttgctggacatcagaggacatcttcgagaagagtgaactgattcattgggtacggcaagctcctggacagggtctcgagtggataggctgggtgaaaactgtcacgggggcagtgaactttggaagctccgatttccgccagcgagtttctcttacccgtgacagagatctgtttacagcccacatggacatcaggggcttgactcagggtgataccgcgacatacttctgtgctcggcaaaagttttatgccgggggacagggctggtacttcgacttatggggccgcgggaccctgattgtggtctcgtca

SEQ ID NO: 26179 - RNA, 375 nt, synthetic construct
  misc_feature 1..375: note = derived and/or modified sequence opt3 from anti-HIV-1_HeavyChain
  source 1..375: mol_type = other RNA
agacacacctggaacaagagcggctccggggtgaaaaagcccggagcctctgtcagggtttcatgctggacaagtgaggacatcttcgaacggactgagctgattcattgggtgcgccaggctcctggtcaaggcctcgaatggatagggtgggtaaaagcagtgagcggagccgtcaattacggctcccttgattttcgacaccgtgtgtctctgacgagagacagggatttgtcgaccgcgcatatggacatccggggtttaacacaggatgacactgctacctatttctgtgcccgccagaagtttgcaagaggggatcagggatggttctttgacctgtggggcaggggcacactaattgttgtgtcaagc

SEQ ID NO: 26180 - RNA, 375 nt, synthetic construct
  misc_feature 1..375: note = derived and/or modified sequence opt3 from anti-HIV-1_HeavyChain
  source 1..375: mol_type = other RNA
agacacacctgggagcagagcggctccggggtgaagaaacccggagcctctgtcagggtttcatgctggacaagtgaagacatcttcgaaaagagcgagctgattcattgggtgcggcaagctcctggtcagggcctcgagtggatagggtgggtaaaaactgtgacgggagcagtcaactttggctcctctgatttccgccagcgagtgtcgcttacccgtgacagagatctgtttacagcccacatggacatcaggggtttgactcagggggataccgcgacatacttctgtgctcggcaaaagtttgaacgcggaggccagggctggattttcgacttatgggggagaggaaccctgatcgccgtttcaagc

SEQ ID NO: 26181 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagagacccggagcttctgtcagggtttcatgctggaccagtgaagacatcttcgagacaactgaactcattcattgggtgcggcaggcacctggtcagggccttgagtggatagggtgggtaaaagccgtgagcggagcggtcaactacggctccctggattttcgccaccgagtgtctttgacgcgtgacagagatttatcgaccgctcatatggacatcaggggtctgacacaggatgacactgccacctatttctgtgcacggcaaaagtttgcccgcggggatcagggatggttctttgacctatggggcagaggcacactcattgttgtgtcaagc

SEQ ID NO: 26182 - RNA, 375 nt, synthetic construct
  misc_feature 1..375: note = derived and/or modified sequence opt3 from anti-HIV-1_HeavyChain
  source 1..375: mol_type = other RNA
agacacgacctggagcagagcggctccggggtgaagaaacccggagcctctgtcagggtttcatgctggaccagtgaagatatcttcgagcggacagaactcattcattgggtgcgccaagctcctggtcagggccttgagtggatagggtgggtaaagactgtgacgggagcagtcaactttggcagcccaaatttccgacaccgtgtgtccctgaccagagacagggatttgtttacagcccatatggacatccggggtttaactcagggggataccgcgacatacttctgtgctcgccagaaatttgaaagaggaggccaaggctggtatttcgacctgtgggggaggggaaccctaattgttgtgtcttcg

SEQ ID NO: 26183 - RNA, 375 nt, synthetic construct
  misc_feature 1..375: note = derived and/or modified sequence opt3 from anti-HIV-1_HeavyChain
  source 1..375: mol_type = other RNA
agacacacctgggagcagagcggctccggggtgaagaaactgggagcctctgtcagggtttcatgctggacaagtgaagacatcttcgagcggactgaactcattcattgggtgcgccaagctcccggtcagggccttgagtggatagggtgggtaaaggcagtgagcggagccgtcaactacggctccctggattttcgacaccgtgtgtctttgacgagagacagggatttatcgaccgcgcatatggacatccggggtctgacacaggatgacactgctacctatttctgtgcccgccagaaatttgcaagaggggatcaaggatggttctttgacctatggggcaggggcacactcattgttgtgtcaagc

SEQ ID NO: 26184 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgcctcgcaagtgaagacatcttcgaaaagagcgagcttattcattgggtgaggcaggcccctggtcagggcctggagtggatagggtgggtaaaaaccgtgacaggagcggtcaactttggctcctctgatttccggcagcgcgtgtcgttgactcgagaccgtgatttatttacggctcacatggacatcagaggtctgacccaaggggatacagccacttacttctgtgcaaggcagaagttttatgccggaggccagggctggtacttcgacctatgggggcggggaaccctcattgttgtgtcaagc

SEQ ID NO: 26185 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggcgctggggtgaagaaacccggagcatccgtcagagtttcttgctggacctcagaagacatcttcgagaagagtgaactcattcattgggtgaggcaggcccctggtcagggccttgagtggatagggtgggtaaaaacagtgactggagcggtcaactttggcagctccgatttccggcagcgcgtgtctctgacgcgagaccgtgatttgtttaccgctcacatggacatcagaggtttaacacaaggggatactgccacctacttctgtgcaaggcagaagttttatgccggaggccagggctggtacttcgacctgtgggggcggggaacactaattgttgtgtcgtca

SEQ ID NO: 26186 - RNA, 375 nt, synthetic construct
  misc_feature 1..375: note = derived and/or modified sequence opt3 from anti-HIV-1_HeavyChain
  source 1..375: mol_type = other RNA
agacacacctgggagcagagcggctccggggtgaagaaacccggagcctctgtcagggtttcatgctggacaagtgaagacatcttcgaaaagagcgagctgattcattgggtgcggcaagctcctggtcagggcctcgagtggatagggtgggtaaaaactgtgacgggagcagtcaactttggctcctctgatttccgccagcgagtgtcgcttacccgtgacagagatctgtttacagcccacatggacatcaggggtttgactcagggggataccgcgacatacttctgtgctcggcaaaagttttatgccggaggccagggctggtacttcgacttatgggggcgcggaaccctgattgttgtgtcaagc

SEQ ID NO: 26187 - RNA, 375 nt, synthetic construct
  misc_feature 1..375: note = derived and/or modified sequence opt3 from anti-HIV-1_HeavyChain
  source 1..375: mol_type = other RNA
agacacacctgggagcagagcggctccggggtgaagaaacccggagcctctgtcagggtttcatgctggacaagtgaagacatcttcgagcggactgaactgattcattgggtgcgccaagctcctggtcagggcctcgagtggatagggtgggtaaagacggtgaccggagcagtcaactttggcagcccaaatttccgacaccgtgtgtcccttacaagagatagggacctgtttactgcccatatggatatccggggtttgacccacggggacacagcgacctacttctgtgctcgccagaaatttgaaagaggaggccagggctggtatttcgatttatgggggaggggaactctgattgttgtgtcttcg

SEQ ID NO: 26188 - RNA, 375 nt, synthetic construct
  misc_feature 1..375: note = derived and/or modified sequence opt3 from anti-HIV-1_HeavyChain
  source 1..375: mol_type = other RNA
agacacacctgggagcagagcggctccggggtgaagaaactgggagcctctgtcagggtttcatgctggacaagtgaagacatcttcgagcggactgaactcattcattgggtgcgccaagctcccggtcagggccttgagtggatagggtgggtaaaggcagtgagcggagccgtcaactacggctccctggattttcgacaccgtgtgtctttgacgagagacagggatttattcaccgcgcatatggacatccggggtctgacacagggggatactgctacctatttttgtgcccgccagaaattctacgcaggaggccaaggctggtattttgacctatgggggagaggaacactcattgttgtgtcgtca

SEQ ID NO: 26189 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggcgctggggtgaagaaactcggagcatccgtcagagtttcttgctggacctcagaagacatcttcgagaggacagaacttattcattgggtgcggcaggcccccggtcagggcctggagtggatagggtgggtaaaggcggtgagtggagctgtcaactacggcagcttggattttcgccaccgagtgtccttaactcgtgacagagatctgttcacggcccatatggacatcaggggtctaacccaggatgacacagcaacttatttttgtgcccggcaaaaattcgctcgcggggatcagggatggtttttcgacctctggggcagaggcaccctgattgttgtgtcttcg

SEQ ID NO: 26190 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcgaagtttcatgctggaccagtgaggacatcttcgaaagaacagagctcattcattgggtgaggcaggcacctggtcagggccttgaatggatagggtgggtaaagactgtgagcggagccgtcaactttggctccccaaatttccggcaccgcgtgtctctgacgcgagatcgtgacttgtttaccgcgcatatggatatcagaggtttaacacagggggacactgctacctacttctgtgccaggcaaaaatttgcacggggagatcagggctggttctttgacctgtggggccgcgggacactaattgttgtgtcgtca

SEQ ID NO: 26191 - RNA, 372 nt, synthetic construct
  misc_feature 1..372: note = derived and/or modified sequence opt3 from anti-HIV-1_HeavyChain
  source 1..372: mol_type = other RNA
caggcccacctggagcaaagcggcgctggggtgaagaaactcggagcatccgtcagagtttcttgctggacctcagaagacatcttcaagacagagcttattcattgggtgaggcaggcccccggtcagggcctggaatggatagggtgggtaaaagcggtgagtggagctgtcaactacggcagcttggattttcggcaccgcgtgtccttaactcgagaccgtgatctgtctacggcccatatggacatcagaggtctaacccaggatgacacagcaacttatttctgtgccaggcaaaagtttgctcgcggggatcagggatggttctttgacctctggggccggggcaccctgattgttgtgtcgtca

SEQ ID NO: 26192 - RNA, 375 nt, synthetic construct
  misc_feature 1..375: note = derived and/or modified sequence opt3 from anti-HIV-1_HeavyChain
  source 1..375: mol_type = other RNA
agacacacctgggagcagagcggctccggggtgaagaaacccggagcctctgtcagggtttcatgctggacaagtgaagacatcttcgagcggactgaactgattcattgggtgcgccaagctcctggtcagggcctcgagtggatagggtgggtaaagacggtgaccggagcagtcaactttggcagcccaaatttccgacaccgtgtgtcccttacaagagatagggacctgtttactgcccatatggatatccggggtttgacccagggggacacagcgacctacttctgtgctcgccagaaattttatgccggaggccaaggctggtacttcgatttatgggggagaggaactctgattgttgtgtcttcg

SEQ ID NO: 26193 - RNA, 375 nt, synthetic construct
  misc_feature 1..375: note = derived and/or modified sequence opt3 from anti-HIV-1_HeavyChain
  source 1..375: mol_type = other RNA
agacacacctgggagaggatctggagcggcgtgaagaaacccggggcctccgtccgggtttcttgctggacatcagaagacattttcgagcgcactgaactgatacattgggtgcgacaggctcctggacaaggtctcgagtggatcggctgggtaaagattgtgagtggggcagtcaactttggaagcccaaatttccgtcagagagtgtcccttacgagggatcgggacctgtttaccgcccacatggatatccgcggcttgacacagggtgacactgcgacctacttctgtgctagacagaaatttgaaaggggagggcaaggctggattttcgatttatggggccgggggacactgatcgccgtttcttcg

SEQ ID NO: 26194 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgtcgacggctcatatggacatcaggcggctaacccaggatgacacagccacttatttctgtgcacgccaaaaatttgccagaggtgatcaggggtggttctttgacctctggggaaggggcaccctgattgttgtgtcaagc

SEQ ID NO: 26195 - RNA, 375 nt, synthetic construct
  misc_feature 1..375: note = derived and/or modified sequence opt3 from anti-HIV-1_HeavyChain
  source 1..375: mol_type = other RNA
agacacaccgtggagcagagcggctccggggtcaagaaacccggagcctctgttagggtgtcatgctggacaagtgaagacatcttcgagcggactgaactgattcattgggtacgccaagctcctggtcagggcctcgagtggatagggtgggtgaagacggtcaccggagcagtgaactttggcagcccaaatttccgacaccgtgtttcccttacaagagatagggacctgtttactgcccatatggatatccggggtttgacccagggggacacagcgacctacttctgtgctcgccagaaatttgaaagaggaggccaaggctggtatttcgatttatgggggaggggaactctgattgtggtctcttcg

SEQ ID NO: 26196 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgccagaccgagatttgtttaccgcgcacatggacatccgtggtttaacacaaggggatactgctacctacttctgtgccagacagaagttttatgcaggaggccagggctggtacttcgacctgtgggggaggggaacactaattgttgtgtcaagc

SEQ ID NO: 26197 - RNA, 375 nt, synthetic construct
  misc_feature 1..375: note = derived and/or modified sequence opt3 from anti-HIV-1_HeavyChain
  source 1..375: mol_type = other RNA
agacacaccgtggagcagagcggctccggggtcaagaaagttggagcctctgtgagggtatcatgctggacaagtgaagacatcttcgagcggactgaactgattcattgggtgcgccaagctcccggtcagggcctcgagtggatagggtgggtcaaggcagtgagcggagccgttaactacggctcccttgattttcgacaccgtgtgtctctgacgagagacagggatttgttcaccgcgcatatggacatccggggtttaacacaggatgacactgctatttatttttgtgcccgccagaaattcgcaagaggggatcaaggatggtttttcgacctgtggggcaggggcaccctaatcgtcgtgtcgtca

SEQ ID NO: 26198 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctgggcaagtgaagacatcttcgagaggaccgaactcattcattgggtgcggcaggcccctggtcagggccttgagtggatagggtgggtaaagacagtgagcggagcggtcaactttggctccccaaatttccgccaccgagtgtctctgactcgtgatagagacttgtttacggctcatatggatatcaggggtttaacccagggggacacagccacttacttctgtgcacggcaaaaatttgaacgcggaggccagggctggtatttcgatctgtgggggagaggaaccctaattgttgtgtcgtca

SEQ ID NO: 26199 - RNA, 375 nt, synthetic construct
  misc_feature 1..375: note = derived and/or modified sequence opt3 from anti-HIV-1_HeavyChain
  source 1..375: mol_type = other RNA
agacacacctgggaacaggtgtggagcggcgtcaagaaacccggggcctccgttagggtgtcttgctggacatcagaggacatcttcgagcggactgaactgattcattgggtacgccaagctcctggacagggtctcgagtggataggctgggtgaagacggtcaccggggcagtgaactttggaagtccaaatttccgacaccgtgttagccttacaagagatagggacctgtttactgcccatatggatatccggggcttgacccagggtgacacagcgacctacttctgtgctcgccagaaatttgaaagagggggacaaggctggtatttcgatttatggggcagggggactctgattgtggtctcctct

SEQ ID NO: 26200 - RNA, 375 nt, synthetic construct
  misc_feature 1..375: note = derived and/or modified sequence opt3 from anti-HIV-1_HeavyChain
  source 1..375: mol_type = other RNA
agacacacctggaggcagagcggctccggggtgaagaaactgggagcctctgtccgggtttcatgctggacaagtgaggacatcttcgaacgcactgagctcattcattgggtgcgacaagctcccggtcagggccttgaatggatagggtgggtaaaggcagtgagcggagtcgtgaactacggctccctggattttcgtcacagagtttctttgacgagggaccgggatttatcgaccgcccatatggacatccgcggtctgacacaggatgacactgcgacctatttctgtgctagacagaaatttgccaggggagatcaagggtggttctttgacctatggggccggggcacactcattgtggtctcaagc

SEQ ID NO: 26201 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtggtgacatcttcgaaaggacagagctcattcattgggtgcggcaggcacctggccaggggcttgaatggataggatgggtaaagatcgtgagcggcgccgtcaactttggttccccaaatttccgccagcgagtgtctctgactcgtgatagagacttgtttacggcgcacatggatattagggggttaacccaaggagacacagctacttacttctgtgcccggcagaaatttgagcgcggcggccaggggtggatcttcgatctgtggggaagaggtaccctaattgcagtttcgtca

SEQ ID NO: 26202 - RNA, 375 nt, synthetic construct
  misc_feature 1..375: note = derived and/or modified sequence opt3 from anti-HIV-1_HeavyChain
  source 1..375: mol_type = other RNA
agacacaccgtggagcagagcggctccggggtcaagaaacccggagcctctgttagggtgtcatgctggacaagtgaagacatcttcgaaaagagcgagctgattcattgggtacggcaagctcctggtcagggcctcgagtggatagggtgggtgaaaactgtcacgggagcagtgaactttggctcctctgatttccgccagcgagtttcgcttacccgtgacagagatctgtttacagcccacatggacatcaggggtttgactcagggggataccgcgacatacttctgtgctcggcaaaagttttatgccggaggccagggctggtacttcgacttatgggggcgcggaaccctgattgtggtctcaagc

SEQ ID NO: 26203 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaaagatgggcttctgtcagggtttcatgctggaccagtgaagacatcttcgagcggacagaactcattcattgggtgcgccaggcacccggacagggtcttgagtggataggctgggtaaaggccgtgagcggggcggtcaactacggatccctggattttcgacaccgtgtgtctttgactagagacagggatttattcacggctcatatggacatccggggcctgacccaggatgacacagccacttatttttgtgcacgccaaaaattcgccagaggtgatcaggggtggtttttcgacctatggggaaggggcaccctcattgttgtgtcgtca

SEQ ID NO: 26204 - RNA, 375 nt, synthetic construct
  misc_feature 1..375: note = derived and/or modified sequence opt3 from anti-HIV-1_HeavyChain
  source 1..375: mol_type = other RNA
agacacaccgtggagcagagcggctccggggtcaagaggcccggagcctctgttcgggtgtcatgctggacaagtgaagacatcttcgagactacggaactgattcattgggtacgccaagctcctggtcagggcctcgagtggatagggtgggtgaaaaccgtcacaggagcagtgaactttggcagctccgatttccgacagcgtgtttctcttactagagacagggatctgtttaccgcccacatggacatccggggtttgacacagggggataccgcgacttacttctgtgctcgccaaaagttttatgccggaggccagggctggtacttcgacttatgggggagaggaacactgattgtggtctcgtca

SEQ ID NO: 26205 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagaggtctgttcacggctcatatggatatcagggggctaacccaggacgatacagccacttatttttgtgcacggcaaaaattcgcccgcggagaccagggctggtttttcgatctctggggcagagggaccctgattgttgtgtcgtca

SEQ ID NO: 26206 - RNA, 375 nt, synthetic construct
  misc_feature 1..375: note = derived and/or modified sequence opt3 from anti-HIV-1_HeavyChain
  source 1..375: mol_type = other RNA
caggtgcacctggagcaaagcggctccggggtcaagaaacccggagcctctgttagagtgtcatgctggaccagtgaagacatcttcgaaaagagcgagctcattcattgggtaaggcaggctcctggtcagggccttgagtggatagggtgggtgaaaacagtcactggagcagccaactttggctcctctgatttccggcagcgcgtgtcgctgacgccagaccgagatttgtttaccgcgcacatggacatccgtggtttaacacaaggggatactgctacctacttctgtgccagacagaagttttataaaggaggccagggctggtacttcgacctgtgggggaggggaacactaattgttgtgtcaagc

SEQ ID NO: 26207 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggcgctggggtgaagaaacccggagcatccgtcagagtttcttgctggacctcagaagacatcttcgatacaactgagctcattcattgggtgaggcaggcccctggtcagggccttgaatggatagggtgggtaaagatcgtgagtggagcggtcaactttggcagcccaaatttccggcagcgcgtgtccctgacgcgagaccgtgatttgtttaccgctcacatggacattagaggtttaacacaaggggatactgccacctacttctgtgcaaggcagaaatttgagcggggaggccagggctggatcttcgacctgtgggggcgcggaacactaattgccgtttcttcg

SEQ ID NO: 26208 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtagggacatcttcgaacggacagagcttattcattgggtgcgccaggcacccggtcagggcctggaatggatagggtgggtaaaggccgtgagcggagcggtcaactacggctccttggattttcgacaccgtgtgtctttaactagagacagggatctgtcgacggctcatatggacatccggggtctaacccaggatgacacagccacttatttctgtgcacgccaaaaatttgccagaggggatcagggatggttctttgacctctggggcaggggcaccctgattgttgtgtcaagc

SEQ ID NO: 26209 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgccttgcaagtgaagacatcttcgagaggaccgaactgattcattgggtgcggcaggcccccggtcagggcttggagtggatagggtgggtaaaggcggtgagcggagctgtcaactacggctccttagattttcgccaccgagtgtctctgacacgtgacagagatctatcgactgcccatatggacatcaggggtctcacgcaggatgacaccgcaacatatttctgtgcccggcaaaaatttgctcgcggggatcagggatggttctttgacctgtggggcagaggcactcttattgttgtgtcaagc

SEQ ID NO: 26210 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggcctagtgaagacatcttcgagaggaccgaactcattcattgggtgcggcaggcaccaggtcagggccttgagtggatagggtgggtaaagacagtgactggaacggtcaactttggcagcctgaatttccgccagcgagtgtccttgacccgtgatagagacttatttacagcccacatggatatcaggggtctgactcaaggggacaccgcgacatacttctgtgctcggcagaaatttgaacgcggaggccagggctggtatttcgatctatgggggagaggaaccctcattgttgtgtcttcg

SEQ ID NO: 26211 - RNA, 375 nt, synthetic construct
  misc_feature 1..375: note = derived and/or modified sequence opt3 from anti-HIV-1_HeavyChain
  source 1..375: mol_type = other RNA
agagcccacctggagcagagcggctccgaatggaagaaactcggggcttctgtgagggtctcatgctggaccagtggagacatcttcgagcggacagaacttattcattgggttcgccaagcacccggtcagggcctggagtggatagggtgggtgaaggccgtaagcggagcggtgaactacggctccttggattttcgacaccgtgtctctttaactagagacagggatctgttcacggctcatatggacatccggggtctaacccaggatgacacagccacttatttttgtgcacgccagaaattcgccagaggggatcaaggatggtttttcgacctctggggcaggggcaccctgattgtggtttcgtca

SEQ ID NO: 26212 - RNA, 375 nt, synthetic construct
  misc_feature 1..375: note = derived and/or modified sequence opt3 from anti-HIV-1_HeavyChain
  source 1..375: mol_type = other RNA
agacacaccgtggagcagagcggctccggggtcaagaaactgggagcctctgttaacgtgtcatgctggacaagtgaagacatcttcgagaggactgaactcattcattgggtacggcaagctcccggtcagggccttgagtggatagggtgggtgaaggcagtcagcggagccgtgaattacggctccctggattttcgccaccgagtttctttgacgcgtgacagagatttattcaccgcgcatatggacatcaggggtctgacacaggatgacactgctacctatttttgtgcccggcagaaattcgcacgcggggatcaaggatggtttttcgacctatggggcagaggcacactcattgtggtctcgtca

SEQ ID NO: 26213 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaccagtgacaggagccgtcaactttggctcctctgatttccggcagcgcgtgtcgctgactcgagaccgtgatttgtttacggcgcacatggacatcagaggtttaacccaaggggatacagctacttacttctgtgccaggcagaagttttatgcaggaggccagggctggtacttcgacctgtgggggcggggaaccctaattgttgtgtcaagc

SEQ ID NO: 26214 - RNA, 375 nt, synthetic construct
  misc_feature 1..375: note = derived and/or modified sequence opt3 from anti-HIV-1_HeavyChain
  source 1..375: mol_type = other RNA
agacacacctggaacaagagcggctccggggtgaaaaagcccggagcctctgtcagggtttcatgctggacaagtgaggacatcttcgaacggactgagctgattcattgggtgcgccaggctcctggtcaaggcctcgaatggatagggtgggtaaaaacggtgaccggagcagtcaattttggcagcccaaacttccgacaccgtgtgtcccttacaagagatagggacctgtttactgcccatatggatatccggggtttgacccagggggacacagcgacctacttctgtgctcgccagaagtttgagagaggaggccagggctggtatttcgatttatgggggaggggaactctgattgttgtgtcttcg

SEQ ID NO: 26215 - RNA, 375 nt, synthetic construct
  misc_feature 1..375: note = derived and/or modified sequence opt3 from anti-HIV-1_HeavyChain
  source 1..375: mol_type = other RNA
caggcccacagcgagcaatccggctctggggtgaagaaacccggagcttcagtcagagttagttgctggaccagcgaagacatcttcgagaggacagaactgattcattgggtgcggcaggcacctggtcagggcctcgagtggatagggtgggtaaagatcgtgtccggagccgtcaactttggctctccaaatttccgccagcgagtgtcgcttactcgtgatagagacctgtttacggcgcacatggatattaggggtttgacccaaggggacacagctacttacttctgtgcccggcagaaatttgaacgcggaggccagggctggatcttcgatttatgggggagaggaaccctgattgcagtttcaagc

SEQ ID NO: 26216 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggcgctggggtgaagagacccggagcatccgtcagggtttcttgctggacctcagaagacatcttcgagacaactgaactcattcattgggtgcggcaggcccctggtcagggccttgagtggatagggtgggtaaaaacggtgaccggagcggtcaactttggcagtccaaatttccgccaccgagtgagcctgacacgtgatagagacttgtttactgctcatatggatatcaggggtttaacccagggggacacagccacctacttctgtgcacggcaaaagtttgaacgcggaggccagggctggtatttcgatctgtgggggagaggaactctaattgttgtgtcctct

SEQ ID NO: 26217 - RNA, 375 nt, synthetic construct
  misc_feature 1..375: note = derived and/or modified sequence opt3 from anti-HIV-1_HeavyChain
  source 1..375: mol_type = other RNA
ggccacacctgggagcagagcggggccggagtgaagaaactgggtgcttccgtcagagtttcttgctggacatcagaagacatcttcgagaggactgaactcattcattgggtgcggcaagcacccggccaggggcttgagtggataggatgggtaaaggccgtgagtggcgcggtcaactacggtagcctggattttcgccaccgagtgtccttgacgcgtgacagagatttattcaccgctcatatggacatcagggggctgacacaggatgacactgccatttatttttgtgcacggcagaaattcgcccgcggagatcaaggctggtttttcgacctatggggcagagggaccctcatcgttgtgtcttcg

SEQ ID NO: 26218 - RNA, 375 nt, synthetic construct
  misc_feature 1..375: note = derived and/or modified sequence opt3 from anti-HIV-1_HeavyChain
  source 1..375: mol_type = other RNA
ggcacccccgggagcgagtccggatctggtgtgaagaaactgggcgcctcagtcagagttagttgctggacaagcgaagacatcttcgagaggactgaactcattcactgggtgcggcaggctcctgggcaaggacttgagtggataggctgggtaaaggcagtgtccggtgccgtcaactacgggtctctggattttcgccatcgagtgtcgttgacgcgtgacagagatttatcaaccgcgcacatggacatcaggggactgacacaggatgacactgctacctatttctgtgcccggcagaaatttgcacgcggcgatcagggctggttctttgacctatgggggagaggaacactcattgttgtgagcagt

SEQ ID NO: 26219 - RNA, 375 nt, synthetic construct
  misc_feature 1..375: note = derived and/or modified sequence opt3 from anti-HIV-1_HeavyChain
  source 1..375: mol_type = other RNA
ggcacccccgggagcgagtccggatctggtgtgaagatgcctggcgcctcagtcagagttagttgctggacaagcgaagacatcttcgagaggactgaactgattcactgggtgcggcaggctccagggcaaggactcgagtggataggctgggtaaaaacggtgtccggtgcagtcaactttgggtctccgaatttccgccatcgagtgtcgcttacccgtgatagagacctgtttacagcccacatggatatcaggggattgactcagggcgacaccgcgacatacttctgtgctcggcagaagtttgaacgcggcgggcagggatggtatttcgatttatggggtagaggcaccctgattgttgtgtcaagc

SEQ ID NO: 26220 - RNA, 375 nt, synthetic construct
  misc_feature 1..375: note = derived and/or modified sequence opt3 from anti-HIV-1_HeavyChain
  source 1..375: mol_type = other RNA
agacacacctgggagcagagcggcgccggggtgaagaaacccggagcttccgtcagggtttcttgctggacatcagaagacatcttcgagcggactgaactgattcattgggtgcgccaagcacctggtcagggcctcgagtggatagggtgggtaaagacggtgagtggagccgtcaactttggcagcccaaatttccgacaccgtgtgtcccttaccagagatagggacctgtttacagcgcatatggatatccggggtttgactcagggggacaccgctacatacttctgtgcccgccagaaatttgaaagaggaggccaaggctggtatttcgatttatgggggaggggaaccctgattgttgtgtcttcg

SEQ ID NO: 26221 - RNA, 375 nt, synthetic construct
  misc_feature 1..375: note = derived and/or modified sequence opt3 from anti-HIV-1_HeavyChain
  source 1..375: mol_type = other RNA
ggcacccccgggaacaagagcggatccggtgtgaaaaagcctggcgcctctgtcagagtttcatgctggacaagtgaggacatcttcgagaaaagcgaactgattcactgggtgaggcaggctccagggcaaggactcgaatggataggctgggtaaagactgtgacgggtgcagtcaattttgggtcctctgatttccggcagcgcgtgtcgcttacccgagaccgtgatctgtttacagcccatatggacatcagaggattgactcagggcgataccgcgacatacttctgtgctaggcagaaattttatgccggcgggcaaggatggtacttcgacttatggggtcggggcaccctgattgttgtgtcaagc

SEQ ID NO: 26222 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggcgctggggtgaagaaacccggagcatccgtcagagtttcttgctggtcaagtgaagacatcttcgagaggaccgaactcattcattgggtgcggcaggcccctggtcagggccttgagtggatagggtgggtaaagacagtgactggagcggtcaactttggcagcccaaatttccgccaccgagtgtccctgacgcgtgatagagacttgtttaccgctcatatggatatcaggggtttaacacagggggacactgccacctacttctgtgcacggcaaaaatttgaacgcggaggccagggctggtatttcgatctgtgggggagaggaacactaattgttgtgtcttcg

SEQ ID NO: 26223 - RNA, 375 nt, synthetic construct
  misc_feature 1..375: note = derived and/or modified sequence opt3 from anti-HIV-1_HeavyChain
  source 1..375: mol_type = other RNA
ggcacccccgggaacaagagcggatccggtgtgaaaaagcctggcgcctctgtcagagtttcatgctggacaagtgaggacatcttcgaaaggactgagctgattcactgggtgcggcaggctccagggcaaggactcgaatggataggctgggtaaaaacggtgaccggtgcagtcaattttgggagcccgaacttccgccatcgagtgtcccttacacgtgatagagacctgtttactgcccacatggatatcaggggattgacccagggcgacacagcgacctacttctgtgctcggcagaagtttgagcgcggcgggcagggatggattttcgatttatggggtagaggcactctgatcgccgtttcttcg

SEQ ID NO: 26224 - RNA, 375 nt, synthetic construct
  misc_feature 1..375: note = derived and/or modified sequence opt3 from anti-HIV-1_HeavyChain
  source 1..375: mol_type = other RNA
ggcacccccgggaacaagagcggatccggtgtgaaaaagcctggcgcctctgtcagagtttcatgctggagtagcgaggacatcttcgaaaggacagagctgattcactgggtgcggcaggctccagggcaaggactcgaatggataggctgggtaaaaactgtgacgggtgcagtcaattttgggtcccttgatttccgccatcgaatctctctgacccgtgacagagatttgtttacagcccacatggacattaggggattaactcagggcgataccgcgacatacttctgtgctcggcagaagtttgagcgcggcgggcagggatggatcttcgacctgtggggtagaggcaccctaattgccgtgtcgtca

SEQ ID NO: 26225 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcgcttccggcgtgaagagacccgggggatgggtcagggtttcttgctggacctcagaagacatcttcgagcggagtgaactcatttactgggtgcgccaggcacctggtcagggccttgagtggatagggtgggtaaaaacagtgactggagccgtcaactttggcagcccaaatttccgacatcgtgtgtccctgacgagagatagggacttgtttaccgcgcacatggatatccggggtttaacacagggggacactgctacctatttctgtgcccgccaaaagtttgaaagaggaggccagggctggtacttcgatctgtgggggaggggaacactaattgttgtgtcttcg

SEQ ID NO: 26226 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactagctccggagccgtgaactttggctctccaaatttccgcacgcgagtctcgctgacccgtgatagagacttgtttacagcgcacatggatatcaggggtttaactcagggggacaccgctacatacttctgtgcccggcaaaaatttgaacgcggaggccagggctggtatttcgatctgtgggggagaggaaccctaattgtggtttcaagc

SEQ ID NO: 26227 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggcgctggggtgaagaaacccggagcatccgtcagagtttcttgctggacctcagaagacatcttcgagaggacagaactcattcattgggtgcggcaggcccctggtcagggccttgagtggatagggtgggtaaagactgtgagtggagcggtcaactttggcagcccaaatttccgccaccgagtgtccctgacgcgtgatagagacttgtttaccgctcatatggatatcaggggtttaacacagggggacactgccacctacttctgtgcacggcaaaaatttgaacgcggaggccagggctggtatttcgatctgtgggggagaggaacactaattgttgtgtcttcg

SEQ ID NO: 26228 - RNA, 375 nt, synthetic construct
  misc_feature 1..375: note = derived and/or modified sequence opt3 from anti-HIV-1_HeavyChain
  source 1..375: mol_type = other RNA
agacacacctgggagcagagcggctccggggtgaagaaacccggagcctctgtcagggtttcatgctggacaagtgaagacatcttcgagcggactgaactgattcattgggtgcgccaagctcctggtcagggcctcgagtggatagggtgggtaaagacggtgaccggagcagtcaactttggcagcccaaatttccgacaccgtgtgtcccttacaagagatagggacctgtttactgcccatatggatatccggggtttgacccagggggacacagcgacctacttctgtgctcgccagaaatttgaaagaggaggccaaggctggtatttcgatttatgggggaggggaactctgattgttgtgtcttcg

SEQ ID NO: 26229 - RNA, 375 nt, synthetic construct
  misc_feature 1..375: note = derived and/or modified sequence opt3 from anti-HIV-1_HeavyChain
  source 1..375: mol_type = other RNA
ggcaccacatggaacaagagcgggtccggagtgaaaaagcccggtgcctctgtcagagtttcatgctggacgagtgaggacatcttcgaaaggactgagctgattcactgggtgcggcaggctcctggccaagggctcgaatggataggatgggtaaaaaccgtgacaggcgcagtcaattttggtagcccaaacttccgccatcgagtgtcccttactcgtgatagagacctgtttaccgcccacatggatatcagggggttgacacagggagacaccgcgacttacttctgtgctcggcagaagtttgagcgcggcggccaggggtggtatttcgatttatggggaagaggtacactgattgttgtgtcttcg

SEQ ID NO: 26230 - RNA, 375 nt, synthetic construct
  misc_feature 1..375: note = derived and/or modified sequence opt3 from anti-HIV-1_HeavyChain
  source 1..375: mol_type = other RNA
agacacacctggaacgagagcggctccggggtgaagaaacccggagcctctgtcagggtttcatgctggacaagtgaagacatcttcgaaaagagcgagctgattcattgggtgcggcaggctcctggtcaaggcctcgagtggatagggtgggtaaaaactgtgacgggagcagtcaattttggctcctctgatttccgccagcgagtgtcgcttacccgtgacagagatctgtttacagcccacatggacatcaggggtttgactcagggggataccgcgacatacttctgtgctcggcagaagttttatgccggaggccaaggctggtacttcgacttatgggggcgcggaaccctgattgttgtgtcaagc

SEQ ID NO: 26231 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtggtaacatcttcgaaaggacagagcttattcattgggtgcggcaggcacccggccaggggctggaatggataggatgggtaaaggccgtgagcggcgcggtcaattacggttccttggactttcgccaccgagtgtctttaactcgtgatagagacctgtcgacggctcatatggatatcagggggctaacccaggacgatacagccacttatttctgtgcacggcaaaaatttgcccgcggagaccagggctggttctttgatctctggggcagagggaccctgattgttgtgtcaagc

SEQ ID NO: 26232 - RNA, 378 nt, synthetic construct
  misc_feature 1..378: note = derived and/or modified sequence opt3 from anti-HIV-1_HeavyChain
  source 1..378: mol_type = other RNA
agatgcagcatggagcagcccggctggtccgaaaagcctggggcctctgtgaccctgtcatgtaaaacagctgacgaggatgtcttcgacgcagcctacatgcactgggttaggcaagcgccaggacagacttttgaatggctcggttggatgaagccggtgacgggcgctgtaagttatgcccggaaattccaggggcgcgtgagcttttacatgacccgagagcttggaatggcatatatggatctgcgtaacttgagattcgacgatacagccgtctacttttgcgctaggaagactgcaggcgacgtgtccggtgataatcgggggtatttctttgacttatggggacgcggctctagagttatcgtgtcgtca

SEQ ID NO: 26233 - RNA, 375 nt, synthetic construct
  misc_feature 1..375: note = derived and/or modified sequence opt3 from anti-HIV-1_HeavyChain
  source 1..375: mol_type = other RNA
agacacaccagcgagcagtccggctctggggtgaagaaacccggagcctcagtcagggttagttgctggacaagcgaagacatcttcgagcggtccgaactgattcattgggtgcgccaagctcctggtcagggcctcgagtggatagggtgggtaaagactgtgacgggagcagtcaactttggctctccaaatttccgacaccgtgtgtcgcttaccagagatagggacctgtttacagcccatatggatatccggggtttgactcagggggacaccgcgacatacttctgtgctcgccagaaatattacgccggaggccaaggctggtattttgatttatgggggagaggaaccctgattgttgtgtcaagc

SEQ ID NO: 26234 - RNA, 375 nt, synthetic construct
  misc_feature 1..375: note = derived and/or modified sequence opt3 from anti-HIV-1_HeavyChain
  source 1..375: mol_type = other RNA
agacacaccgtggagcagagcggcgccggggtcaagaaacccggagcttccgttagggtgtcttgctggacatcagaagacatcttcgagcggactgaactgattcattgggtacgccaagcacctggtcagggcctcgagtggatagggtgggtgaagacggtcagtggagccgtgaactttggcagcccaaatttccgacaccgtgtttcccttaccagagatagggacctgtttacagcgcatatggatatccggggtttgactcagggggacaccgctacatacttctgtgcccgccagaaatttgaaagaggaggccaaggctggtatttcgatttatgggggaggggaaccctgattgtggtctcttcg

SEQ ID NO: 26235 - RNA, 375 nt, synthetic construct
  misc_feature 1..375: note = derived and/or modified sequence opt3 from anti-HIV-1_HeavyChain
  source 1..375: mol_type = other RNA
ggcaccccctggaacgagagcgggtccggagtgaagaaacctggtgcctctgtcagagtttcatgctggacaagtgaagacatcttcgaaaagagcgagctgattcactgggtgaggcaggctccaggccaagggctcgagtggataggatgggtaaaaactgtgacgggcgcagtcaattttggttccccgaacttccggcatcgcgtgtctcttacccgagatcgtgacctgtttacagcccacatggatatcagagggttgactcagggagacaccgcgacatacttctgtgctaggcagaagtttgaacggggcggccaggggtggtatttcgatttatggggacgcggtaccctgattgttgtgtcgtca

SEQ ID NO: 26236 - RNA, 375 nt, synthetic construct
  misc_feature 1..375: note = derived and/or modified sequence opt3 from anti-HIV-1_HeavyChain
  source 1..375: mol_type = other RNA
agacacgacctggagcccagcggctccggggtgaagaaacctggagcctctgtcagggtttcatgctggaccagtgaagatatcttcgagcggacagaactcattcattgggtgcgccaggctccaggtcaaggccttgagtggatagggtgggtaaagactgtgacgggagcagtcaactttggcagcctggacttccgacaccgtatctccttgaccagagatagggacttatttacagcccatatggatattcggggtctgactcagggggacaccgcgacatacttctgtgctcgccagaaatttgaatctagatataccggaggccagggctggtacttcgatctatgggggaggggaactcacatcgtg

SEQ ID NO: 26237 - RNA, 375 nt, synthetic construct
  misc_feature 1..375: note = derived and/or modified sequence opt3 from anti-HIV-1_HeavyChain
  source 1..375: mol_type = other RNA
agacacaccgtggagcagagcggctccggggtcaagaaactgggagcctctgttagggtgtcatgcctcgctagtgaagacatcttcgagcggacagaacttattcattgggtacgccaagcacccggtcagggcctggagtggatagggtgggtgaaggccgtcagcggagcggtgaactacggctccttggattttcgacaccgtgtttctttaactagagacagggatctgtcgacggctcatatggacatccggggtctaacccaggatgacacagccacttatttctgtgcacgccagaaatttgccagaggggatcaaggatggttctttgacctctggggcaggggcaccctgattgtggtctcaagc

SEQ ID NO: 26238 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccgaatctaagaaacccggggcttcagtgagagtcagttgctggaccagcgaggacatcttcgaaaagtccgagctcattcattgggttaggcaggcacctggacagggtcttgaatggataggctgggtgaaaacagtaactggggccgtgaactttggatcttcggatttccggcagcgcgtctcactgacgcgagaccgtgatttgtttaccgcgcacatggacatcagaggcttaacacaaggtgatactgctacctacttctgtgccaggcagaagttttatgcagggggacagggctggtacttcgacctgtggggccgggggacactaattgtggttagcagt

SEQ ID NO: 26239 - RNA, 375 nt, synthetic construct
  misc_feature 1..375: note = derived and/or modified sequence opt3 from anti-HIV-1_HeavyChain
  source 1..375: mol_type = other RNA
ggcacccccgggagcgagtccgcctctggagtgagaaggcctggtgcttcagtccgggttagttgctggacaagcgaagacatcttcgagcgctccgaactgatttactgggtgcgacaggcaccaggccgtgggctcgagtggataggatggatcaaacttgtatctggcgccgtgaactttggttcggtcgatttcagagacagggtgtcactgactcgggatcgcgacttgtttacggcgcacatggatattagagggttaacccaaggagacacagctacttatttctgtgccaggcagaagtttgaacggggcggccaggggtggtacttcgatctgtggggacgcggtaccctaatcgttgtgagcagt

SEQ ID NO: 26240 - RNA, 375 nt, synthetic construct
  misc_feature 1..375: note = derived and/or modified sequence opt3 from anti-HIV-1_HeavyChain
  source 1..375: mol_type = other RNA
caggtgcacctggagcaaagcggctccggggtcaagaaacccggagcctctgttagagtgtcatgctggaccagtgaagacatcttcgaaaagagcgagctcattcagtgggtaaggcaggctcctggtcagggccttgagtggatagggtgggtgaaaacagtcactggagcagtgaactttggctcctctgatttccggcaacgcgtttcgctgacgcgagaccgtgatttgtttaccgcccatatggacatcagaggtttaacacagggggatactgcgacctacttctgtgctaggcagaagttttatgccggaggccagggctggtacttcgacctgtgggggcggggaacactaattgtggtctcaagc

SEQ ID NO: 26241 - RNA, 375 nt, synthetic construct
  misc_feature 1..375: note = derived and/or modified sequence opt3 from anti-HIV-1_HeavyChain
  source 1..375: mol_type = other RNA
ggcacccccgggagcgagtccggatctggtgtgaagaaagtcggcgcctcagttagagtgagttgctggacaagcgaagacatcttcgagaggactgaactgattcactgggtacggcaggctcctgggcaaggactcgagtggataggctgggtgaaggcagtctccggtgccgtgaactacgggtctcttgattttcgccatcgagtttcgctgacgcgtgacagagatttgttcaccgcgaggatggacatccggggattaacacaggatgacactgctatttatttttgtgcccgccagaaattcgcaagaggcgatcagggctggtttttcgacctgtgggggaggggaaccctaatcgtggtctcaagc

SEQ ID NO: 26242 - RNA, 375 nt, synthetic construct
  misc_feature 1..375: note = derived and/or modified sequence opt3 from anti-HIV-1_HeavyChain
  source 1..375: mol_type = other RNA
ggcacccccgggagcgagtccggatctggtgtgaagagacctggcgcctcagtcagggttagttgctggacaagcgaagacatcttcgagactacggaactgattcactgggtgcggcaggctccagggcaaggactcgagtggataggctgggtaaaaaccgtgtccggtgcagtcaactttgggtctcttaatttccgccatcgagtgtcgctgacacgtgatagagacttgtcaactgcccacatggatatcaggggattaacccaggacgatacagcgacctacttttgtgctcggcagaagttcgcccgcggcgaccagggctggtttttcgatctgtgggggagaggaactctaattgttgtgagcagt

SEQ ID NO: 26243 - RNA, 372 nt, synthetic construct
  misc_feature 1..372: note = derived and/or modified sequence opt3 from anti-HIV-1_HeavyChain
  source 1..372: mol_type = other RNA
agagcccacctggagcagagcggcgctggggtgaagaaacccggaggttgggtcagggtttcctgctggacctctgaagacatcttcaagacagagctcattcattgggtgcggcaagcacctggccaggggcttgaatggataggatgggtaaaaactgtgacgggcgccgtcaactttggttcaccaaatttccgccaccgagtgagtctgacccgtgatagagacttgtttacagcgcatatggatatcagggggttaactcagggagacaccgctacatacttctgtgcccggcagaagtttgagcgcggcggccaagggtggtatttcgatctgtggggaagaggtaccctaattgttgtgagctcc

SEQ ID NO: 26244 - RNA, 378 nt, synthetic construct
  misc_feature 1..378: note = derived and/or modified sequence opt3 from anti-HIV-1_HeavyChain
  source 1..378: mol_type = other RNA
caggtgcaactgatgcagagcggcgccgaggtcaagagacccggggcttccgttaaaatctcttgcaccgcatcaggattcacactcactgaccactacatgcattgggtgaggcaggcccctggtcagacgtttgaatggcttggctggatgaagccagtaaccggggcggtgaactatgctcggaaattccaaggacgcgtcagtttttaccgaacacgtgagctgggcattgcctatatggatttgagaaatttaaggttcgacgatactgcagtgtacttttgtgcccggaagaccgctggtgacgttagcggggataaacgcggattctttttcgacctgtggggcagaggctccagggtgatagtctcttcg

SEQ ID NO: 26245 - RNA, 378 nt, synthetic construct
  misc_feature 1..378: note = derived and/or modified sequence opt3 from anti-HIV-1_HeavyChain
  source 1..378: mol_type = other RNA
caggtgcaactggtccagagcggcgccgaggttaagaaacccggggcttccgtgaaggtatcttgcaaagcatcaggatacaacttcaccggttattacctccactgggtgagacaggcccctggccagacatttgaatggcttgggtggatgaagccagtcactggagcggtgagttatgctaggaaattccaaggccgggttagcttttacatgacgcgcgagctgggtatggcctatatggacttgcgaaatttacgtttcgatgacaccgcagtgtacttttgtgccagaaagacagctggggatgtctccggagacaacaggggctatttctttgatctgtggggccgggggtctcgcgtgatcgtatcgtca

SEQ ID NO: 26246 - RNA, 375 nt, synthetic construct
  misc_feature 1..375: note = derived and/or modified sequence opt3 from anti-HIV-1_HeavyChain
  source 1..375: mol_type = other RNA
ggcacccccgggagcaagtccggatctggtgtgaaaaagcctggcgcctcagtcagagttagttgctggacaagcgaggacatcttcgaaaggactgagctgattcactgggtgcggcaggctccagggcaaggactcgaatggataggctgggtaaaaacggtgaccggtgcagtcaactttgggtccccgaatttccgccatcgagtgtctcttacacgtgatagagacctgtttactgcccacatggatatcaggggattgacccagggcgacacagcgacctacttctgtgctcggcagaagtttgagcgcggcgggcagggatggtatttcgatttatggggtagaggcactctgattgttgtgtcgtca

SEQ ID NO: 26247 - RNA, 378 nt, synthetic construct
  misc_feature 1..378: note = derived and/or modified sequence opt3 from anti-HIV-1_HeavyChain
  source 1..378: mol_type = other RNA
caggtgcaactggtccagagcggcgccgagctcaagaaacccggggcttccgttaaggtgtcttgcgaagcatcaggatacagtttcaccgaccaccatatccactgggtaagacaggcccctggtcagggccttgagtggctggggtggatgaacccaaataacggagatacagcgtatgctcaaacgtttttgggcagggtgactatgacccgggacacaagcattaatactgcctacatggaattatcccgcctgacctctgatgacacagcagtctatttctgtgcccgaaaaaccgctggtgatgtgtcgggggacaagcgtggatttttctttgatctatggggcagaggctcaagggttatagtgagcagt

SEQ ID NO: 26248 - RNA, 378 nt, synthetic construct
  misc_feature 1..378: note = derived and/or modified sequence opt3 from anti-HIV-1_HeavyChain
  source 1..378: mol_type = other RNA
caggtgtacatgagctccagaggcgggatgaagaaacccggagcctctatgaccgtctcatgcaagacagctgacgaggatatcttcgacgcagcctatatgcactgggttaggcaagcgcctggtcagacttttgaatggctgggctggatgaaaccagtgacgggggctgtaaactacgcccggcagttccagggacgcgtgagtttttatcgaacccgtgagctcggcattgcatacatggatcttagagacctgaagttcgatgacacagccgtctatttttgtgctaggaaaactaagggtgatgtgagcggggacgatcggggattctttttcgacttgtggggccgcggcaccagagttatagtgtcctct

SEQ ID NO: 26249 - RNA, 378 nt, synthetic construct
  misc_feature 1..378: note = derived and/or modified sequence opt3 from anti-HIV-1_HeavyChain
  source 1..378: mol_type = other RNA
caggtgcaactggtccagagcggcgccgaggttaagaaacccggggcttccgtgaaggtatcttgcaaagcatcaggatacaccttcacagcctattacatgcactggctcagacaggcgcctggtcagggccttgaatggatggggtggatcaacccacatagtggaggcactaattttgctcaaaagttccagggtagggtgacgatgacccgggacacaagcattactaccgcctatatggagctgtcccgcttgcgatctgatgacacagcaacctacttttgtgcccgtcagaaattcgcttcgagatattcaggggatcagggaagctactttgacttatggggcaggggcactctgatagtcgtgagttcc

SEQ ID NO: 26250 - RNA, 375 nt, synthetic construct
  misc_feature 1..375: note = derived and/or modified sequence opt3 from anti-HIV-1_HeavyChain
  source 1..375: mol_type = other RNA
agagcccacctggagcagagcggcgctggggtgaagaaactcggagcatccgtcagggtttcttgctggacctcagaagacatcttcgagcggacagaacttattcattgggtgcgccaagcccccggtcagggcctggagtggatagggtgggtaaaggcggtgagtggagctgtcaactacggcagcttggattttcgacaccgtgtgtccttaactagagacagggatctgttcacggcccatatggacatccggggtctaacccaggatgacacagcaacttatttttgtgcccgccagaaattcgctagaggggatcaaggatggtttttcgacctctggggcaggggcaccctgattgttgtgtcttcg

SEQ ID NO: 26251 - RNA, 378 nt, synthetic construct
  misc_feature 1..378: note = derived and/or modified sequence opt3 from anti-HIV-1_HeavyChain
  source 1..378: mol_type = other RNA
caggtgagactggtccaaagcggcgccgacgttaagcagcccggggcttccgtgaaagtatcttgcaaggcatcaggatacaccttcacagattattacatgcactgggtgaggcaggcccctggtcagacttttgagtggctcggctggatgaaaccagtcacgggggcggtgagttatgctcggaagttccaaggacgcgttagcttttacatgacccgagaacttggcatggcctatatggacctgcgtaacttgagattcgatgacacagcagtgtacttttgtgccaggaaaactgctggtgatgtctccggggacaatcggggatatttctttgatttatggggccgcggctctagagtgatcgtatcgtca

SEQ ID NO: 26252 - RNA, 378 nt, synthetic construct
  misc_feature 1..378: note = derived and/or modified sequence opt3 from anti-HIV-1_HeavyChain
  source 1..378: mol_type = other RNA
caggcccacctgggcaacaagagcgggtccggagtgaaaaagcccggtgcttctgtcagagtttcatgctggaccagtgaggacatcttcgagaaaagcgaactcattcattgggtgaggcaagcacctggccaggggcttgaatggataggatgggtaaagacagtgactggcgccgtcaattttggttcctctgatttccggcagcgcgtgtcgctgacgcgagaccgtgatttgtttaccgcgcacatggacatcagagggttaacacagggagatactgctacctacttctgtgccaggcaaaaattttatgcaggcggccaggggtggtacttcgacctgtggggacggggtacactaattgttgtgtcaagc

SEQ ID NO: 26253 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaaagcggcgggggagtcaagaaacccggtgcctccgttaccctgtcttgcaagacagctgacgaagatgtgttcgacgcagcctatatgcactgggtaagacaggcgcctggccagacttttgagtggctcgggtggatgaaaccagtgacgggagctgtcaactacgccaggaagttccagggccgggtgtcattttatcgcacccgagaacttggtatcgcatacatggatctgcgtaatttgagattcgacgatacagccgtttatttttgtactaggaaaaccgctggggacgtgagtggagataagcggggcttctttttcgacttatggggccgcgggagcagagtcattgtgtcctct

SEQ ID NO: 26254 - RNA, 381 nt, synthetic construct
  misc_feature 1..381: note = derived and/or modified sequence opt3 from anti-HIV-1_HeavyChain
  source 1..381: mol_type = other RNA
caggtgtacgtcgagcaacccggcgggggagttaagaaacctggtgccagcgtgaccctgtcctgcaagacagctgacgaagatgtattcgacgcaacttatatgcactgggtgagacaggccccaggccagacgtttgagtggctcgggtggatgaaaccggtcaccggagcggtgaactacgctaggaagttccagggccgggtttctttttatcgcacacgagaacttggtatcgcctacatggatctgcgtaatttgagattcgacgatactgcagtgtatttttgtgccaggaaaaccgctggggacgtctcaggagataagcggggcttctttttcgacttatggggccgcgggagtagagtgattgtaagctcc

SEQ ID NO: 26255 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgtcgaagttgagaagcccggggctagcgtgaccctgtcctgcaaaacagcagacgaagatgtattcgacgccgcgtatatgcactgggtgagacaggctcctggacagacttttgagtggctcggttggatgaagccagtcacgggcgccgtgtcttacgcaaggaaattccaggggcgggtttcattttatatgacccgcgaacttggaatggcctacatggatctgcgaaacttgcgtttcgacgatacagctgtgtatttttgtgcaagaaagactgccggcgacgtcagtggtgataatagggggtacttctttgacttatggggacggggcagccgcgtgatcgtatcctct

SEQ ID NO: 26256 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgctggggtcaagaaacccggagcaagcgttaccctgtcctgcaagacagccgacgaagatgtgttcgacgcggcttatatgcactgggtaagacaggcccctggtcagacttttgagtggctcggctggatgaaaccagtgacgggggcagtctcttacgccaggaagttccagggacgggtgtcattttatatgacccgcgaacttggcatggcttacatggatctgcgaaacttgcgtttcgacgatacagcagtttatttttgtgccagaaaaactgctggtgacgtgagtggggataataggggatacttctttgacttatggggccggggcagccgcgtcatcgtgtcctct

SEQ ID NO: 26257 - RNA, 381 nt, synthetic construct
  misc_feature 1..381: note = derived and/or modified sequence opt3 from anti-HIV-1_HeavyChain
  source 1..381: mol_type = other RNA
caggtgcacatggagcaagccggcgctggggtcaagaaacccggagcaagcgttaccctgtcctgcaagacagccgacgaagatgtgttcgacgcggcttacatgcattgggtaagacaggcccctggtcagacttttgagtggctcggctggatgaaaccagtgacgggggcagtcaactatgccaggaagttccagggacgggtgtctttttaccgcacccgagaacttggcatcgcttatatggatctgcgtaatttgagattcgacgatacagcagtttacttttgtgccaggaaaactgctggtgacgtgtcaggggataagcggggattctttttcgacttatggggccgcggcagtagagtcattgtgagctcc

SEQ ID NO: 26258 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgctgaagtcaagaaacccggggcaagcgttaccctgtcctgcgagacagccgacgaagatgtgttcgacgcggcttatatgcactgggtaagacaggcccctggacagacttttgagtggctcggttggatgaagccagtgacgggcgcagtcaactacgccaggaaattccaggggcgggtgtctttttatcgcacccgagaacttggaatcgcttacatggatctgcgtaatttgagattcgacgatacagcagtttatttttgtgccaggaagactgctggcgacgtgtcaggtgataaacgggggttctttttcgacttatggggacgcggcagtagagtcattgtgagctcc

SEQ ID NO: 26259 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaacccggcgggggagtcaagaaacctggtgccagcgttaccctgtcctgcaagacagctgacgaagatgtgttcgacgcagcctatatgcactgggtaagacaggcgccaggccagacttttgagtggctcgggtggatgaaaccggtgacgggagctgtcaactacgccaggaagttccagggccgggtgtctttttatcgcacccgagaacttggtatcgcatacatggatctgcgtaatttgagattcgacgatacagccgtttatttttgtgctaggaaaactgcaggggacgtgtcaggagataagcggggcttctttttcgacttatggggccgcgggagtagagtcattgtgagctcc

SEQ ID NO: 26260 - RNA, 372 nt, synthetic construct
  misc_feature 1..372: note = derived and/or modified sequence opt3 from anti-HIV-1_HeavyChain
  source 1..372: mol_type = other RNA
gccaccccctggaacaagagcggctccggggtgaaaaagcctggagcttctgtcagagtttcatgctggacaagtgaggacatcttcgaaaggactgagctgagcctcgtgcggcaggcaccaggtcaaggccttgaatggattgggtggatgaaaacggtaaccggagccgtgaattttggctccccgaacttccgccacggtgtctctctgacacgagatcgtgacttgtttactgcgcatatggatataagagggttaacccagggagacacagctacctacttctgtgccaggcagaagtttgagcggggcggccaggggtggtatttcgatctgtggggacgcggtactctaatcgtggtttcgtca

SEQ ID NO: 26261 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgctgggatgaagaaacccggagcaagcatgaccgcctcctgcaagacagcggacgaagatatcttcgacgctgcctatatgcactgggtcagacaggcacctggtcagacttttgagtggctgggctggatgaaaccagttacgggggccgtgaactacgctaggcagttccaaggacgggtatctttttatcgcacccgagaactcggcattgcatacatggatcttcgtgacctgaagttcgatgacacagccgtgtatttttgtgctagaaaaactaagggtgatgtctcaggggacgataggggattctttttcgacttgtggggccggggcacccgcgtgatagttagtagc

SEQ ID NO: 26262 - RNA, 378 nt, synthetic construct
  misc_feature 1..378: note = derived and/or modified sequence opt3 from anti-HIV-1_HeavyChain
  source 1..378: mol_type = other RNA
caggtgcaactggtccagagcggcgccgaggttaagaaacccggggcttccgtgaaggtatcttgcaaagcatcaggatacaccttcacaggttattacatgcactgggtgagacaggcccctggccagacttttgaatggctcgggtggatgaagccagtcacgggagcggtgaactatgctaggcaattccagggccgggttagtttttaccgcacccgagagcttggtatcgcctatatggacctgcgtgatttgaaattcgacgatacagcagtgtacttttgtgccagaaagactaaggctgacgtcagcggggatgacaggggattctttttcgatttatggggccggggcacccgcgtgattgtatcctct

SEQ ID NO: 26263 - RNA, 381 nt, synthetic construct
  misc_feature 1..381: note = derived and/or modified sequence opt3 from anti-HIV-1_HeavyChain
  source 1..381: mol_type = other RNA
agagtgtacatggagcaggccggcgctggggtcaagaaacccggagcaagcgttaccctgtcctgcaagacagccgacgaagatgtgttcgacgcggcttatatgcactgggtaaggcaagcccctggtcagacttttgagtggctcggctggatgaaaccagtgacgggggcagtctcttacgcccggaagttccagggacgcgtgtcatttaccatgacacgagaacttggcatggcttatatggatctgcgtaacttgagattcgacgatactgcagtttacttttgtgccaggaaaaccgctggtgacgtgagtggggataatcggggatatttctttgacttatggggccgcggcagcagagtcatcgtgtcctct

SEQ ID NO: 26264 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaaagcggcgggggagtcaagaaacccggtccttccgttaccctgtcttgcaagacagccgacgaagatgtgttcgacgctgcatatatgcactgggtaagacaggccccaggccagacttttgagtggctcgggtggatgaaaccggtgacgggagcggtcaactacgctaggaagttccagggccgggtgtcattttatcgcacccgagaacttggtatcgcctacatggatctgcgtaatttgagattcgacgatacagcagtttatttttgtgccaggaaaactgctggggacgtgagtggagataagcggggcttctttttcgacttatggggccgcgggagcagagtcattgtgtcctct

SEQ ID NO: 26265 - RNA, 378 nt, synthetic construct
  misc_feature 1..378: note = derived and/or modified sequence opt3 from anti-HIV-1_HeavyChain
  source 1..378: mol_type = other RNA
caggtgcaactggtccagagcggcgccgaggttaagaaacccggggcttccgtgaaggtatcttgcaaagcatcaggatacaccttcacaggttattacatccactggatgagacaggcccctggccaggggctcgaatggatgggatggattaacccaaatagtggcgcggtgagctatgctaggaagtttcaaggtcgggtctccttccttcatgaccaggggatacgcatggcctacatggatctgcgaaacttgcgttttgacgatactgcagtgtatttctgtgccagaaaaacggctggagacgtttctggcgataataggggctactttttcgacttatgggggcggggatcgcgcgtgatcgtctcaagc

SEQ ID NO: 26266 - RNA, 381 nt, synthetic construct
  misc_feature 1..381: note = derived and/or modified sequence opt3 from anti-HIV-1_HeavyChain
  source 1..381: mol_type = other RNA
caggtgcacatggagcaagccggcgtcgaagttgagaagcccggggctagcgtgaccctgtcctgcaaaacagcagacgaagatgtattcgacgccgcgtacatgcattgggtgagacaggctcctggacagacttttgagtggctcggttggatgaagccagtcacgggcgccgtgaactatgcaaggaaattccaggggcgggtttctttttaccgcacccgagaacttggaatcgcctatatggatctgcgtaatttgagattcgacgatacagctgtgtacttttgtgcaaggaagactgccggcgacgtctcaggtgataaacgggggttctttttcgacttatggggacgcggcagtagagtgattgtaagctcc

SEQ ID NO: 26267 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgctggggtcaagaaacccggagcaagcgccaccctgtcctgcaagacagcggacgaagatgttttcgacgctgcctatatgcactgggtgagacaggcacctggtcagacttttgagtggctcggctggatgaaaccagtaacgggggccgtgtcttacgctaggaagttccagggacgggtctcattttatatgacccgcgaacttggcatggcatacatggatctgcgaaacttgcgtttcgacgatacagccgtgtatttttgtgctagaaaaactgccggtgacgttagtggggataataggggatacttctttgacttatggggccggggcagccgcgtgatcgtctcctct

SEQ ID NO: 26268 - RNA, 375 nt, synthetic construct
  misc_feature 1..375: note = derived and/or modified sequence opt3 from anti-HIV-1_HeavyChain
  source 1..375: mol_type = other RNA
ggccacgacctggagcagagcgggtccggagtgaagaaacccggtgcctctgtcagagtttcatgctggaccagtgaagatatcttcgaaaagagcgagctcattcattgggtgaggcaagctcctggccaggggcttgagtggataggatgggtaaaagcagtgtccggcgccgtcaactacggttctctggactttcggcaccgcgtgtcgttgacacgagatcgtgacttattcactgcgcatatggatatcagagggctgacgcaggacgataccgctatttatttttgtgccaggcagaagttcgcacggggagaccaaggctggtttttcgatctatggggccgcgggacactcatcgttgtgtcaagc

SEQ ID NO: 26269 - RNA, 378 nt, synthetic construct
  misc_feature 1..378: note = derived and/or modified sequence opt3 from anti-HIV-1_HeavyChain
  source 1..378: mol_type = other RNA
caggcccacagaggcaccatctgggggctggaggtgaagaaacccggaggttgggtcagggttagctgctggacatccgaagacattttcgagcggactgaactcatacattgggtgcgccaagctcctggccaggggcttgagtggatcggatgggtaaagacggtgaccggcgcagtcaactttggttctccaaatttccgacaccgtgtgtcactgacaagagatagggacttgtttactgcccatatggatattcgggggttaacccagggagacacagcgacctacttctgtgctcgccagaaatttgaaagaggcggccaagggtggtatttcgatctgtggggaaggggtactctaatcgttgtgagtagc

SEQ ID NO: 26270 - RNA, 381 nt, synthetic construct
  misc_feature 1..381: note = derived and/or modified sequence opt3 from anti-HIV-1_HeavyChain
  source 1..381: mol_type = other RNA
caggtgcacatggagcaagccggcgctggggtcgaaaagcccggagcaagcgttaccctgtcctgcaaaacagccgacgaggatgtgttcgacgcggcttacatgcattgggtaagacaggcccctggtcagacttttgaatggctcggctggatgaagccagtgacgggggcagtctcttatgccaggaaattccagggacgggtgtcattttacatgacccgcgagcttggcatggcttatatggatctgcgaaacttgcgtttcgacgatacagcagtttacttttgtgccagaaagactgctggtgacgtgagtggggataataggggatatttctttgacttatggggccggggcagccgcgtcatcgtgtcctct

SEQ ID NO: 26271 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaaagcggcgggggagtcaagaaacccggtgcctccgttaccctgtcttgcaagacagctgacgaagatgtgttcgacgcagcctatatgcactgggtaagacaggcgcctggccagacttttgagtggctcgggtggatgaaaccagtgacgggagctgtctcatacgccaggaagttccagggccgggtgagtttttatatgacccgcgaacttggtatggcatacatggatctgcgaaacttgcgtttcgacgatacagccgtttatttttgtgctagaaaaactgcaggggacgtgagcggagataataggggctacttctttgacttatggggccgggggtcccgcgtcatcgtgtcttcg

SEQ ID NO: 26272 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaaagcggcgggggagtcaagaaacccggtgcctccgttaccctgtcttgcaagacagctgacgaagatgtgttcgacgcagcctatatgcactgggtaagacaggcgcctggccagacttttgagtggctcgggtggatgaaaccagtgacgggagctgtcaactacgccaggaagttccagggccgggtgtcattttatcgcacccgagaacttggtatcgcatacatggatctgcgtaatttgagattcgacgatacagccgtttatttttgtgctaggaaaactgcaggggacgtgagtggagataagcggggcttctttttcgacttatggggccgcgggagcagagtcattgtgtcctct

SEQ ID NO: 26273 - RNA, 381 nt, synthetic construct
  misc_feature 1..381: note = derived and/or modified sequence opt3 from anti-HIV-1_HeavyChain
  source 1..381: mol_type = other RNA
gaggtgtacatggaacagagcggcgggggagtcaagaaacccggtgcctccgttaccctgtcttgcaagacagcttcagaggacgtgttcgatgcagcctatatgcactgggtaagacaagcgcctggccagacttttgaatggctcgggtggatgaaaccagtgacgggagctgtcaactacgccaggaagttccagggccgggtgagtttttatcgcacccgagagcttggtatcgcatacatggacctgcgtaatttgagattcgatgacacagccgtttatttttgtgctaggaaaactgcaggggatgtgagcggagacaagcggggcttctttttcgatttatggggccgcgggtccagagtcattgtgtcttcg

SEQ ID NO: 26274 - RNA, 381 nt, synthetic construct
  misc_feature 1..381: note = derived and/or modified sequence opt3 from anti-HIV-1_HeavyChain
  source 1..381: mol_type = other RNA
caggtgcaactggtccagagcggcgccgaggttaagaaacccggggcttccgtgaccctctcttgcaagacagcagacgaagatgtattcgacgccgcgtacatgcactgggtgagacaggctcctggacagacttttgagtggcttggttggatgaaaccagtcacgggcgccgtgtcatatgcaaggaagttccaagggcgggttagtttttacatgacccgcgaactgggaatggcctatatggatttgcgaaacttacgtttcgacgatacagctgtgtacttttgtgcaagaaaaactgccggcgacgtcagcggtgataatagggggtatttctttgacctgtggggacggggctcccgcgtgatcgtatcttcg

SEQ ID NO: 26275 - RNA, 381 nt, synthetic construct
  misc_feature 1..381: note = derived and/or modified sequence opt3 from anti-HIV-1_HeavyChain
  source 1..381: mol_type = other RNA
caggtgttcatggagcaaagcggcgggggaatgaagaaacccggtgcctccatgaccgtctcttgcaagacagctgacgaagatgtttttgacgcagcctatatgcactgggtgagacaggcgcctggccagactttcgagtggctggggtggatgaaaccagtaacgggagctgtgtcatatgccaggaagtttcagggccgggtcagtttctacatgacccgcgaactcggtatggcatatatggatcttcgaaacctgcgttttgacgatacagccgtgtacttctgtgctagaaaaactgcaggggacgttagcggagataataggggctactttttcgacttgtggggccgggggtcccgcgtgatcgtctcttcg

SEQ ID NO: 26276 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggaatgaagaaacccggtgctagcatgaccgtctcctgcaagacagcagacgaagatatcttcgacgccgcgtatatgcactgggttagacaggctcctggccagacttttgagtggctggggtggatgaaaccagtgacgggagccgtaaactacgcaaggcggttccagggccgcgtgtctttttatcgaacccgtgaactcggtattgcctacatggatcttagagacctgaagttcgatgacacagctgtctatttttgtgcaaggaaaactaagggggatgtgtcaggagacgatcggggcttctttttcgacttgtggggccgcgggaccagagttatagtgagtagc

SEQ ID NO: 26277 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgctggggtcaagaaacccggagcaagcgttaccctgtcctgcaaggccgcggacgaagatgtgttcgacgctgcctatatgcactgggtaagacaggcacctggtcagacatttgagtggctcggctggatgaaaccagtgactggggccgtctcttacgctaggaagttccagggacgggtgtcattttatatgacgcgcgaacttggcatggcatacatggatctgcgaaacttgcgtttcgacgataccgccgtttatttttgtgctagaaaaacagccggtgacgtgagtggggataataggggatacttctttgacttatggggccggggcagccgcgtcatcgtgtcctct

SEQ ID NO: 26278 - RNA, 381 nt, synthetic construct
  misc_feature 1..381: note = derived and/or modified sequence opt3 from anti-HIV-1_HeavyChain
  source 1..381: mol_type = other RNA
caggtgttcatggagcaagccggcgctgggatgaagaaacccggagcaagcatgaccgtctcctgcaagacagccgacgaagatatctttgacgcggcttacatgcactgggttagacaggcccctggtcagactttcgagtggctgggctggatgaaaccagtgacgggggcagtaaactatgccaggcagtttcaaggacgggtgtctttctaccgcacccgagaactcggcattgcttatatggatcttcgtgacctgaagtttgatgacacagcagtctacttctgtgccagaaaaactaagggtgatgtgtcaggggacgataggggatttttctttgacttgtggggccggggcacccgcgttatagtgagtagc

SEQ ID NO: 26279 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaacccggcggggaagtcaagaaacctggagcaagcgttaccctgtcctgcaagacagctgacgaggatgtgttcgacgcagcctatatgcactgggtaagacaggcgccaggtcagacttttgaatggctcggctggatgaaaccggtgacgggggctgtcaactacgccaggaagttccagggacgggtgtctttttatatgacccgcgagcttggcatggcatacatggatctgcgaaatttgcgtttcgacgatacagccgtttatttttgtgctagaaaaactgccggtgacgtgtcaggggataacaggggatacttctttgacttatggggccggggcagtcgcgtcatcgtgagctcc

SEQ ID NO: 26280 - RNA, 381 nt, synthetic construct
  misc_feature 1..381: note = derived and/or modified sequence opt3 from anti-HIV-1_HeavyChain
  source 1..381: mol_type = other RNA
caggtgcacatggagcaagccggcgctggggtcaagaaacccggagcaagcgttaccctgtcctgcaagacagccgacgaagatgtgttcgacgcggcttacatgcattgggtaagacaggcccctggtcagacttttgagtggctcggctggatgaaaccagtgacgggggcagtctcttatgccaggaagttccagggacgggtgtcattttacatgacccgcgaacttggcatggcttatatggatctgcgaaacttgcgtttcgacgatacagcagtttacttttgtgccagaaaaactgctggtgacgtgagtggggataataggggatatttctttgacttatggggccggggcagccgcgtcatcgtgtcctct

SEQ ID NO: 26281 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggagtcaagaaacccggtgctagcgttaccctgtcctgcaagacagcagacgaagatgtgttcgacgccgcgtatatgcactgggtaagacaggctcctggccagacttttgagtggctcgggtggatgaaaccagtgacgggagccgtcaactacgcaaggaagttccagggccgggtgtctttttatcgcacccgagaacttggtatcgcctacatggatctgcgtaatttgagattcgacgatacagctgtttatttttgtgcaaggaaaactgccggggacgtgtcaggagataagcggggcttctttttcgacttatggggccgcgggccgagagtcattgtgagtagc

SEQ ID NO: 26282 - RNA, 381 nt, synthetic construct
  misc_feature 1..381: note = derived and/or modified sequence opt3 from anti-HIV-1_HeavyChain
  source 1..381: mol_type = other RNA
caggtgcaactggtccagagcggcgccgaggttaagaaacccggggcttccgtgaaggtatcttgcaaagcatcaggacacaccttcacaaactacgacatcaattgggtgagacaggcccctggtcagggcctcgaatggattgggtgggtcaagatagtgagtggaactgttaactttgcgagccttgatttcaggaatcggatctccctgtctcgcgaccgagatttgtcgacggcttatatggacattcgtggcttaacccaagatgacacagccacttacttttgtgcaagacagaaattcgcctcaaggtatagcggtgatcaggggagttactttgacctgtggggacggggcaccctaatcgtggtctcctct

SEQ ID NO: 26283 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggaatgaagaaacccggtgctagcatgaccgtctcctgcaagacagcagacgaagatatcttcgacgccgcgtatatgcactgggttagacaggctcctggccagacttttgagtggctggggtggatgaaaccagtgacgggagccgtaaactacgcaaggcagttccaaggccgggtgtctttttatcgcacccgagaactcggtattgcctacacagatcttcgtgacctgaagttcgatgacactgctgtctatttttgtgcaagaaaaaccaagggggatgtgtcaggagacgataggggcttctttttcgacttgtggggccgggggacacgcgttatagtgagtagc

SEQ ID NO: 26284 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggagtcaagaaacccggtgctagcgttaccctgtcctgcaagacagcagacgaagatgtgttcgacgccgcgtatatgcactgggtaagacaggctcctggccagacttttgagtggctcgggtggatgaaaccagtgacgggagccgtcaactacgcaaggcagttccaaggccgggtgtctttttatcgcacccgagaacttggtatcgcctacatggatctgcgtgacttgaagttcgatgacacagctgtttatttttgtgcaagaaaaactaagggggatgtgtcaggagacgataggggcttctttttcgacttatggggccgggggacccgcgtcattgtgagtagc

SEQ ID NO: 26285 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggagtcaagaaacccggtgctagcgttaccctgtcctgcaagacagcagacgaagatgtgttcgacgccgcgtatatgcactgggtaagacaggctcctggccagacttttgagtggccagggtggatgaaaccggtgacgggagccgtcaactacgcaaggaagttccagggccgggtgtctttttatcgcacccgagaactcggtatcgcctacatggatcttcgtaatctgagattcgacgatacagctgtttatttttgtgcaaggaaaactgccggggacgtgtcaggagataagcggggcttctttttcgacttgtggggccgcgggagtagagtcattgtgagctcc

SEQ ID NO: 26286 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggagtcaagaaacccggtgctagcgcaaccctgtcctgcaagacagccgacgaagatgttttcgacgcggcttatatgcactgggtgagacaggcccctggccagacttttgagtggctcgggtggatgaaaccagtaacgggagcagtgtcttacgccaggaagttccagggccgggtctcattttatatgacccgcgaacttggtatggcttacatggatctgcgaaacttgcgtttcgacgatacagcagtgtatttttgtgccagaaaaactgctggggacgttagtggagataataggggctacttctttgacttatggggccgggggagccgcgtgatcgtctcctct

SEQ ID NO: 26287 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggagtcaagaaacccggtgctagcgttaccctgtcctgcaagacagcagacgaagatgtgttcgacgccgcgtatatgagatgggtaaggcaggctcctggccagacttttgagtggctcgggtggatgaaaccagtgacgggagccgtcaactacgcacggaagttccagggccgcgtgtctttttatcgaacccgtgaacttggtatcgcctacatggatctgagaaatttgaggttcgacgatacagctgtttatttttgtgcacggaaaactgccggggacgtgtcaggagataagcgcggcttctttttcgacttatggggcagagggagtagggtcattgtgagctcc

SEQ ID NO: 26288 - RNA, 381 nt, synthetic construct
  misc_feature 1..381: note = derived and/or modified sequence opt3 from anti-HIV-1_HeavyChain
  source 1..381: mol_type = other RNA
caggtgcaactggtccagagcggcgccgaggttaagaaacccggggcttccgtgaaggtatcttgcagagcatcaggatacaccttcggtaaccacgccatcagttgggtgaggcaggcgcctggccaggggctcgaatggatgggatggattcggccaaaaacaggcgctcgcaatcaagcccgacagtttcagccgcgtataagccttactagagacagggcactgtccacggcctatttggatttaaactctctgacctcggctgactcaggtacatacttctgtgcacggcagacttttaagcccgatttctattttgccgaccaagggtggagcttcaatctatggggacgcggcgctcattttatcgtcagttcc

SEQ ID NO: 26289 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggagtcaagaaacccggtgctagcgttaccctgtcctgcaagacagcagacgaagatgtgttcgacgccgcgtatatgcactgggtaagacaggctcctggccagacttttgagtggctcgggtggatgaaaccagtgacgggagccgtctcttacgcaaggaagttccagggccgggtgtcattttatatgacccgcgaacttggtatggcctacatggatctgcgaaacttgcgtttcgacgatacagctgtttatttttgtgcaagaaaaactgccggggacgtgagtggagataataggggctacttctttgacttatggggcccggggagccgggtcatcgtgtcctct

SEQ ID NO: 26290 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgctggggtcaagaaacccggagcaagcgttaccctgtcctgcaagacagccgacgaagatgtgttcgacgcggcttatatgcactgggtaagacaggcccctggtcagacttttgagtggctcggctggatgaaaccagtgacgggggcagtcaactacgccaggaagttccagggacgggtgtctttttatcgcacccgagaacttggcatcgcttacatggatctgcgtaatttgagattcgacgatacagcagtttatttttgtgccaggaaaactgctggtgacgtgtcaggggataagcggggattctttttcgacttatggggccgcggcagtagagtcattgtgagctcc

SEQ ID NO: 26291 - RNA, 381 nt, synthetic construct
  misc_feature 1..381: note = derived and/or modified sequence opt3 from anti-HIV-1_HeavyChain
  source 1..381: mol_type = other RNA
caggtgcacatggagcaagccggcgggggagtcaagaaacccggtgctagcgttaccctgtcctgcaagacagcagacgaagatgtgttcgacgccgcgtacatgcattgggtaagacaggctcctggccagacttttgagtggctcgggtggatgaaaccagtgacgggagccgtcaactatgcaaggaagttccagggccgggtgtctttttaccgcacccgagaacttggtatcgcctatatggatctgcgtaatttgagattcgacgatacagctgtttacttttgtgcaaggaaaactgccggggacgtgtcaggagataagcggggcttctttttcgacttatggggccgcgggagtagagtcattgtgagctcc

SEQ ID NO: 26292 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgacgggatgaagaaacccggagctagcatgaccgtctcctgcaagacagcagatgaagacatcttcgatgccgcgtatatgcactgggttagacaggctcctggtcagacttttgagtggctgggctggatgaaaccagtgacgggggccgtaaactacgcaaggcagttccaaggacgggtgtctttttatcgcacccgagaactcggcattgcctacatggaccttcgtgatctgaagttcgacgatacagctgtctatttttgtgcaagaaaaactaagggtgacgtgtcaggggatgacaggggattctttttcgatttgtggggccggggcacccgcgttatagtgagtagc

SEQ ID NO: 26293 - RNA, 381 nt, synthetic construct
  misc_feature 1..381: note = derived and/or modified sequence opt3 from anti-HIV-1_HeavyChain
  source 1..381: mol_type = other RNA
caggtgcaactggtccagagcggcgccgaggttaagaaacccggggcttccgtgaccctctcttgcaagacagcagacgaagatgtattcgacgccgcgtacatgcactgggtgagacaggctcagggacaaacttttgagtggcttggttggatgaaacctgtcacgggcgccgtgaactatgcaaggaagttccaggggcgggtttcattttaccgcacccgagaactgggaatcgcctatatggatttgcgtaatttaagattcgacgatacagctgtgtacttttgtgcaaggaaaactgccggcgacgtcagtggtgataagcgggggttctttttcgacctgtggggacgcggcagcagagtgattgtatcctct

SEQ ID NO: 26294 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggagtcaagaaacccggtgctagcgttaccctgtcctgcaagacagcagacgaagatgtgttcgacgccgcgtatatgcactgggtaagacaggctcctggccagacttttgagtggctcgggtggatgaaaccagtgacgggagccgtcaactacgcaaggaagttccagggccgggtgtctttttatcgcacccgagaacttggtatcgcctacatggatctgcgtaatttgagattcgacgatacagctgtttatttttgtgcaaggaaaactgccggggacgtgtcaggagataagcggggcttctttttcgacttatggggccgcgggagtcaagtcattgtgagctcc

SEQ ID NO: 26295 - RNA, 381 nt, synthetic construct
  misc_feature 1..381: note = derived and/or modified sequence opt3 from anti-HIV-1_HeavyChain
  source 1..381: mol_type = other RNA
caggtgcaactggtccagagcggcgccgaggttagaaagcccggggcttccgtgaaagtatcttgcaaggcatcaggatacaccttcacaaactattacatgcactgggtgaggcaggcccctggtcagggcctcgaatggatcgggtgggtcaaaattgtgagtggaactgttaattttgcgagccttgacttccggaaccgcatatccctgtctcgagatcgtgacttgtcgacggcttatatggatatcagaggcttaacccaagacgatacagccacttacttttgtgcaaggcagaagttcgcctcacggtatagcggtgaccaggggagttactttgatctgtggggacgcggcaccctaattgtggtctcctct

SEQ ID NO: 26296 - RNA, 381 nt, synthetic construct
  misc_feature 1..381: note = derived and/or modified sequence opt3 from anti-HIV-1_HeavyChain
  source 1..381: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggaaccgtcaactacgcccgcaaatttcagggccgagtgagcttctatcgtacaagagaactgggtatcgcgtacatggatttgaggaatttacggtttgacgatactgctgtttatttctgtgcccgcaagaccgcaggggacgtgtccggagataaaagaggctttttctttgacctgtggggcagggggtctcgggtcattgtgtcgtca

SEQ ID NO: 26297 - RNA, 381 nt, synthetic construct
  misc_feature 1..381: note = derived and/or modified sequence opt3 from anti-HIV-1_HeavyChain
  source 1..381: mol_type = other RNA
ctgatccacctcgcccagagcggcgctgaggtgaagaaacccggggcatccgtcaccctttcttgcaagacagccgacgaagatgttttcgacgcggcttacatgcattgggtgagacaagcccctggacagacttttgagtggctgggttggatgaaaccagtaacgggcgcagtgtcatatgccaggaagttccaggggcgggtcagtttttacatgacccgcgaattgggaatggcttatatggatttacgaaacctgcgtttcgacgatacagcagtgtacttttgtgccagaaaaactgctggcgacgttagcggtgataatagggggtatttctttgacctatggggacggggctcccgcgtgattgtctcttcg

SEQ ID NO: 26298 - RNA, 381 nt, synthetic construct
  misc_feature 1..381: note = derived and/or modified sequence opt3 from anti-HIV-1_HeavyChain
  source 1..381: mol_type = other RNA
caggtgcaactggtccagagcggcgccgaggttaagaaacccggggcttccatgaccgtgtcttgcaagacagcagacgaagatatcttcgacgccgcgtacatgcactgggtaagacaggctcctggacagacttttgagtggctcggttggatgaaaccagtgacgggcgccgtcaactatgcaaggcaattccaggggcgggtgtcattttaccgcacccgagaacttggaattgcctatatggatctgcgtgacttgaagttcgatgacacagctgtttacttttgtgcaagaaaaactaagggcgatgtgagtggtgacgatagggggttctttttcgacttatggggacggggcacccgcgtcatagtgagctcc

SEQ ID NO: 26299 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaaggcagagggggagtcaagaaacccggtgccagcgttaccctgtcctgcaagacagctgacgaagatgtgttcgacgcagcctatatgcactgggtaaggcaggcgcctggccagacttttgagtggctcgggtggatgaaaccagtgacgggagctgtcaactacgcccggaagttccagggccgcgtgtctttttatcgaacccgtgaacttggtatcgcatacatggatctgagaaatttgaggttcgacgatacagccgtttatttttgtgctcggaaaactgcaggggacgtgtcaggagataagcgcggcttctttttcgacttatggggcagagggagtagggtcattgtgagctcc

SEQ ID NO: 26300 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggaatgaagaaacccggtgctagcatgaccgtctcctgcaagacagcagacgaagatgttttcgacgccgcgtatatgcactgggtgagacaggctcctggccagacttttgagtggctggggtggatgaaaccagtaacgggagccgtgaactacgcaaggcagttccaaggccgggtctctttttatcgcacccgagaactcggtatcgcctacatggatcttcgtgacctgaagtcagatgacacagctgtgtatttctgtgcaagaaaaactgccggggatgttagtggagacaagaggggctttttctttgatttgtggggccgggggagccgcgtgattgtctcctct

SEQ ID NO: 26301 - RNA, 381 nt, synthetic construct
  misc_feature 1..381: note = derived and/or modified sequence opt3 from anti-HIV-1_HeavyChain
  source 1..381: mol_type = other RNA
caggtgcaactggtccagagcggcgccgaggttaagaaacccgggtcctctatcaaggtgtcatgcaaagctagtggagacaccattagcagatacgcaataaactgggtaaggcaggcccctggtcagggcctcgaatggatcgggtgggtgaagacagtcactggagcggtgaatttcggctcccttgattttcggcaccgcatttctctgacgcgagaccgtgatttgttcaccgctcatatgggtatcagagggttaacacaaggagacactgccacctatttttgtgcaaggcagaaattcgagtcgcggtacacaggcggccaggggtggtattttgatctgtggggacgcggtacccacattgttgtgtcaagc

SEQ ID NO: 26302 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggagtcaagaaacccggtgctagcgttaccctgtcctgcaagacagcagacgaagatatcttcgacgccgcgtatatgcactgggtgagacaggctcctggccagacttttgagtggctcgggtggatgaaaccagtaacgggagccgtgaactacgcaaggaagttccagggccgggtctctttttatcgcacccgagaacttggtattgcctacatggatctgcgtaatttgagattcgacgatacagctgtgtatttttgtgcaaggaaaactgccggggacgtttcaggagataagcggggcttctttttcgacttatggggccgcgggagtagagtgatagtcagctcc

SEQ ID NO: 26303 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggagtcaagaaacccggtgctagcgttaccctgtcctgcaagacagcagacgaagatgtgttcgacgccgcgtatatgcactgggtaagacaggctcctggccagacttttgagtggctcgggtggatgaaaccagtgacgggagccgtcaactacgcaaggaatttccagggccgggtgtctttttatcgcacccgagaacttggtatcgcctacatggatctgcgtaacttgagattcgacgatacagctgtttatttttgtgcaaggcaaaagttcgagtcacggtacagtggggaccagggaagctattttgatttatggggccgcggcactctgattatagtgtcctct

SEQ ID NO: 26304 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggagtcaagagacccggtgctagcgttaccctgtcctgcaaaacagcagacgaagatgtgttcgacgccgcgtatatgcactgggtaaggcaggctcctggccagacttttgagtggctcgggtggatgaagccagtgacgggagccgtcaactacgcacggaaattccagggccgcgtgtctttttatcgaacccgtgaacttggtatcgcctacatggatctgagaaatttgaggttcgacgatacagctgtttatttttgtgcacggaagactgccggggacgtgtcaggagataaacgcggcttctttttcgacttatggggcagagggagtagggtcattgtgagctcc

SEQ ID NO: 26305 - RNA, 381 nt, synthetic construct
  misc_feature 1..381: note = derived and/or modified sequence opt3 from anti-HIV-1_HeavyChain
  source 1..381: mol_type = other RNA
caggtgcaactggtccagagcggcgacgaggttaagaaacccggggcctccgtgaccctctcttgcaagacagctgatgaagacgtattcgatgcagcctacatgcactgggtgagacaggcgcctggacagacttttgagtggcttggttggatgaaaccagtcacgggcgctgtgaactatgccaggaagttccaagggcgggtttcattttaccgcacccgagaactgggaatcgcatatatggacttgcgtaatttaagattcgatgacacagccgtgtacttttgtgctaggaaaactgcaggcgatgtcagtggtgacaagcgggggttctttttcgatctgtggggacgcggcagcagagtgattgtatcctct

SEQ ID NO: 26306 - RNA, 381 nt, synthetic construct
  misc_feature 1..381: note = derived and/or modified sequence opt3 from anti-HIV-1_HeavyChain
  source 1..381: mol_type = other RNA
caggtgcaactggtccagagcggcgccggggttaagaaacccggatcctctgtgaaggtatcatgcaaagctagtggtggcaccttcagctcctacgcaatcaactggctcagacaggtgcctgggcagaggccagagtggatgggatggattcggccgaagacaggcgcccgcaatcaagcgcgacagtttcagccccgtatatctcttactagagacagggctctgtcgacggcctatttggatttaaactcactgaccagcgcagacagtggtacatacttctgtgcccggcagacttttaaacctgatttctattttgctgaccaagggtggtccttcaatctatggggacgcggcgcacactttatcgtctctagc

SEQ ID NO: 26307 - RNA, 381 nt, synthetic construct
  misc_feature 1..381: note = derived and/or modified sequence opt3 from anti-HIV-1_HeavyChain
  source 1..381: mol_type = other RNA
caggtgtacatggagagagccggcgggggagtcaagaaacccggtgctagcgttaccctgtcctgcgaaacagcagacgaggatgtgttcgacgccgcgtatatgcactgggtaaggcaagctcctggccagacttttgaatggctcgggtggatgaagccagtgacgggagccgtcaactacgcacggaaattccagggccgcgtgtctttttatcgaacccgtgagcttggtatcgcctacatggatctgagaaatttgaggttcgacgatacagctgtttatttttgtgcacggaagactgccggggacgtgtcaggagataaacgcggcttctttttcgacttatggggcagagggagtagggtcattgtgagctcc

SEQ ID NO: 26308 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgctgggatgaagaaacccggagcaagcatgaccgtctcctgcaagacagccgacgaagatatcttcgacgcggcttatatgcactgggttagacaggcccctggtcagacttttgagtggctgggctggatgaaaccagtgacgggggcagtaaactacgccaggcagttccaaggacgggtgtcttttctccaggatcagggcattcgcatagcttatatggaccttcgagatctgaagttcgacgataccgcagtctacttttgtgcccgtaaaacaaagggtgacgtgtcaggggatgacagaggattctttttcgatttgtggggcaggggcactcgggttatcgtgagtagc

SEQ ID NO: 26309 - RNA, 381 nt, synthetic construct
  misc_feature 1..381: note = derived and/or modified sequence opt3 from anti-HIV-1_HeavyChain
  source 1..381: mol_type = other RNA
caggtgtacatgggcgccgggagaggaggtgtcaagaaacccggcgctagcgttaccctgtcctgcaagacagcagacgaggatgtgttcgacgccgcgtatatgcactgggtaaggcaagctcctgggcagacttttgaatggctcggatggatgaaaccagtgacgggcgccgtcaactacgcacggaagttccagggtcgcgtgtctttttatcgaacccgtgagcttgggatcgcctacatggatctgagaaatttgaggttcgacgatacagctgtttatttttgtgcacggaaaactgccggagacgtgtcaggcgataagcgcggcttctttttcgacttatgggggagaggaagtagggtcattgtgagctcc

SEQ ID NO: 26310 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgctggggtcaagaaacccggagcaagcgttaccctgtcctgcaagacagccgacgaagatgtgttcgacgcggcttatatgcactgggtaagacaggcccctggtcagccatttgagtggctcggctggatgaaaccggtgactggggcagtctcttacgccaggaagttccagggacgggtgtcattttatatgacgcgcgaacttggcatggcttacatggatctgcgaaacttgcgtttcgacgataccgcagtttatttttgtgccagaaaaacagctggtgacgtgagtggggataataggggatacttctttgacttatggggccggggcagccgcgtcatcgtgtcctct

SEQ ID NO: 26311 - RNA, 381 nt, synthetic construct
  misc_feature 1..381: note = derived and/or modified sequence opt3 from anti-HIV-1_HeavyChain
  source 1..381: mol_type = other RNA
caggtgcaactggtccagagcggcgccgaggttaagaaacccggggcttccgtgaagatctcttgcaaagcatcaggatacaccttcattagacacggtatacattggctcaggcaggtacctggccagcggccagaatggatggggtggatccgcccgaagacaggagcccgaaaccaagcgcgtcagtttcagcccagaattagtcttgctagggaccgggccctgagcactgcatatttggatttaaattccctgacgtctgccgactcgggcacctacttctgtgctcgccagacatttaaacctgatttctattttgcagaccaaggttggtcattcaacctatgggggagaggagcccactttatcgtgagcagt

SEQ ID NO: 26312 - RNA, 381 nt, synthetic construct
  misc_feature 1..381: note = derived and/or modified sequence opt3 from anti-HIV-1_HeavyChain
  source 1..381: mol_type = other RNA
caggtgctgctcgtccaaagcggcgccgaggttaagaaacccgggtcctctgtgaaggtatcatgcaaagctagtggagacagccttaccaagtacgcattctcctgggtgagacaggcccctggtcagggcccagaatggatggggtggatcaggccgaaaacaggagcgcggaaccgcgctcgacagtttcaaccccgtatttctctgactagagatagggccttgtcgacggcatatttagacctaaattcactgaccagcgccgatagtggcacatacttctgtgctcggcagacttttaagcctgacttctattttgcagatcagggttggtccttcaacctctgggggcgcggagcccactttatagtctctagc

SEQ ID NO: 26313 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggagtcaagaaacccggtgctagcgttaccctgtcctgcaagacagcagacgaagatgtgttcgacgccgcgtatatgcactgggtaagacaggctaggggccagacttttgagtggctcgggtggatgaaacctgtgacgggagccgtcaactacgcacggaagttccagggccgcgtgtctttttatcgaacccgtgaacttggtatcgcctacatggatctgagaaatttgaggttcgacgatacagctgtttatttttgtgcacggaaaactgccggggacgtgtcaggagataagcgcggcttctttttcgacttatggggcagagggagtagggtcattgtgagctcc

SEQ ID NO: 26314 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggagtcaagaaacccggtgctagcgttaccctgtcctgcaagacagcagacgaagatgtgttcgacgccgcgtatatgcactgggtaagacaggctcctggccagacttttgagtggctcgggtggatgaaaccagtgacgggagccgtcaactacgcaaggaagttccagggccgggtgtctttttatcgcacccgagaacttggtatcgcctacatggatctgcgtaatttgagattcgacgatacagctgtttatttttgtgcaaggaaaactgccggggacgtgtcaggagataaccggggctacttctttgacttatggggccgcgggagtagagtcattgtgagctcc

SEQ ID NO: 26315 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggagtcaagaaacccggtgctagcgttaccctgtcctgcaagacagcagacgaagatgtgttcgacgccgcgtatatgcactgggtaagacaggctcctggccagacttttgagtggctcgggtggatgaaaccagtgacgggagccgtcaactacgcaaggaagttccagggccgggtgtctttttatcgcacccgagaacttggtatcgcctacatggatctgcgtaatttgagattcgacgatacagctgtttatttttgtgcaaggaaaactgccggggacgtgtcaggagataagcggggcttctttttcgacttatggggcccggggagtcgcgtcattgtgagctcc

SEQ ID NO: 26316 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggaatgaagaaacccggtgctagcatgaccgtctcctgcaagacagcagacgaagatatcttcgacgccgcgtatatgagatgggttaggcaggctcctggccagacttttgagtggctggggtggatgaaaccagtgacgggagccgtaaactacgcacggcagttccaaggccgcgtgtctttttatcgaacccgtgaactcggtattgcctacatggatcttagagacctgaagttcgatgacacagctgtctatttttgtgcaaggaaaactaagggggatgtgtcaggagacgatcggggcttctttttcgacttgtggggccgcgggaccagagttatagtgagtagc

SEQ ID NO: 26317 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggagtcaagaaacccggtgctagcgttaccctgtcctgcaagacagcagacgaagatgtgttcgacgccgcgtatatgcactgggtaagacaggctcctggccagacttttgagtggctcgggtggatgaaaccagtgacgggagccgtctcttacgcaaggaagttccagggccgggtgtcattttatatgacccgcgaacttggtatggcctacctggatttgcgaaacttacgtttcgacgatacagctgtttatttttgtgcaagaaaaactgccggggacgtgagtggagataataggggctacttctttgacctgtggggccgggggagccgcgtcatcgtgtcctct

SEQ ID NO: 26318 - RNA, 381 nt, synthetic construct
  misc_feature 1..381: note = derived and/or modified sequence opt3 from anti-HIV-1_HeavyChain
  source 1..381: mol_type = other RNA
caggtgcaactggtccagagcggcgccgaggttaagaaacccggggcttccgtgaaggtatcttgcaaagcatcaggatacaccttcacaggttattacatgcactgggtgagacaggcccctggccaggggctcgaatggatcggatgggtcaagactgtgacgggcgcggttaactttggtagtcttgacttcaggcatcggattagcctgacccgcgatcgagacttgtttacagctcacatggatatacgtgggttaactcaaggagacaccgccacatatttctgtgcaagacagaaatttgagtccaggtacaccggcggccaggggtggtatttcgatctgtggggacggggtactcatatcgtggtctcttcg

SEQ ID NO: 26319 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggagtcaagaaacccggtgctagcgttaccctgtcctgcaagacagcagacgaagatgtgttcgacgccgcgtatatgcactgggtaagacaggctcctggccagacttttgagtggctcgggtggatcaaaccagtgacgggagccgtcaactacgcaaggaagttccagggccgggtgtctttttatcgcacccgagaacttggtattgcctacatggatctgcgtaatttgagattcgacgatacagctgtttatttttgtgcaaggaaaactgccggggacgtgtcaggagataagcggggcttctttttcgacttatggggccgcgggagtagagtcatagtgagctcc

SEQ ID NO: 26320 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggaatgaagaaacccggtgctagcgtcaccgtttcctgcaagacagcagacgaagatatcttcgacgccgcgtatatgcactgggtgagacaggctcctggccagacttttgagtggctggggtggatgaaaccagtaacgggagccgtgaactacgcaaggcagttccaaggccgggtctctttttatcgcacccgagaactcggtattgcctacatggatcttcgtgacctgaagttcgatgacacagctgtgtatttttgtgcaagaaaaactaagggggatgtttcaggagacgataggggcttctttttcgacttgtggggccgggggacccgcgtgatagtcagtagc

SEQ ID NO: 26321 - RNA, 381 nt, synthetic construct
  misc_feature 1..381: note = derived and/or modified sequence opt3 from anti-HIV-1_HeavyChain
  source 1..381: mol_type = other RNA
caggcccacctggagcaaagcggctccggggtgaagaaacccggagcttctgtcagagtttcatgctggagtagcgaagacatctccaaggcagagctcattcattgggtgaggcaggcccctggtcagggccttgaatggatagggtgggtaaaaaccgtgacaggagcggtcaacttcggctctctggattttcggcaccgcatctcgttgactcgagaccgtgatttattcacggctcatatggacattagaggtctgacccagggggatacagccacttacttttgtgcaaggcaaaagttcgagtcacggtataccggaggccagggctggtactttgacctatgggggcgcggaacacacatcgtggttagcagt

SEQ ID NO: 26322 - RNA, 381 nt, synthetic construct
  misc_feature 1..381: note = derived and/or modified sequence opt3 from anti-HIV-1_HeavyChain
  source 1..381: mol_type = other RNA
caggtgtacatggaggccggcagagggggagtcaagaaacccggtgctagcgcaaccctgtcctgcaagacagccgacgaagatgttttcgacgcggcttatatgcactgggtgaggcaagcccctggccagacttttgagtggctcgggtggatgaaaccagtaacgggagcagtgtcttacgcccggaagttccagggccgcgtctcattttatatgacccgagaacttggtatggcttacatggatctgcgtaacttgagattcgacgatacagcagtgtatttttgtgccaggaaaactgctggggacgttagtggagataatcggggctacttctttgacttatggggccgcgggagcagagtgatcgtctcctct

SEQ ID NO: 26323 - RNA, 381 nt, synthetic construct
  misc_feature 1..381: note = derived and/or modified sequence opt3 from anti-HIV-1_HeavyChain
  source 1..381: mol_type = other RNA
agatgcatctggaggcaggccggcgggggagtgaagaaacccggtgctagcgtcaccctgtcctgtaagacagcagacgaggatgttttcgacgccgcgtacatgcactgggtgcggcaagctcctggccagacttttgaatggctcgggtggatgaaaccagtaacgggagccgtgtcttatgcacgcaagttccagggccgagtctcattttacatgacccgtgagcttggtatggcctatatggatctgagaaacttgaggttcgacgatacagctgtgtacttttgcgcacggaaaactgccggggacgttagtggagataatcgcggctatttctttgacttatggggcagagggagcagggtgattgtctcctct

SEQ ID NO: 26324 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggagtcaagaaacccggtgctagcgttaccctgtcctgcaagacagcagacgaagatgtgttcgacgccgcgtatatgcactgggtaagacaggctcctggccagacttttgagtggctcgggtggatcaaaccagtgacgggagccgtctcttacgcaaggaagttccagggccgggtgtcattttatatgacccgcgaacttggtatggcctacatggatctgcgaaacttgcgtttcgacgatacagctgtttatttttgtgcaagaaaaactgccggggacgtgagtggagataataggggctacttctttgacttatggggccgggggagccgcgtcattgtgtcctct

SEQ ID NO: 26325 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgaagagtagctgctggacctccgaagacatcttcgatacaactgagctcatttactgggtcagacaggcacctggacagggtcttgaatggataggctgggttaaaatcgtgtctgggacggtaaactttgcctcgctggacttcaggaatcggatttcattgagccgcgatcgagacttaagtaccgcgtatatggatatccgtggactgacacaggacgatactgctacctacttttgtgccagacaaaagttcgcatccaggtattctggcgaccagggtagctactttgatctatgggggcggggaacactcattgtggtctcctca

SEQ ID NO: 26326 - RNA, 381 nt, synthetic construct
  misc_feature 1..381: note = derived and/or modified sequence opt3 from anti-HIV-1_HeavyChain
  source 1..381: mol_type = other RNA
agatgcctgtggaggcaggccggcgggggaatgaagaaacccggtgctagcatgaccgtgtcctgtaagacagcagacgaggatgtcttcgacgccgcgtacatgcactgggttcggcaagctcctggccagacttttgaatggctcgggtggatgaaaccagtgacgggagccgtaaactatgcacgcaagttccagggccgagtgtctttttaccgtaccagagagcttggtatcgcctatatggatctgaggaatttgcggttcgacgatacagctgtctacttttgcgcacgcaaaactgccggggacgtgtcaggagataagagaggcttctttttcgacttatggggcagggggagtcgggttattgtgagctcc

SEQ ID NO: 26327 - RNA, 381 nt, synthetic construct
  misc_feature 1..381: note = derived and/or modified sequence opt3 from anti-HIV-1_HeavyChain
  source 1..381: mol_type = other RNA
agatgcatctgggagagggccggcgggggaatgaagaaacccggtgctagcatgaccgtgtcctgtaagacagcagacgaagatattttcgacgccgcgtacatgcactgggtccggcaggctcctggccaaacttttgagtggctggggtggatgaaaccagttacgggagccgtgaactatgcacgccagttccagggccgagtatctttttaccgtaccagagaactcggtatagcctatatggatcttagggacctgaagttcgatgacacagctgtgtacttttgcgcacggaaaactaagggggatgtctcaggagacgatcgcggcttctttttcgacttgtggggcagagggaccagggtgatcgttagtagc

SEQ ID NO: 26328 - RNA, 381 nt, synthetic construct
  misc_feature 1..381: note = derived and/or modified sequence opt3 from anti-HIV-1_HeavyChain
  source 1..381: mol_type = other RNA
caggtgcaactggagcaggccggcgggggagtcaagaaacccggtgctagcgttaccctctcctgcaagacagcagacgaagatgtgttcgacgccgcgtacatgcactgggtaagacaggctcctggccagacttttgagtggcttgggtggatgaaaccagtgacgggagccgtcaactatgcaaggaagttccaaggccgggtgtctttttaccgcacccgagaactgggtatcgcctatatggatttgcgtaatttaagattcgacgatacagctgtttacttttgtgcaaggaaaactgccggggacgtgtcaggagataagcggggcttctttttcgacctgtggggccgcgggagtagagtcattgtgagctcc

SEQ ID NO: 26329 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggaatgaagaaacccggtgctagcatgaccgtctcctgcaagacagcagacgaagatgttttcgacgccgcgtatatgcactgggtgagacaggctcctggccagacttttgagtggctggggtggatgaaaccagtaacgggagccgtgaactacgcaaggaagttccagggccgggtctctttttatcgcacccgagaactcggtatcgcctacatggatcttcgtaatctgagattcgacgatacagctgtgtatttttgtgcaaggaaaactgccggggacgtttcaggagataagcggggcttctttttcgacttgtggggccgcgggagtagagtgattgtcagctcc

SEQ ID NO: 26330 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggagtcaagaaacccggtgctagcgttaccctgtcctgcaagacagcagacgaagatgtgttcgacgccgcgtatatgagatgggtaaggcaggctcctggccagacttttgagtggctcgggtggatgaaaccagtgacgggagccgtctcttacgcacggaagttccagggccgcgtgtcattttatatgacccgagaacttggtatggcctacatggatctgcgtaacttgagattcgacgatacagctgtttatttttgtgcaaggaaaactgccggggacgtgagtggagataatcggggctacttctttgacttatggggccgcgggagcagagtcatcgtgtcctct

SEQ ID NO: 26331 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaacccggcgggggagtcaagaaacctggtgccagcgttaccctgtcctgcaagacagctgacgaagatgtgttcgacgcagcctatatgcactgggtaagacaggcgccaggccagacttttgagtggctcgggtggatgaaaccggtgacgggagctgtctcttacgccaggaagttccagggccgggtgtcattttatatgacccgcgaacttggtatggcatacatggatctgcgaaacttgcgtttcgacgatacagccgtttatttttgtgctagaaaaactgcaggggacgtgagtggagataataggggctacttctttgacttatggggccgggggagccgcgtcatcgtgtcctct

SEQ ID NO: 26332 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcggggaagtcaagaaacccggagctagcgttaccctgtcctgcaagacagcagacgaggatgtgttcgacgccgcgtatatgcactgggtaagacaggctcctggtcagacttttgaatggctcggctggatgaaaccagtgacgggggccgtctcttacgcaaggaagttccagggacgggtgtcattttatatgacccgcgagcttggcatggcctacatggatctgcgaaacttgcgtttcgacgatacagctgtttatttttgtgcaagaaaaactgccggtgacgtgagtggggataataggggatacttctttgacttatggggccggggcagccgcgtcatcgtgtcctct

SEQ ID NO: 26333 - RNA, 381 nt, synthetic construct
  misc_feature 1..381: note = derived and/or modified sequence opt3 from anti-HIV-1_HeavyChain
  source 1..381: mol_type = other RNA
caggtgcaactggtccagagcggcgccgaggttaagaaacccggggcttccgtgagagtatcttgccaggcatcaggatacatcttcaccggttattttgtgaactggctcaggcagcttcctggccaacggccagaatggatggggtggattcgcccgaagagtggagcccgaaatcaggcgcgtcagttccagcccagaataagcctgacaagggaccgggctttgtccactgcctacttagattctaactcgctgacgtcagcagacagcggcacctatttttgtgcccgccaaacattcaaacctgatttttacttcgctgaccagggttggagttttaatctatgggggagaggagcacacttcatcgtctcctct

SEQ ID NO: 26334 - RNA, 381 nt, synthetic construct
  misc_feature 1..381: note = derived and/or modified sequence opt3 from anti-HIV-1_HeavyChain
  source 1..381: mol_type = other RNA
ggctgcatctggacccaggccgggggaggtgtgaagaaacccggcgctagcgtcacactgtcctgtaagactgcagacgaggatgttttcgacgccgcgtacatgcactgggtgagacaagctcctgggcagacgtttgaatggctcggatggatgaaaccagtaaccggcgccgtgtcttatgcaaggaagttccagggtcgggtctcattttacatgacacgcgagcttgggatggcctatatggatctgcgaaacttgcgtttcgacgatactgctgtgtacttttgcgcaagaaaaaccgccggagacgttagtggcgataataggggctatttctttgacttatgggggcggggaagccgcgtgattgtctcctct

SEQ ID NO: 26335 - RNA, 381 nt, synthetic construct
  misc_feature 1..381: note = derived and/or modified sequence opt3 from anti-HIV-1_HeavyChain
  source 1..381: mol_type = other RNA
agatgcatctggaggcaggccggcgggggaatgaagaaacccggtgctagcatgaccgtgtcctgtaagacagcagacgaggatattttcgacgccgcgtacatgcactgggtccggcaagctcctggccagacttttgaatggctggggtggatgaaaccagttacgggagccgtgaactatgcacgccagttccagggccgagtatctttttaccgtaccagagagctcggtatagcctatatggatcttagggacctgaagttcgatgacacagctgtgtacttttgcgcacggaaaactaagggggatgtctcaggagacgatcgcggcttctttttcgacttgtggggcagagggaccagggtgatcgttagtagc

SEQ ID NO: 26336 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggagtcaagaaacccggtgctagcgttaccctgtcctgcaagacagcagacgaagatgtgttcgacgccgcgtatatgcactgggtaagacaggctcctggccagacttttgagtgggtggggtggatgaaaccagtcacgggagccgtgtcttacgcaaggaagttccagggccgggtttcattttatatgacccgcgaactcggtatggcctacatggatcttcgaaacctgcgtttcgacgatacagctgtgtatttttgtgcaagaaaaactgccggggacgtcagtggagataataggggctacttctttgacttgtggggccgggggagccgcgtgatcgtatcctct

SEQ ID NO: 26337 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggagtcaaggaacccggtgctagcgttaccctgtcctgcaaaacagcagacgaggatgtgttcgacgccgcgtatatgcactgggtaagacaggctcctggccagacttttgaatggctcgggtggatgaagccagtgacgggagccgtcaactacgcaaggaaattccagggccgggtgtctttttatcgcacccgagagcttggtatcgcctacatggatctgcgtaatttgagattcgacgatacagctgtttatttttgtgcaaggaagactgccggggacgtgtcaggagataaacggggcttctttttcgacttatggggccgcgggagtagagtcattgtgagctcc

SEQ ID NO: 26338 - RNA, 381 nt, synthetic construct
  misc_feature 1..381: note = derived and/or modified sequence opt3 from anti-HIV-1_HeavyChain
  source 1..381: mol_type = other RNA
caggcccacctggagcaaagcggctccggggtgaagaaacccggagcttctgtcagagtttcatgctggagtagcgaagacatcttcaagaccgagctcattcattgggtgaggcaggcacctggtcagggccttgaatggatagggtgggtaaaaacagtgactggagccgtcaactttggctccctggatttccggcaccgcatctctttgacgcgagaccgtgatttatttaccgcgcatatggacattagaggtctgacacagggggatactgctacctacttctgtgccaggcaaaagtttgagtcgcggtatacaggaggccagggctggtacttcgacctatgggggcgcggaacccacatcgtggtttcaagc

SEQ ID NO: 26339 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtggatgaagacagtaactggagccgtgaactttggctccctggatttccgccaccgaatctctttgacgcgtgacagagatttatttaccgcgcatatggacattaggggtctggctcagggggatacagccacttacttctgtgcacggcaaaaatttgaatcgcgctataccggaggccagggctggtacttcgacctatgggggagaggaacacacatcgtcgtgtcaagc

SEQ ID NO: 26340 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcctggatttccgccaccgaatctccttgacccgtgacagagatttatttacagcgcatatggacattaggggtctgactcagggggataccgctacatacttctgtgcccggcaaaaatttgaatctcgctataccggaggccagggctggtacttcgacctatgggggagaggaactcacatcgtggtttcgtca

SEQ ID NO: 26341 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgtatatggatatcagaggactgacacaggacgatactgctacctacttttgtgccaggcaaaaattcgcaagtcggtattccggcgaccagggttcttactttgatctatgggggcgcggaacactcattgtcgtgagctcc

SEQ ID NO: 26342 - RNA, 384 nt, synthetic construct
  misc_feature 1..384: note = derived and/or modified sequence opt3 from anti-HIV-1_HeavyChain
  source 1..384: mol_type = other RNA
agccacacctggaacaatagaggctccgccatgaagaaacccggggcttctgtgagggtctcatgctggacaagtgaggacatcttcgatactacggaactgatttactgggttcggcaggcacctggacaaggtctcgagtggataggctgggtgaagatcgtaagcgggaccgtgaactttgcctcccttgacttccgcaatcgaatttctctgtcgcgtgatagagacttgtcaacagcgtatatggatatcaggggattaactcaggacgataccgctacatacttttgtgcccggcagaaattcgcaagccgctatagtggcgaccagggttcctactttgatctgtgggggagaggaaccctaattgtcgtgtctagc

SEQ ID NO: 26343 - RNA, 381 nt, synthetic construct
  misc_feature 1..381: note = derived and/or modified sequence opt3 from anti-HIV-1_HeavyChain
  source 1..381: mol_type = other RNA
cagagccacctggagcaatccggctctgccatgaagaaacccggggcttcagtgagagtcagttgctggaccagcgaagacatcttccataacgagctcatttactgggttaggcaggcacctggacagggtcttgaatggataggctgggtgaagatcgtatccgggacagtgaattttgcctctctggatttccggaaccgcatttcgttgtcacgagaccgtgatttaagcactgcgtatatggacatcagaggactgacgcaggatgacaccgctacatacttttgtgccaggcaaaaattcgcaagtcggtattccggcgatcagggttcttactttgacctatgggggcgcggaactctcattgtcgtgagctcc

SEQ ID NO: 26344 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtggatgaagactgtaacgggagccgtgaactttggcagcctggatttccgccaccgaatctccttgacccgtgacagagatttatttacagcgcatatggacattaggggtctgactcagggggataccgctacatacttctgtgcccggcaaaaatttgaatctcgctataccggaggccagggctggtacttcgacctatgggggagaggaactcacatcgtcgtgtcgtca

SEQ ID NO: 26345 - RNA, 381 nt, synthetic construct
  misc_feature 1..381: note = derived and/or modified sequence opt3 from anti-HIV-1_HeavyChain
  source 1..381: mol_type = other RNA
caggtgttcatggagcaagccggcggggaagtcaagaaacccggagctagcatgaccgtttcctgcaagacagcagacgaggatgtgtttgacgccgcgtacatgcactgggtaagacaggctcctggtcagactttcgaatggctgggctggatgaaaccagtgacgggggccgtcaactatgcaaggcagtttcaaggacgggtgtctttctaccgcacccgagagctcggcatcgcctatatggatcttcgtgacctgaagtttgatgacacagctgtttacttctgtgcaagaaaaactaagggtgatgtgtcaggggacgataggggatttttctttgacttgtggggccggggcacccgcgtcattgtgagtagc

SEQ ID NO: 26346 - RNA, 381 nt, synthetic construct
  misc_feature 1..381: note = derived and/or modified sequence opt3 from anti-HIV-1_HeavyChain
  source 1..381: mol_type = other RNA
caggcccacctggagcaaagcggctccggggtgaagaaactcggagcttctgtcagagtttcatgctggaccagtgaagacatcttcgaggatgaacttattcattgggtgaggcaggcacccggtcagggcctggagtggatagggtgggtaaagatcgtgagcggaacagtcaactttgcctccttggacttccggaatcgcatttctttatcgcgagatcgtgacctgtcaactgcgtacatggatatcagaggcctaacgcaggacgataccgctacatatttttgtgccaggcaaaaattcgcaagccggtacagtggtgaccaggggtcctattttgatctctggggacgcggcactctgattgtggtttctagc

SEQ ID NO: 26347 - RNA, 381 nt, synthetic construct
  misc_feature 1..381: note = derived and/or modified sequence opt3 from anti-HIV-1_HeavyChain
  source 1..381: mol_type = other RNA
cagagccacctggagcaatccggctctgccatgaagaaacccggggcttcagtgagagtcagttgctggaccagcgaagacatcctcaaggcagagcttatttactgggttaggcaggcccctggacggggtctggaatggataggctgggtgaaaacagtatccgggactgtgaacttcggatcttcggattttcgcaatcgaatctcattgacgcgtgacagagatttaagcaccgcgcatatggacattaggggcctgacacaggatgacactgctacctatttctgtgcccggcagaagtttgagagtctatactccgatgaccaaggttcttatttcgatctctgggggcgcggaacactgatcattgtcagctcc

SEQ ID NO: 26348 - RNA, 381 nt, synthetic construct
  misc_feature 1..381: note = derived and/or modified sequence opt3 from anti-HIV-1_HeavyChain
  source 1..381: mol_type = other RNA
caggtgcaactggtccagagcggcgccgaggttaagaaacccggggcttccgtgaaggtatcttgcaaagcatcaggatacagtttcaccgactattacatccactggctcagacaggtgcagggtcaaaggcctgaatggatgggctggattcggccacgcacaggggcccgaaaccaggcgcgtcagtttcagccgagaataagccttactagggatcgggctctgtccacggcctatttggacttaaattctctgacctcggcagattcaggaacatacttctgtgcccgccaaacttttaagcccgacttctattttgctgatcagggctggagcttcaacctatggggtagaggggcacattttatcgtcagttcc

SEQ ID NO: 26349 - RNA, 381 nt, synthetic construct
  misc_feature 1..381: note = derived and/or modified sequence opt3 from anti-HIV-1_HeavyChain
  source 1..381: mol_type = other RNA
caggtgttcatggagcaagccggcggggaagtcaagaaacccggagctagcatgaccgtttcctgcaagacagcagacgaggatgtgtttgacgccgcgtacatgcactgggtaagacaggctcctggtcagactttcgaatggctgggctggatgaaaccagtgacgggggccgtcaactatgcaaggaagtttcagggacgggtgtctttctaccgcacccgagagctcggcatcgcctatatggatcttcgtgacctgaaatttgatgacacagctgtttacttctgtgcaagaaagactaagggtgatgtgtcaggggacgataggggatttttctttgacttgtggggccggggcacccgcgtcattgtgagtagc

SEQ ID NO: 26350 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggcgctggggtgaagaaacccggagcatccgtcagagtttcttgctggacctcagaagacatcttcgagaggacagaactcattcattgggtgcggcaggcccctggtcagggccttgagtggatagggtgggtaaagactgtgacgggagcggtcaactttggcagtctggatttccgccaccgaatcagcttgacccgtgacagagatttatttacagctcatatggacattaggggtctgactcagggggataccgccacatacttctgtgcacggcaaaaatttgaatcccgctataccggaggccagggctggtacttcgacctatgggggagaggaactcacatcgtggtttcttcg

SEQ ID NO: 26351 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggcgctggggtgaagaaacccggagcatccgtcagagtttcttgctggtcaagtgaagacatcttcgagaggaccgaactcattcattgggtgcggcaggcccctggtcagggccttgagtggatagggtgggtaaagacagtgactggagcggtcaactttggcagcctggatttccgccaccgaatctccttgacgcgtgacagagatttatttaccgctcatatggacattaggggtctgacacagggggatactgccacctacttctgtgcacggcaaaaatttgaatctcgctatacaggaggccagggctggtacttcgacctatgggggagaggaacccacatcgtggtttcgtca

SEQ ID NO: 26352 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctgggcaagcgaagacatcttcgataccacagagctcatttactgggttaggcaggcccctggacagggtcttgaatggataggctgggtgaagatcgtatccgggactgtgaactttgcgtctctggacttccggaatcgcatttcgttgtcacgagatcgtgacttaagcacggcttatatggatatcagaggactgacccaggacgatacagccacttacttttgtgcaaggcaaaaattcgccagtcggtattccggcgaccagggttcttactttgatctatgggggcgcggaaccctcattgtcgtgagctcc

SEQ ID NO: 26353 - RNA, 381 nt, synthetic construct
  misc_feature 1..381: note = derived and/or modified sequence opt3 from anti-HIV-1_HeavyChain
  source 1..381: mol_type = other RNA
agatgcaggctggtgcagagcggcgccgaggtcaagaaacccggggcttccgttcgggtgtcttgtcaagcatcaggatacaccttcagtgcctatggtgtaaactgggtgcgccaggcgcctggccaggaactcgagtggatcgggtgggtcaagacagtgactggagctgttaattttggcagcccaaacttccgacaccgtatttcccttacgagagacagggatctgtttaccgcccatatggacatacggggtttgacacagggggatactgcaacctacttctgcgcccgccaaaaatttgaatctagatatacaggaggccagggctggtacttcgacttatgggggaggggaacccacatcgtggtctcgtca

SEQ ID NO: 26354 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggagtagcgaagacatcttcgagaggaccgaactcattcattgggtgtgtcaggcacctggtcagggccttgagtggatagggtgggtaaagacagtgactggagccgtcaactttggctccctggatttccggcaccgcatctctttgacgcgagaccgtgatttatttaccgcgcatatggacattagaggtctgacacagggggatactgctacctacttctgcgccaggcaaaaatttgaatcgcggtatacaggaggccagggctggtacttcgacctatgggggcgcggaacccacatcgtggtttcaagc

SEQ ID NO: 26355 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagatcgtgacaggagccgtcaactttggctccctggatttccgccaccgaatttctttgactcgtgacagagatttatttacggcgcatatggacatcaggggtctgacccagggggatacagctacttacttctgtgcccggcaaaaatttgaatcgcgctataccggaggccagggctggtacttcgacctatgggggagaggaacacacattgtggtttcaagc

SEQ ID NO: 26356 - RNA, 384 nt, synthetic construct
  misc_feature 1..384: note = derived and/or modified sequence opt3 from anti-HIV-1_HeavyChain
  source 1..384: mol_type = other RNA
caggtgcaactggtccagagcggcctcgaggttaagaaacccggggcctccgtgagagtatcttgctggacctcagaagacatcttcgatacaactgagcttatttactgggtgaggcaggctcctggacagggtctggaatggataggctgggtcaagatcgtgagtgggacggttaactttgccagcttggacttccggaatcgcatttccttatctcgagatcgtgacctgtcgaccgcacacatggatatcagaggactaacacaagacgatactgcgacctatttttgtgctaggcagaaattcgcctcacggtacagcggcgaccagggtagttattttgatctctgggggcgcggaacactgattatcgtgtcctct

SEQ ID NO: 26357 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgcatatggatatcagaggactgaggcaggacgatacagctacttatttttgtgcccggcaaaaattcgagagtcgctactccggcgaccagggttcttattttgatctatgggggagaggaaccctcattatcgtcagctcc

SEQ ID NO: 26358 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagtttgcatcacggtatagcggagaccagggcagttacttcgatctgtggggccgcgggacactaattgttgtgtcctct

SEQ ID NO: 26359 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtttacagcgcatatggatatcaggggtttaactcagggggacaccgctacatacttctgtgcccggcaaaaatttgaatctcgctataccggaggccagggctggtacttcgatctgtgggggagaggaactcacattgttgtgtcgtca

SEQ ID NO: 26360 - RNA, 384 nt, synthetic construct
  misc_feature 1..384: note = derived and/or modified sequence opt3 from anti-HIV-1_HeavyChain
  source 1..384: mol_type = other RNA
agacacacctgggagcagagcggctccggggtgaagaaacccggagcctctgtcagggtttcatgctggacaagtgaagacatcttcgaaaagagcgagctgattcattgggtgcggcaagctcctggtcagggcctcgagtggatagggtgggtaaaaactgtgacgggagcagtcaactttggctcctctgatttccgccagcgagtgtcgcttacccgtgacagagatctgtcaacagcctacatggacatcaggggtttgactcaggatgacaccgcgacatatttttgtgctcggcaaaagttcgccagccgctacagtggggatcagggatcctattttgacttatggggcagaggcaccctgattgttgtgtctagc

SEQ ID NO: 26361 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgtatatggatatcagaggactgacacaggacgatactgctacctacttttgtgccaggcaaaaattcgagagtcggtatacaggcggtcaggggtggtactttgacctatggggacgcggcacccatattgtcgtgtcctct

SEQ ID NO: 26362 - RNA, 384 nt, synthetic construct
  misc_feature 1..384: note = derived and/or modified sequence opt3 from anti-HIV-1_HeavyChain
  source 1..384: mol_type = other RNA
caggtgcaactggtccagagcggcgccgaggttaagaaacccggggcttccgtgagagtatcttgctggacctcagaagacatcttcgatacaactgagctcatttactgggtgaggcaggcacctggacagggtcttgaatggataggctgggtcaagatcgtgagtgggacggttaactttgccagcctggacttccggaatcgcatttccttgtctcgagatcgtgacttatcgaccgcgcacatggatatcagaggactgacacaagacgatactgctacctatttttgtgccaggcagaaattcgagtcacggtacacaggcggtcaggggtggtattttgacctatggggacgcggcacccatattgtggtcagcagt

SEQ ID NO: 26363 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgtatatggatatcagaggactgacacagggcgacactgctacctacttttgtgccaggcaaaaattcgagagtcggtatacaggtgggcagggatggtactttgatctatggggccgcggcacccatattgtcgtgtcctct

SEQ ID NO: 26364 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgagcggagccgtcaactttggctccccagatttccgccaccgaatctctctgtcgcgtgacagagatttgtcaacggcgcatatggacattaggggtttaacccaggatgacacagctacttacttttgtgcccggcaaaaattcgcaagccgctatagtggggatcagggatcctactttgacctgtggggcagaggcaccctaatcattgtgtctagc

SEQ ID NO: 26365 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcgcggccttgagtggatagggtgggtaaagactgtgagcggaacggtcaactttggctcctctgatttccgaaatcgtgtgtcgctgaccagagacagggatttgtcaacagcccacatggacatccggggtttaactcaggatgacaccgcgacatacttttgtgctcgccagaaattcgaaagcctgtatagtgatgaccaagggtcctactttgatctatggggaagaggcaccctcattatcgtttctagc

SEQ ID NO: 26366 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgcaaccgaatctccctgacccgtgatagagacttgtctacagcgcacatggatattaggggtttaactcaggacgataccgctacatacttttgtgcccggcaaaaattcgaatcgctgtattcagacgatcaggggagctactttgacctatggggacgcggcaccctcatcattgtgagttcc

SEQ ID NO: 26367 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagagacccggggcttcagtgagggtcagttgctggaccagcgaagacatcttcgatacaactgagctcatttactgggttcggcaggcacctggacagggtcttgaatggataggctgggtgaaaatcgtatccgggacggtgaactttgcctctctggacttccgcaatcgaatttcgttgtcacgtgatagagacttaagcaccgcgtatatggatatcaggggactgacacaggacgatactgctacctacttttgtgcccggcaaaagttcgcaagtcgctattccggcgaccagggttcttactttgatctatgggggagaggaacactcattgtcgtgagctcc

SEQ ID NO: 26368 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgcaatcgaatctctttatcgcgtgacagagatctgtcaactgcttatatggacattaggggtctaacgcaggatgacaccgccacatacttctgtgcacggcaaaaatttgccagccgctatagtggggatcagggatcctacttcgacctctggggcagaggcactctgatcgtggtttctagc

SEQ ID NO: 26369 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcctggatttccgccaccgaatctccttgacccgtgacagagactttttcacagcgcatatggatattaggggtttaactcagggggataccgctacatacttttgtgcccggcaaaaattcgaatctcgctataccggaggccagggctggtactttgacctgtgggggagaggaactcacatcgtggtttcgtca

SEQ ID NO: 26370 - RNA, 381 nt, synthetic construct
  misc_feature 1..381: note = derived and/or modified sequence opt3 from anti-HIV-1_HeavyChain
  source 1..381: mol_type = other RNA
caggcccacctggagcaaagcggctccggggtgaagaaacccggagcttctgtcagagtttcatgctggagtagcgaagacatcttcaggaccgagctcattcattgggtgcggcaggcacctggtcagggccttgaatggatagggtgggtaaagacagtgactggagccgtcaactttggctccctggatttccgccaccgaatctctttgacgcgtgacagagatttatttaccgcgcatatggacattaggggtctgacacagggggatactgctacctacttctgtgcccggcaaaaatttgagtcgcgctatacaggaggccagggctggtacttcgacctatgggggagaggaacccacatcgtggtttcaagc

SEQ ID NO: 26371 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtttacagcgcatatggatatcaggggtttaactcagggggacaccgctacatacttctgtgcccggcaaaaatttgaatctctgtattcggatgaccagggatcatacttcgatctatggggccgcggcaccctcattatcgttagcagt

SEQ ID NO: 26372 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgcatatggatatcagaggactgacacaggacgatactgctacctatttttgtgccaggcaaaaattcgcaagtcggtactccggcgaccagggttcttattttgatctatgggggcgcggaacactcattatcgtcagctcc

SEQ ID NO: 26373 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctcttcggacttccggaatcgcatttcactgagccgagatcgtgacttgagtaccgcgcatatggatatcagaggattaacacaggacgatactgctacctatttttgtgccaggcaaaaattcgcatcccggtactctggcgaccagggtagctattttgatctgtgggggcgcggaacactaattgtcgtgtcctca

SEQ ID NO: 26374 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggacagaactcatttactgggtgcggcaggcacctggtcgcggccttgagtggatagggtgggtaaagactgtgagcggaacggtcaactttggctcctctgatttccgaaatcgtatctcgctgaccagagacagggatttgtcaacagcccatatggacattcggggtttaactcaggatgacaccgcgacatatttttgtgctcgccagaaattcgaaagcctgtacagtgatgaccaagggtcctattttgatctatggggaagaggcaccctcatcattgtgtctagc

SEQ ID NO: 26375 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaagacatcttcgatacaactgagctcattcattgggttaggcaggcacctggacagggtcttgaatggataggctgggtgaagacggtaaccggggccgtgaactttggatccctggacttccggcaccgcatctctttgacacgagatcgtgacttatttactgcgcatatggatattagaggcctgacccagggtgacacagctacctacttctgtgccaggcaaaaatttgagtcgcggtatactgggggacagggctggtacttcgatctatggggccgcgggacacacatcgtcgtgtcaagc

SEQ ID NO: 26376 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaagacatcttcggaacaactgagctcatttactgggttaggcaggcacctggtcagggccttgaatggatagggtgggtgaagatcgtatccggaacggtgaactttgcctctctggatttccggaatcgcatttcgttgtcacgagaccgtgatttaagcaccgcgtatatggacatcagaggcctgacacaggatgacactgctacctacttttgtgccaggcaaaaattcgcaagtcggtattccggtgatcaggggtcttactttgacctatggggacgcggcacactcattgtcgtgagctcc

SEQ ID NO: 26377 - RNA, 384 nt, synthetic construct
  misc_feature 1..384: note = derived and/or modified sequence opt3 from anti-HIV-1_HeavyChain
  source 1..384: mol_type = other RNA
caggtgcaactggtccagagcggctccgccatgaagaaacccggggcttctgttagagtgtcatgctggaccagtgaggacatcttcgatacaactgaactcatttactgggtaaggcaggcacctggacagggtcttgagtggataggctgggtgaagatcgtcagcgggacggtgaactttgcctccctggacttccggaatcgcatttctttgtcgcgagatcgtgacttatcaaccgcgtatatggatatcagaggactgacacaagacgatactgctacctacttttgtgccaggcagaaattcgcaagccggtatagtggcgaccagggttcctactttgatctatgggggcgcggaacactcattgttgtgtctagc

SEQ ID NO: 26378 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaaggtatcttcgagaggacagaactcattcattgggtgcggcaggcacctggccaggggcttgagtggataggatgggtaaagactgtgacgggcgccgtcaactttggtagcctggacttccgccaccgaatctccttgacccgtgatagagacttatttacagcgcatatggatattagggggctgactcagggagacaccgctacatacttctgtgcccggcaaaaatttgaatctcgctataccggcggccaggggtggtacttcgatctatggggaagaggtactcacatcgtggtttcgtca

SEQ ID NO: 26379 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggacagaactcattcattgggcacggcaggcccctggtcagggccttgagtggatagggtgggtgaagactgtaacgggagcggtgaactttggcagcccaaatttccgccaccgagcttccctgacccgtgatagagacttgtttacagcccatatggatatcaggggtttaactgaaggggacaccgcaacatacttctgtgcccggcagaaatttgcttctcgctattcgggagatcaaggctcatacttcgacctgtggggcagagggaccctaattatcgtcagcagt

SEQ ID NO: 26380 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaagacatcttcgatacagcagagctcatttactgggttaggcaggcccctggacagggtcttgaatggataggctgggtgaagatcgtatccgggactgtgaactttgcgtctctggacttccggaatcgcatttcgttgtcacgagatcgtgacttaagcacggctcatatggatatcagaggactgaggcaggacgataccgccacatatttttgtgcacggcaaaaattcgagagtcgctactccggcgaccagggttcttattttgatctatgggggagaggaactctcattatcgtcagctcc

SEQ ID NO: 26381 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagaatgggtaaaggccgtgagcggggcggtcaactacggatccttggattttcgccaccgagtgtctttaactcgtgacagagatctgttcacggctcatatggacatcaggggcctaacccaggatgacacagccacttatttttgtgcacggcaaaaattcgagtcgcgctacaccggtgggcagggatggtattttgatctctggggcagaggcacacacattgttgtgtcaagc

SEQ ID NO: 26382 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgtatatggatatcagaggactgacacaggacgatactgctacctacttttgtgccaggcaaaaattcgcaagtcggtattccggcgaccagggttcttactttgatctatgggggcgcggaacactcgactgcgtcagctcc

SEQ ID NO: 26383 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccggggccgtgaactttgcgtctctggacttccggaatcgcatttcgttgtcacgagatcgtgacttaagcacggctcatatggatatcagaggactgacccaggacgatacagccacttatttttgtgcaaggcaaaaattcgccagtcggtactccggcgaccagggttcttattttgatctatgggggcgcggaaccctcattatcgtcagctcc

SEQ ID NO: 26384 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgtcgacggctcatatggacatcaggggtctaacccagggggatacagccacttatttctgtgcacggcaaaaatttgaatcacgctacaccggaggccagggctggtatttcgacctctgggggagaggaacacacattgttgtgagcagt

SEQ ID NO: 26385 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtcaaccgcgcacatggacatcagaggtttaacacaagatgacactgctacctacttttgtgccaggcagaagttcgaaagcctgtatagtgatgaccaggggtcctactttgatctatggggacggggcacactcattatcgtttctagc

SEQ ID NO: 26386 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggaaccgtcaactttggcagcctgaatttccgccaccgaatctccttgacacgtgatagagacttatttactgcccatatggatattaggggtctgacccagggggacacagcgacctacttctgtgctcggcaaaaatttgaatctcgctatactggaggccagggctggtacttcgatctatgggggagaggaacacacatcgtggtttcgtca

SEQ ID NO: 26387 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaagacatcttcgagaggacagaactcatttactgggttcggcaggcacctggacgcggtcttgagtggataggctgggtgaagatcgtatccgggactgtgaactttgcctctctggatttccgaaatcgtatttcgttgtcaagagacagggatttaagcacggcgcatatggacatccggggactgacccaggatgacacagctacttatttttgtgcccgccagaaattcgcaagtagatactccggcgatcaaggttcttattttgacctatgggggaggggaaccctcattatcgtcagctcc

SEQ ID NO: 26388 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgtatatggatatcagaggactgacacaggacgatactgctacctacttttgtgccaggcaaaaattcgcaagtcggtattccggcgaccagggttcttactttgatctatgggggcgcggaacactcattatcgtcagctcc

SEQ ID NO: 26389 - RNA, 384 nt, synthetic construct
  misc_feature 1..384: note = derived and/or modified sequence opt3 from anti-HIV-1_HeavyChain
  source 1..384: mol_type = other RNA
caggccagactggagcaaagcggctccggggtgaagaaactcggagcttctgtcagggtttcatgctggaccagtgaagacatcttcgagcggacagaacttattcactgggtgcgccaggcacccggtcagggcctggagtggatagggtgggtaaaggccgtgagcggagcggtcaactacggctccttggattttcgaaatcgtatctctttatcgagagacagggatctgtcaactgcttatatggacattcggggtctaacgcaggatgacaccgccacatacttctgtgcacgccaaaaatttgccagcagatatagtggggatcagggatcctacttcgacctctggggcaggggcactctgatcgtggtttctagc

SEQ ID NO: 26390 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccgctatgaagaaacccggggcatctgtgagagtctcatgctggaccagtgaagacatcttcgatacaactgagctcatttactgggttaggcaggcccctggacagggtcttgaatggataggctgggtgaagatcgtaagcgggacggtgaactttgcgtccctggacttccggaatcgcatttctttgtcgcgagatcgtgacttatcaaccgctcatatggatatcagaggactgacacaggacgatactgccacctatttttgtgcaaggcaaaaattcgccagccggtacagtggcgaccagggttcctattttgatctatgggggcgcggaacactcattatcgtctctagc

SEQ ID NO: 26391 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgtcaactttggctccctggatttccgccaccgaatctctttgacgcgtgacagagatttatcgaccgcgtacatggacattaggggtctgacacaggatgacactgctacctatttttgtgcccggcaaaaattcgcatcacgctacagcggggatcagggaagttattttgacctatggggcagaggcacactcatcgtggtttcctct

SEQ ID NO: 26392 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgcgaactttggctccctggatttccgccaccgaatctctttgacgcgtgacagagatttatttaccgctcatatggacattaggggtctgacacagggggatactgccacctacttctgtgcacggcaaaaatttgaatcgcgctatacaggaggccagggctggtacttcgacctatgggggagaggaacccacatcgtcgtgtcaagc

SEQ ID NO: 26393 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggagcgaactcattcattgggtgcggcaggcacctggtcagggccttgagtggatagggtgggtaaagacagtgactggagccgtcaactttggctccctggatttccgccaccgaatctctttgacgcgtgacagagatttatttaccgcgcatatggacattaggggtctgacacagggggatactgctacctacttctgtgcccggcaaaaatttgaatcgcgctatacaggaggccagggctggtacttcgacctatgggggagaggaacccacatcgtggtttcaagc

SEQ ID NO: 26394 - RNA, 381 nt, synthetic construct
  misc_feature 1..381: note = derived and/or modified sequence opt3 from anti-HIV-1_HeavyChain
  source 1..381: mol_type = other RNA
agatgcatctggaggcaggccggcgggggagtgaagaaacccggtgctagcgtcaccctgtcctgtaagacagcagacgaggatgttttcgacgccgcgtacatgcactgggtgcggcaagctcctggccagacttttgaatggctcgggtggatgaaaccagtaacgggagccgtgtcttatgcacgcaagttccagggccgagtctcattttacatgacccgtggtattagaatggcctatatggatcttaggaacctgcggttcgacgatacagctgtgtacttttgcgcacgcaaaactgccggggacgttagtggagataatagaggctatttctttgacttgtggggcagggggagccgggtgatagtctcctct

SEQ ID NO: 26395 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaagacatcttcgagaggacagaactcatttactgggttcggcaggcacctggacgcggtcttgagtggataggctgggtgaagatcgtatccgggactgtgaactttgcctctctggatttccgaaatcgtatttcgttgtcaagagacagggatttaagcacggcgtatatggacatccggggactgacccaggatgacacagctacttacttttgtgcccgccagaaattcgcaagtagatattccggcgatcaaggttcttactttgacctatgggggaggggaaccctcattgtcgtgagctcc

SEQ ID NO: 26396 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaagacatcttcgagaggacagaactcattcattgggttcggcaggcacctggacagggtcttgagtggataggctgggtgaagactgtaacgggggccgtgaactttggatccctggatttccgccaccgaatctctttgacccgtgacagagatttatttacagcgcatatggacattaggggcctgactcagggtgataccgctacatacttctgtgcccggcaaaaatttgaatcgcgctataccgggggacagggctggtacttcgacctatggggcagagggactcacatcgtcgtgtcaagc

SEQ ID NO: 26397 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcgcggctcatatggatatcagaggactgacccaggacgatacagccacttatttttgtgcaaggcaaaaattcgccagtcggtactccggcgaccagggttcttattttgatctatgggggcgcggaaccctcattatcgtcagctcc

SEQ ID NO: 26398 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagatcgtgagcggagccgtcaactttggctccccaaatttccgccagcgagtgtctctgactcgtgatagagacttgtttacggcgcacatggatattaggggtttaacccaaggggacacagctacttacttctgtgcccggcagaaatttgcatcgcgctattcaggagatcagggcagctacttcgacctgtggggcagagggaccctaatcgttgtgagttcc

SEQ ID NO: 26399 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgtcaactttggctccctggatttccgccaccgaatctctttgacgcgtgacagagatttatttaccgcgcatatggacattaggggtctgacacagggggatactgctacctacttctgtacacggcaaaaatttgaatcgcgctataccggaggccagggctggtacttcgacctatgggggagaggaactcacatcgtggtttcaagc

SEQ ID NO: 26400 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggcccagagtggatagggtgggtaaagacagtgactggagccgtcaactttggctcccttgatttccgccaccgaatctctctgacgcgtgacagagatttgtttaccgcgcatatggacattaggggtttaacacagggggatactgctacctacttctgtgcccggcaaaaatttgaatcgcgctatacaggaggccagggctggtacttcgacctgtgggggagaggaacccacatcgtggtttcaagc

SEQ ID NO: 26401 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgtcaactttggcccactggatttccgccaccgaatctccttgacgcgtgacagagatttatttaccgcgcatatggacattaggggtctgacacagggggatactgctacctacttctgtgcccggcaaaaatttgaatctcgctatacaggaggccagggctggtacttcgacctatgggggagaggaacccacatcgtggtttcgtca

SEQ ID NO: 26402 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggccccgccatgaagaaacctggggcttctgtgagagtctcatgctggaccagtgaagacatcttcgagaggacagaactcatttactgggttcggcaggcaccaggacgcggtcttgagtggataggctgggtgaagactgtaagcgggacggtgaactttggatcctctgatttccgaaatcgtatctcgctgaccagagacagggatttgtcaacagcccatatggacattcggggcttaactcaggatgacaccgcgacatatttttgtgctcgccagaaattcgaaagcctgtacagtgatgaccaaggttcctattttgatctatgggggagaggaaccctcatcattgtctctagc

SEQ ID NO: 26403 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtggattaagcaccgcgcatatggacatcagaggcctgacacaggatgacactgctacctatttttgtgccaggcaaaaattcgcaagtcggtactccggtgatcaggggtcttattttgacctatggggacgcggcacactcattatcgtcagctcc

SEQ ID NO: 26404 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgagcggagccgtcaactttggctccccaaatttccgccaccgagtgtctctgacgcgtgatagagacttgtttaccgcgcatatggatatcaggggtttaacacagggggacactgctacctacttctgtgcccggcaaaaatttgcatcgcgctattcaggagatcagggcagctacttcgacctgtggggcagagggacactaattatcgttagttcc

SEQ ID NO: 26405 - RNA, 384 nt, synthetic construct
  misc_feature 1..384: note = derived and/or modified sequence opt3 from anti-HIV-1_HeavyChain
  source 1..384: mol_type = other RNA
cagagccacctggagcattccggctctgccatgaagaaacccggggcttcagtgagagtcagttgctggaccagcgaagacatcttcgatacaactgagctcatttactgggttaggcaagcacctggacagggtcttgaatggataggctgggtgaagatcgtatccgggacggtgaactttgcctctctggacttccggaatcgcatttcgttgtcacgagatcgtgacttaagcaccgcgtatatggatatcagaggactgacacaggacgatactgctacctacttttgtgccaggcagaaattcgcaagtcggtattccggcgaccaaggttcttactttgatctatgggggcgcggaacactcattgtcgtgagctcc

SEQ ID NO: 26406 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagatcgtgagcggagccgtcaactttggctccccaaatttccgccagcgagtgtctctgactcgtgatagagacttgtttacggcgcacatggatattaggggtttaacccaaggggacacagctacttacttctgtgcccggcagaaatttgaatcgctgtattcagatgaccagggaagctacttcgatctatggggccgcggcaccctcatcattgttagttcc

SEQ ID NO: 26407 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgagcggagccgtcaactttggctccccaaatttccgccaccgaatctctctgacgcgtgatagagacttgtttaccgcgcatatggatattaggggtttaacacagggggacactgctacctacttctgtgcccggcaaaaatttgaatcgcgctatacaggaggccagggctggtacttcgatctgtgggggagaggaacccacatcgtggtttcaagc

SEQ ID NO: 26408 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcgcttccggcgtgagaaggcccggggcatctgtccgggtttcatgctggaccagtgaagacatcttcgagcgcagcgaactcatttactgggtgcgacaggcccctggacgtggtcttgagtggataggctggatcaagctggtatccggggcggtgaactttggatctgtcgatttcagaaataggatttcgttgtcacgggaccgcgatttaagcacagctcatatggacatcagaggcctgaggcaggatgacactgccacgtatttttgtgcacggcagaaattcgaaagtcgctactccggtgatcaagggtcttattttgacctatggggacgaggcaccctcattatcgtgagctcc

SEQ ID NO: 26409 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcgcttccggcgtgaagagacccggggcatctgtcagggtttcatgctggaccagtgaagacatcttcgagcggacagaactcatttactgggtgcgccaggcccctggacagggtcttgagtggataggctgggtaaaaactgtgagcggggcggtcaactttggatcccaggatttccgagaccgtttttctctgacgagagatagggacttgtcgaccgctcatatggatatccggggcttaacacaagacgatactgccacctatttctgtgcacgccagaagtttgcctcaagatacagcggtgaccaggggagttatttcgatctgtggggaaggggcacactaattatcgtgtcctct

SEQ ID NO: 26410 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctccctggatttccggcaccgcatctctttgacgcgagaccgtgatttatttaccgcgcatatggacattagaggtctgacacagggggatactgctacctacttctgtgccaggcaaaagtttgaatcgcggtatacaggaggccagggctggtacttcgacctatgggggcgcggaacccacatcgtggtttcaagc

SEQ ID NO: 26411 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgagcggagccgtcaactttggctccccaaatttccgccaccgagtgtctctgacgcgtgatagagacttgtttaccgcgcatatggatatcaggggtttaacacaggacgatactgctacctacttctgtgcccggcaaaaatttgaatcgctgtattcagacgatcaggggagctacttcgacctatggggacgcggcacactcattatcgttagttcc

SEQ ID NO: 26412 - RNA, 384 nt, synthetic construct
  misc_feature 1..384: note = derived and/or modified sequence opt3 from anti-HIV-1_HeavyChain
  source 1..384: mol_type = other RNA
cagagccacctgaagcaatccggctctgccatgaaaaagcccggggcttcagtgagagtcagttgctggaccagcgaggacatcttcgaaaggacagagctcatttactgggttcggcaggcacctggacgcggtcttgaatggataggctgggtgaaaactgtatccgggacggtgaactttggatcttcggatttccgaaatcgtatctcactgaccagagacagggatttgagcacagcccatatggacattcggggcttaactcaggatgacaccgcgacatatttttgtgctcgccagaagttcgagagtctgtactccgatgaccaaggttcttattttgatctatgggggagaggaaccctcatcattgtcagctcc

SEQ ID NO: 26413 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgtcaactttggctccctggatttccgccaccgaatctctttgacgcgtgacagagatttatcgaccgcgcatatggacattaggggtctgacacaggatgacactgctacctacttttgtgcccggcaaaaattcgcatcacgctatagcggggatcagggaagttactttgacctatggggcagaggcacactcatcattgtgtcctct

SEQ ID NO: 26414 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgttcacggctcatatggacatcaggggtctaacccaggatgacacagccacttatttttgtgcacggcaaaaattcgaatcgcgctacaccgggggacagggctggtattttgatctctggggcagagggacacacattgttgtgtcaagc

SEQ ID NO: 26415 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtttacagcgcatatggatatcaggggtttaactcaggacgataccgctacatacttctgtgcccggcaaaaatttgaatctctgtattcggacgatcaggggtcatacttcgacctatggggacgcggcaccctcattatcgttagcagt

SEQ ID NO: 26416 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaagacatcctcgagaggacagaacttatttactgggttcggcaggcacctggacgcggtctggagtggataggctgggtgaagactgtatccgggacggtgaacttcggatcttcggattttcgaaatcgtatctcattgaccagagacagggatttaagcacagcccatatggacattcggggcctgactcaggatgacaccgcgacatatttctgtgctcgccagaaatttgaaagtctatactccgatgaccaaggttcttatttcgatctctgggggagaggaaccctgatcattgtcagctcc

SEQ ID NO: 26417 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccagcgagtgtccctgacccgtgatagagacttgtttacagcgcacatggatatcaggggtttaactcaaggggacaccgctacatacttctgtgcccggcagaaatttgcatctcgctattcgggagatcagggctcatacttcgacctgtggggcagagggaccctaattgttgtgagcagt

SEQ ID NO: 26418 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgaatctccctgacccgtgatagagacttgtttacagcgcatatggatattaggggtttaactcagggggacaccgctacatacttctgtgcccggcaaaaatttgaatctcgctataccggaggccagggctggtacttcgatctgtgggggagaggaactcacatcgtggtttcgtca

SEQ ID NO: 26419 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgacgatatcttcgaaaggacagagctcattcattgggtgcggcaggcacctggtcagggccttgaatggatagggtgggtaaagactgtgacgggagccgtcaactttggcagcccaaatttccgccagcgagtgtccctgacccgtgacagagatttgtttacagcgcacatggacatcaggggtttaactcaaggggataccgctacatacttctgtgcccggcagaaatttgagtctcgctataccggaggccagggctggtacttcgacctgtgggggagaggaactcatattgttgtgtcgtca

SEQ ID NO: 26420 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgcatatggatatcagaggactgacacaggacgatactgctacctatttttgtgccaggcaaaaattcgcaagtcggtactccggcgaccagggttcttattttgatctatgggggcgcggaacactcattgtcgtgagctcc

SEQ ID NO: 26421 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgcaaccgaatctccctgtctcgtgatagagacttgtcgaccgcgcacatggatattaggggtttaacacaggacgatactgctacctacttttgtgcccggcaaaaattcgcatcacgctatagcggggaccagggaagttactttgatctgtggggcagaggcacactaatcattgtgtcctct

SEQ ID NO: 26422 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcgcttccggcgtgaagagacccggggcatctgtcagggtttcatgctggaccagtgaagacatcttcgagcggacagaactcatttactgggtgcgccaggcccctggacagggtcttgagtggataggctgggtaaaaactgtgacgggggcggtcaactttggaagcctggatttccgacatcgtatctccttgaccagagacagggatttatttacagctcacatggacattcggggcctgactcagggtgataccgccacatatttctgtgcacgccaaaagtttgaatctagatacaccgggggacagggctggtatttcgacctatggggcagggggactcatatcgtggtttcgtca

SEQ ID NO: 26423 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcgcttccggcgtgagaaggcccggggcatctgtccgggtttcatgctggaccagtgaagacatcttcgagcgcagcgaactcatttactgggtgcgacaggcccctggacgtggtcttgagtggataggctggatcaagctggtatccggggcggtgaactttggatctgtcgatttcagagacagggtgtcgttgacacgggatcgcgacttatttactgctcatatggatattagaggcctgacgcaggacgataccgccacatatttctgtgcaaggcagaaatttgcctcacggtacagcggtgaccaagggagttatttcgatctatggggacgcggcactctcatcattgtttcctct

SEQ ID NO: 26424 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgagcggaacggtcaactttgcctccctggatttccgcaatcgaatctctttgtcgcgtgacagagatttatcaaccgcgtacatggacattaggggcctgacacaggatgacactgctacctatttttgtgcccggcaaaaattcgcaagccgctacagtggtgatcaggggtcctattttgacctatggggaagaggcacactcatcgtggtttctagc

SEQ ID NO: 26425 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgagcggagccgtcaactttggctccccaaatttccgccaccgaatctctctgtcgcgtgatagagacttgtcaacggcgtacatggatattaggggtttaacccaggacgatacagctacttatttttgtgcccggcaaaaattcgcaagccgctacagtggggaccagggatcctattttgatctgtggggcagaggcaccctaatcgtggtttctagc

SEQ ID NO: 26426 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgtcaactttggctccctggatttccgccaccgaatctctccaacgcgtgacagagatttgtttaccgcgcatatggacattaggggtttaacacagggggatactgctacctacttctgtgcccggcaaaaatttgaatcgcgctatacaggaggccagggctggtacttcgacctgtgggggagaggaaccctaatcgtggtttcaagc

SEQ ID NO: 26427 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaccaaccgcgtatatggatatcagaggactgacacaggacgatactgctacctacttttgtgccaggcaaaaattcgcaagccggtatagtggcgaccagggttcctactttgatctatgggggcgcggaacactcattgtcgtgtctagc

SEQ ID NO: 26428 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgcctccgggacggtaaactttgcgtctctggacttccggaatcgcatttcgttgtcacgagatcgtgacttaagcaccgctcatatggatatcagaggactgacacaggacgatactgccacctatttttgtgcaaggcaaaaattcgccagtcggtactccggcgaccagggttcttattttgatctatgggggcgcggaacactcattgtggtcagctcc

SEQ ID NO: 26429 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagacggtaaccggggccgtgaactttggatccctggacttccggcatcgcatctctttgacacgagatcgtgacttatttactgcgcacatggatattagaggcctgacccagggtgacacagctacctatttctgtgccaggcaaaaatttgagtcgcggtacactgggggacagggctggtatttcgatctatggggccgcgggacacatatcgtcgtgtcaagc

SEQ ID NO: 26430 - RNA, 384 nt, synthetic construct
  misc_feature 1..384: note = derived and/or modified sequence opt3 from anti-HIV-1_HeavyChain
  source 1..384: mol_type = other RNA
caggtgcaactggtccagagcggcgccgaggttaagaaacccggggcttccgtgagagtatcttgctggacctcagaagacatcttcgatacaactgagctcatttactgggtgaggcaggcacctggacagggtcttgaatggataggctgggtcaagatcgtgagtgggacggttaactttgccagcctggacttccggaatcgcatttccttgtctcgagatcgtgacttatcgaccgcgcacatggatatcagaggactgaggcaagacgatacagctacttatttttgtgcccggcagaaattcgagtcacgctacagcggcgaccagggtagttattttgatctatgggggagaggaaccctcattatcgtgtcctct

SEQ ID NO: 26431 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggcatcgcatttcgttgacccgagatcgtgacttatttacagcgcacatggatatcagaggactgactcagggcgacaccgctacatatttctgtgccaggcaaaaatttgagtcacggtacaccggtgggcagggatggtatttcgatctatggggccgcggcactcatattgtcgtgagcagt

SEQ ID NO: 26432 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcgcttccggcgtgaagagacccggggcatctgtcagggtttcatgctggaccagtgaagacatcttcgagcggagcgaactcatttactgggtgcgccaggcccctggacagggtcttgagtggataggctgggtaaaaacagtgactggggcggtcaactttggatccctggatttccgacatcgtatctctttgacgagagacagggatttatttaccgctcacatggacattcggggcctgacacagggtgatactgccacctatttctgtgcacgccaaaagtttgaatcgagatacacagggggacagggctggtatttcgacctatggggcagggggacccatatcgtggtttcaagc

SEQ ID NO: 26433 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagtttgaatcactgtatagcgacgatcagggaagttacttcgacctatggggccggggcacactcattatcgtttcctct

SEQ ID NO: 26434 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaagacatcttcgagaggacagaactcatttactgggttcggcaggcacctggacgcggtcttgagtggataggctgggtgaagactgtatccgggacggtgaactttggatcttcggatttccgaaatcgtatctcactgaccagagacagggatttgagcacagcccatatggacattcggggcttaactcaggatgacaccgcgacatatttttgtgctcgccagaaattcgaaagtctgtactccgatgaccaaggttcttattttgatctatgggggagaggaaccctcatcgtcgtgagctcc

SEQ ID NO: 26435 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgttcacggctcatatggacatcaggggtctaacccagggggatacagccacttatttttgtgcacggcaaaaattcgaatcgcgctacaccggaggccagggctggtattttgacctctgggggagaggaacacacattgttgtgtcaagc

SEQ ID NO: 26436 - RNA, 381 nt, synthetic construct
  misc_feature 1..381: note = derived and/or modified sequence opt3 from anti-HIV-1_HeavyChain
  source 1..381: mol_type = other RNA
caggcccacctggagcaaagcggctccggggtgaagaaacccggagcttctgtcagagtttcatgctggaccagtgaagacatcctcaggaaaagcgagcttattcattgggtgcggcaggcacctggtcagggcctggaatggatagggtgggtaaagacagtgactggagccgtcaacttcggccaccagatctccgatcgcgtgtctttgacgcgagaccgtgatttatcgaccgcgcatatggacattagaggtctgacacaagatgacactgctacctacttttgtgccaggcagaagttcgagtcactatatagcgatgaccaggggagttactttgatctctggggacggggcacactgatcattgtttcctct

SEQ ID NO: 26437 - RNA, 384 nt, synthetic construct
  misc_feature 1..384: note = derived and/or modified sequence opt3 from anti-HIV-1_HeavyChain
  source 1..384: mol_type = other RNA
cccgcccacctggagcagagcggctccggggtgaagaaacctggagcttctgtcagagtttcatgctgggcaagtgaagacatcttcgagaggaccgaactcattcattgggtgcggcaagccccaggtcagggccttgagtggatagggtgggtaaagacagtgactggagcggtcaactttggcagcctggatttccgccaccgaatctccttgacgcgtgacagagatttatttaccgctcatatggacattaggggtctgacacagggggatactgccacctacttctgtgcacggcagaaatttgaatctcgctatacaggaggccaaggctggtacttcgacctatgggggagaggaacccacatcgtggtttcgtca

SEQ ID NO: 26438 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcgcttccggcgtgaagagacccggggcatctgtcagggtttcatgctggaccagtgaagacatcttcgagcggagcgaactcatttactgggtgcgccaggcccctggacagggtcttgagtggataggctgggtaaaaacagtgtccggggcggtcaactttggatctactgatttccgagaacgtatctcgctgtcaagagacagggatttgagcacggcttatatggacattcggggcttaacccaggatgacgccgcaacatacttttgtgcccgccaaaagttcgctagtagatattccggtgatcaggggtcttactttgacctgtggggaaggggcactctaatcgtggttagctcc

SEQ ID NO: 26439 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgtcaactttggctccctggatttgcgccaccgaatctctttaacgcgtgacagagatctgttcaccgcgcatatggacattaggggtctaacacagggggatactgctacctacttttgtgcccggcaaaaattcgaatcgcgctatacaggaggccagggctggtactttgacctctgggggagaggaacccacatcgtggtttcaagc

SEQ ID NO: 26440 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcctggatttccgccaccgaatctccttgacccgtgacagagatttatttacagcgcatatggacattaggggtctgactcagggggataccgctacatacttctgtgcccggcaaaaatttgaatctcgctataccggaggccagggctggtacttcgacctatgggggagaggaactctcatcgtggtttcgtca

SEQ ID NO: 26441 - RNA, 384 nt, synthetic construct
  misc_feature 1..384: note = derived and/or modified sequence opt3 from anti-HIV-1_HeavyChain
  source 1..384: mol_type = other RNA
agccacgacctggagcagtccggctctgccatgaagaaacccggggcttcagtgagagtcagttgctggaccagcgaagatatcttcgacacaactgagctcatttactgggttaggcaagcacctggacagggtcttgaatggataggctgggtgaagatcgtatccgggacggtgaactttgcctctctggatttccggaatcgcatttcgttgtcacgagaccgtgatttaagcaccgcgtatatggacatcagaggactgacacaggatgacactgctacctacttttgtgccaggcagaaattcgcaagtcggtattccggcgatcaaggttcttactttgacctatgggggcgcggaacactcattgtcgtgagctcc

SEQ ID NO: 26442 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgactggagcggtcaactttggcagcttggatttccgccaccgaatctccttaacgcgtgacagagatctgtttaccgctcatatggacattaggggtctaacacagggggatactgccacctacttctgtgcacggcaaaaatttgaatctcgctatacaggaggccagggctggtacttcgacctctgggggagaggaacccacatcgtggtttcgtca

SEQ ID NO: 26443 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtttacagcgcatatggatatcaggggtttaactcagggggacaccgctacatacttctgtgcccggcaaaaatttgcatctcgctattcgggagatcagggctcatacttcgacctgtggggcagagggaccctaattgttgtgagcagt

SEQ ID NO: 26444 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctcttcggacttccggaatcgcatttcactgagccgagatcgtgacttgagtaccgcgcatatgggaatcagaggcttaaggcaggatgacacagctacttatttttgtgcccggcaaaaattcgagtcccgctactctggtgatcaggggagctattttgacctgtggggaagaggcaccctaattatcgtctcctca

SEQ ID NO: 26445 - RNA, 384 nt, synthetic construct
  misc_feature 1..384: note = derived and/or modified sequence opt3 from anti-HIV-1_HeavyChain
  source 1..384: mol_type = other RNA
gaggtgcagctggtccaaagcggcgccgacgttaagaaacccggggcttccgtgagagtatcttgctggacctcagaagatatcttcgacacaactgagctcatttactgggtgaggcaggcacctggacagggtcttgaatggataggctgggtcaagatcgtgagtgggacggttaactttgccagcctggatttccggaatcgcatttccttgtctcgagaccgtgatttatcgaccgcgtatatggacatcagaggactgacacaggatgacactgctacctacttttgtgccaggcaaaaattcgcatcacggtatagcggcgatcagggtagttactttgacctatgggggcgcggaacactcattgtggtctcctct

SEQ ID NO: 26446 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggagtagcgaagacatcttcgagaggaccgaactcattcattgggtgcaccaggcacctggtcagggccttgagtggatagggtgggtaaagacagtgactggagccgtcaactttggctccctggatttccggcatcgcatctctttgacgcgagaccgtgatttatttaccgcgcacatggacattagaggtctgacacagggggatactgctacctacttctgtgccaggcaaaaatttgaatcgcggtatacaggaggccagggctggtacttcgacctatgggggcgcggaacccatatcgtggtttcaagc

SEQ ID NO: 26447 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgcgttaagcaccgctcatatggacatcagaggactgacacaggatgacactgccacctatttttgtgcaaggcaaaaattcgccagtcggtactccggcgatcagggttcttattttgacctatgggggcgcggaacactcattatcgtcagctcc

SEQ ID NO: 26448 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgtcaactttgcgtccctggatttccgcaatcgaatctctttgtcgcgtgacagagatttatcaacggcttacatggacattaggggcctgacccaggatgacacagccacttatttttgtgcacggcaaaaattcgccagccgctacagtggtgatcaggggtcctattttgacctatggggaagaggcaccctcatcgtggtttctagc

SEQ ID NO: 26449 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcgcttccggcgtgagaaggcccggggcatctgtccgggtttcatgctggaccagtgaagacatcttcgagcgcagcgaactcatttactgggtgcgacaggcccctggacgtggtcttgagtggataggctggatcaagctggtatccggggcggtgaactttgcttctttggatttcagaaataggatttcgttatcacgggaccgcgatctgagcacagcctatatggacatcagaggactaactcaggatgacacggcaacctacttttgtgccaggcagaaattcgctagtcggtattccggcgatcaaggttcttactttgacctctgggggcgcggaacactgattgtcgtgagctcc

SEQ ID NO: 26450 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgtcaactttggctccctggatttccgccaccgaatctctttgacgcgtgacagagatttatttaccgcgcatatggacattaggggtctgacacaggatgacactgctacctacttctgtgcccggcaaaaatttgcatcgcgctattcaggggatcagggaagctacttcgacctatggggcagaggcacactcatcattgtgagttcc

SEQ ID NO: 26451 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttggctggatagggtgggtgaagatcgtatccggaacggtgaactttgcctctctggacttccggtcgcgcatttcattgagccgagatcgtgacttaagtaccgcgtatatggatatcagaggcctgacacaggacgatactgctacctacttttgtgccaggcaaaaattcgcatcccggtattctggtgaccaggggagctactttgatctatggggacgcggcacactcattgtcgtgtcctca

SEQ ID NO: 26452 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggccaagactgtaacgggagcggtgaactttggcagcctggatttccgccaccgaatctccttgacccgtgacagagatttatttacagctcatatggacattaggggtctgactcagggggataccgccacatacttctgtgcacggcaaaaatttgaatctcgctataccggaggccagggctggtacttcgacctatgggggagaggaactcacatcgtcgtgtcgtca

SEQ ID NO: 26453 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccgctatgaagaaacccggggcatctgtgagagtctcatgctggaccagtgaagacatcttcgagaggacagaactcatttactgggttcggcaggcccctggacgcggtcttgagtggataggctgggtgaagactgtaagcgggacggtgaactttggatcctctgatttccgaaatcgtatctcgctgaccagagacagggatttgtcaacagcgcatatggacattcggggcttaactcaggatgacaccgctacatatttttgtgcccgccagaaattcgaaagcctgtacagtgatgaccaaggttcctattttgatctatgggggagaggaaccctcatcattgtctctagc

SEQ ID NO: 26454 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttggatctctggacttccggcatcgcatttcgttgacccgagatcgtgacttatttacagcccacatggatatcagaggcctgactcagggtgacaccgcgacatatttctgtgctaggcaaaaatttgagtcacggtacaccgggggacagggctggtatttcgatctatggggccgcgggactcatattgtcgtgagcagt

SEQ ID NO: 26455 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaactcggagcttctgtcagagtttcatgctggaccagtgaagacatcttcgatacaactgagcttatttactgggtgaggcaggcacccggtcagggcctggaatggatagggtgggtaaagatcgtgagcggaacggtcaactttgcctccttggacttccggaatcgcatttctttatcgcgagatcgtgacctgtcaaccgcgtatatggatatcagaggcctaacacaggacgatactgctacctacttttgtgccaggcaaaaattcgcaagccggtatagtggtgaccaggggtcctactttgatctctggggacgcggcacactgattgtggtttctagc

SEQ ID NO: 26456 - RNA, 384 nt, synthetic construct
  misc_feature 1..384: note = derived and/or modified sequence opt3 from anti-HIV-1_HeavyChain
  source 1..384: mol_type = other RNA
agccacaacctggagcagtccggctctgccatgaagaaacccggggcttcagtgagagtcagttgctggaccagcgaagacatcttcgatacaactgagctcatttactgggttaggcaagcacctggacagggtcttgaatggataggctgggtgaagatcgtatccgggacggtgaattttgcctctctggacttccggaaccgcatttcgttgtcacgagatcgtgacttaagcaccgcgtatatggatatcagaggactgacacaggacgatactgctacctacttttgtgccaggcagaaattcgcaagtcggtattccggcgaccaaggttcttactttgatctatgggggcgcggaacactcattgtcgtgagctcc

SEQ ID NO: 26457 - RNA, 384 nt, synthetic construct
  misc_feature 1..384: note = derived and/or modified sequence opt3 from anti-HIV-1_HeavyChain
  source 1..384: mol_type = other RNA
agccacacctggaacaatagaggctccgccatgaagaaacccggggcttctgtgagggtctcatgctggacaagtgaggacatcttcgaacggactgagctgatttactgggttcgccaggcacctggacgaggtctcgaatggataggctgggtgaagacggtaagcgggaccgtgaactttggatcctctgatttccgtaatagaatctcgctttcaagggaccgggatctgagcacagcccatatggacattcgcggcttgactcaagatgacaccgcgacatatttttgtgctagacagaaattcgccagtaggtactccggtgatcaggggtcttattttgacttatggggacggggcaccctgatcattgtcagctcc

SEQ ID NO: 26458 - RNA, 384 nt, synthetic construct
  misc_feature 1..384: note = derived and/or modified sequence opt3 from anti-HIV-1_HeavyChain
  source 1..384: mol_type = other RNA
agccacacctggaacgagtccggctctgccatgaagaaacccggggcttcagtgagagtcagttgctggacaagcgaagacatcttcgagaggactgaactgatttactgggttcggcaggcacctggacgcggtctcgagtggataggctgggtgaagatcgtatccgggacggtgaattttgcctctcttgatttccgaaaccgtatttcgctgtcaagagacagggatttgagcaccgcgtatatggacatccggggattaacacaagatgacactgctacctacttttgtgcccgccagaaattcgcaagtagatattccggcgatcagggttcttactttgacctgtgggggaggggaacactaattgtcgtgagctcc

SEQ ID NO: 26459 - RNA, 384 nt, synthetic construct
  misc_feature 1..384: note = derived and/or modified sequence opt3 from anti-HIV-1_HeavyChain
  source 1..384: mol_type = other RNA
agacacacctgggagcagagcggctccggggtgaagaaacccggagcctctgtcagggtttcatgctggacaagtgaagacatcttcgagcggactgaactgattcattgggtgcgccaagctcctggtcagggcctcgagtggatagggtgggtaaagacggtgaccggagcagtcaactacggcagccttaattttcgatcccgtatctctctgacaagagatagggacttgttcactgcccacatggatattcggggtttaacccagggggacacagcgacctatttttgtgctcgccagaaattcgaatcgagatacactggaggccaaggctggtattttgatctgtgggggaggggaacacatatcgtggtttcaagc

SEQ ID NO: 26460 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcaaggtttcatgctggaccagtgaagacatcttcgagagaacagaactcattcattgggtgaggcaggcacctggtcagggccttgagtggatagggtgggtaaaaactgtgacgggagccgtcaactttggcagcctggatttccggcaccgcatctccttgacccgagaccgtgatttatttacagcgcatatggacattagaggtctgactcagggggataccgctacatacttctgtgccaggcaaaagtttgaatctcggtataccggaggccagggctggtacttcgacctatgggggcgcggaactcacatcgtggtttcgtca

SEQ ID NO: 26461 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagggtagcgaactcattcattgggtgaggcaggcacctggccaggggcttgagtggataggatgggtaaagacagtgactggcgccgtcaactttggttccgcgtacttccggcaccgcgtgtctctgacgcgagatcgtgacttgtcgaccgcttatatggatatcagagggttaacacaggacgatactgccacctacttttgtgcaaggcaaaaattcgcctcacggtatagcggagaccagggcagttactttgatctgtggggccgcgggacactaattgttgtgtcctct

SEQ ID NO: 26462 - RNA, 384 nt, synthetic construct
  misc_feature 1..384: note = derived and/or modified sequence opt3 from anti-HIV-1_HeavyChain
  source 1..384: mol_type = other RNA
ggccacgacctggagcagagcgggtccggagtgaagaaacccggtgcctctgtcagagtttcatgctggaccagtgaagatatcttcgagggcagcgaactcattcattgggtgaggcaagctcctgggcagggacttgagtggataggctgggtaaagacagtgactggtgcagtcaactttgggtccgcctacttccggcaccgcatctctctgtcgcgagaccgtgatttgtcaacggcgtatatggacattagaggattaacccaggatgacacagctacttacttttgtgccaggcagaaattcgcaagccggtatagtggcgatcaaggctcctactttgacctgtgggggcgcggaaccctaatcgtggtttctagc

SEQ ID NO: 26463 - RNA, 384 nt, synthetic construct
  misc_feature 1..384: note = derived and/or modified sequence opt3 from anti-HIV-1_HeavyChain
  source 1..384: mol_type = other RNA
agccacacctggaacaatagaggctccgccatgaagaaacccggggcttctgtgagggtctcatgctggacaagtgaagacatcttcgatactacggaactgatttactgggttcggcaggcacctggacaaggtctcgagtggataggctgggtgaagaccgtaagcgggacagtgaactttggatcctctgacttccgcaatcgaatctcgcttactcgtgatagagacctgtcaaccgcccatatggatattaggggcttgacacaggacgataccgcgacttatttttgtgctcggcagaaattcgagagcttatacagtgacgatcagggttcctattttgacctgtgggggcgcggaacactaatcattgtctctagc

SEQ ID NO: 26464 - RNA, 384 nt, synthetic construct
  misc_feature 1..384: note = derived and/or modified sequence opt3 from anti-HIV-1_HeavyChain
  source 1..384: mol_type = other RNA
agacacacctgggagcagagcggctccggggtgaagaaacccggagcctctgtcagggtttcatgctggacaagtgaagacatcttcgagcggactgaactgattcattgggtgcgccaagctcctggtcagggcctcgagtggatagggtgggtaaagacggtgagcggagcagtcaactttggctccccaaatttccgacaccgtgtgtctcttaccagagatagggacctgtttacagcccatatggatatccggggtttgactcagggggacaccgcgacatacttctgtgctcgccagaaatttgaatcgagatataccggaggccaaggctggtacttcgatttatgggggaggggaactcacattgttgtgtcaagc

SEQ ID NO: 26465 - RNA, 384 nt, synthetic construct
  misc_feature 1..384: note = derived and/or modified sequence opt3 from anti-HIV-1_HeavyChain
  source 1..384: mol_type = other RNA
agccacacctggaacaatagaggctccgccatgaagaaacccggggcttctgtgagggtctcatgctggacaagtgaggacatcttcgaacggactgagctgatttactgggttcgccaggcacctggacgaggtctcgaatggataggctgggtgaagacggtaagcgggaccgtgaactttggatcctctgatttccgtaatagaatctcgcttacaagggaccgggatctgtcaactgcccatatggacattcgcggcttgacccaagatgacacagcgacctatttttgtgctagacagaaattcgagagcttatacagtgatgaccagggttcctattttgatctgtgggggaggggaactctaatcattgtctctagc

SEQ ID NO: 26466 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgcctcgcaagcgaagacatcttcgataccacagagcttatttactgggttaggcaggcccctggacagggtctggaatggataggctgggtgaagatcgtatccgggactgtgaactttgcgtctttggacttccggaatcgcatttcgttatcacgagatcgtgacctgagcacggcttatatggatatcagaggactaacccaggacgatacagccacttacttttgtgcaaggcaaaaattcgccagtcggtattccggcgaccagggttcttactttgatctctgggggcgcggaaccctgattgtcgtgagctcc

SEQ ID NO: 26467 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggcgccgctatgaagaaacccggggcatctgtgagagtctcatgctggaccagtgaagacatcttcgatacaactgagctcatttactgggttaggcaggcccctggacagggtcttgaatggataggctgggtgaagatcgtaagcgggacggtgaactttgcgtccctggacttccggaatcgcatttctttgtcgcgagatcgtgacttatcaaccgctcatatggatatcagaggactgaggcaggacgatacagccacttatttttgtgcacggcaaaaattcgagagccgctacagtggcgaccagggttcctattttgatctatgggggagaggaaccctcattatcgtctctagc

SEQ ID NO: 26468 - RNA, 384 nt, synthetic construct
  misc_feature 1..384: note = derived and/or modified sequence opt3 from anti-HIV-1_HeavyChain
  source 1..384: mol_type = other RNA
agacacacctgggagcagagcggctccggggtgaagaaacccggagcctctgtcagggtttcatgctggacaagtgaagacatcttcgaaaagagcgagctgattcattgggtgcggcaagctcctggtcagggcctcgagtggatagggtgggtaaaaactgtgacgggagcagtcaactttggctcctctgatttccgccagcgagtgtcgcttacccgtgacagagatctgtttacagcccacatggacatcaggggtttgactcagggggataccgcgacatacttctgtgctcggcaaaagtttgaatcacgctataccggaggccagggctggtacttcgacttatgggggagaggaactcatattgttgtgagcagt

SEQ ID NO: 26469 - RNA, 384 nt, synthetic construct
  misc_feature 1..384: note = derived and/or modified sequence opt3 from anti-HIV-1_HeavyChain
  source 1..384: mol_type = other RNA
agccacacctggaacgagtccggctctgccatgaagaaacccggggcttcagtgagagtcagttgctggacaagcgaagacatcttcgatactacggagctgatttactgggttaggcaggcacctggacaaggtctcgaatggataggctgggtgaagatcgtatccgggaccgtgaattttgcctctcttgacttccggaaccgcatttcgctgtcacgagatcgtgacttgagcacagcgtatatggatatcagaggattaactcaggacgataccgctacatacttttgtgccaggcagaaattcgcaagtcggtattccggcgaccagggttcttactttgatctgtgggggcgcggaaccctaattgtcgtgagctcc

SEQ ID NO: 26470 - RNA, 384 nt, synthetic construct
  misc_feature 1..384: note = derived and/or modified sequence opt3 from anti-HIV-1_HeavyChain
  source 1..384: mol_type = other RNA
agacacacctggaacgagagcggctccggggtgaagaaacccggagcctctgtcagggtttcatgctggagtagcgaagacatcttcgagcggacagaactgattcattgggtgcgccaggctcctggtcgaggcctcgagtggatagggtgggtaaagactgtgtccggaacggtcaattttggttcttcggatttccgtaacagaatctcacttaccagggaccgggatctgagcacagcacacatggacattcgcggcttgactcaagatgacaccgccacatacttttgtgcgagacagaaattcgaaagtttatattccgatgaccaggggtcttactttgatctgtggggaaggggcaccctaatcattgtgagctcc

SEQ ID NO: 26471 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgaaatgaagaaacccggggcctcagtgagagtcagttgctggaccagcgaggacatcttcgatacaactgaactcatttactgggttaggcaggctcctggacagggtcttgagtggataggctgggtgaagatcgtatccgggacggtgaactttgcatctctggacttccggaatcgcatttcgttgtcacgagatcgtgacttaagcaccgcctatatggatatcagaggactgacacaggacgatactgcgacctacttttgtgctaggcaaaaattcgccagtcggtattccggcgaccagggttcttactttgatctatgggggcgcggaacactcattgtcgtgagctcc

SEQ ID NO: 26472 - RNA, 384 nt, synthetic construct
  misc_feature 1..384: note = derived and/or modified sequence opt3 from anti-HIV-1_HeavyChain
  source 1..384: mol_type = other RNA
agacacacctgggagcagagcggctccggggtgaagaaacccggagcctctgtcagggtttcatgctggacaagtgaagacatcttcgagcggactgaactgattcattgggtgcgccaagctcctggtcagggcctcgagtggatagggtgggtaaagacggtgaccggaacagtcaactttggcagccttaatttccgacagcgtgtgtccctgactagagatagggacttgtttaccgcacacatggatatccggggtttaacacagggggacaccgccacttacttctgtgcgcgccaaaaatttgaatctctgtattcggatgaccagggatcatacttcgatctatggggcagaggcacactcattatcgttagcagt

SEQ ID NO: 26473 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggagcgaactcattcattgggtgcggcaggcacctggtcagggccttgagtggatagggtgggtaaagacagtgactggagccgtcaactttggctcccagatcttccgccaccgaatttctctgacgcgtgatagagacttgtttaccgcgcatatggatatcaggggtttaacacaaggggacactgctacctacttctgtgcccggcagaaatttgaatcgcgctatacaggaggccagggctggtacttcgatctgtgggggagaggaacccacattgtggtttcaagc

SEQ ID NO: 26474 - RNA, 384 nt, synthetic construct
  misc_feature 1..384: note = derived and/or modified sequence opt3 from anti-HIV-1_HeavyChain
  source 1..384: mol_type = other RNA
agccacacctggaacaagtccggctctgccatgaaaaagcccggggcttcagtgagagtcagttgctggacaagcgaggacatcttcgaaaggactgagctgatttactgggttcggcaggcacctggacgcggtctcgaatggataggctgggtgaaaacggtatccgggaccgtgaattttggatcttcggatttccgaaaccgtatctcacttacaagagacagggatctgagcactgcccatatggacattcggggcttgacccaagatgacacagcgacctatttttgtgctcgccagaagttcgagagtttatactccgatgaccagggttcttattttgatctgtgggggagaggaactctaatcattgtcagctcc

SEQ ID NO: 26475 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgtcaactttggctcccagatcttccgccaccgaatttctctgacgcgtgatagagacttgtttaccgcgcatatggatatcaggggtttaacacaaggggacactgctacctacttctgtgcccggcagaaatttgaatcgcgctatacaggaggccagggctggtacttcgatctgtgggggagaggaccaaccctatttgtgtcaagc

SEQ ID NO: 26476 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcgcttccggcgtgagaaggcccggggcatctgtccgggtttcatgctggaccagtgaagacatcttcgagcgcagcgaactcatttactgggtgcgacaggcccctggacgtggtcttgagtggataggctggatcaagacatgttccggggcggtaaactttggatctgtggatttcagagacagggtctcgctgactcgggatcgcgacttgtttacggctcatatggatattagaggcttaacccagggtgacacagccacttatttctgcgcaaggcagaaatttgaatcacggtacaccgggggacaaggctggtatttcgatctgtggggccgcgggacacacatcgtggttagcagt

SEQ ID NO: 26477 - RNA, 384 nt, synthetic construct
  misc_feature 1..384: note = derived and/or modified sequence opt3 from anti-HIV-1_HeavyChain
  source 1..384: mol_type = other RNA
agccacaccgtggagcagtccggctctgccatgaagaaacccggggcttcagtcagagttagttgctggacaagcgaagacatcttcgatactacggagctgatttactgggtgaggcaagcacctggacagggtctcgaatggataggctgggtaaagatcgtgtccgggaccgtcaactttgcctctcttgacttccggaatcgcatttcgctgtcacgagatcgtgacttgagcacagcgtatatggatatcagaggattaactcaggacgataccgctacatacttttgtgccaggcagaaattcgcaagtcggtattccggcgaccaaggttcttactttgatctgtgggggcgcggaaccctaattgtggttagctcc

SEQ ID NO: 26478 - RNA, 384 nt, synthetic construct
  misc_feature 1..384: note = derived and/or modified sequence opt3 from anti-HIV-1_HeavyChain
  source 1..384: mol_type = other RNA
agacacacctggaacaagagcggctccggggtgaaaaagcccggagcctctgtcagggtttcatgctggagtagcgaggacatcttcgaacggacagagctgattcattgggtgcgccaggctcctggtcaaggcctcgaatggatagggtgggtaaaaactgtgacgggagcagtcaattttggctcccttgatttccgacaccgtatctctctgaccagagacagggatttgtttacagcccatatggacattcggggtttaactcagggggataccgcgacatacttctgtgctcgccagaagtttgagtcgagatataccggaggccagggctggtacttcgacctgtgggggaggggaactcacatcgtggtttcaagc

SEQ ID NO: 26479 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagcgccttgagtggataggctgggtaaagactgtgacgggggccgtcaactttggaagcccaaatttccgacaccgtgtgtccctgaccagagatagggacttgtctacagcgtacatggatatccggggcttaactcaggacgataccgctacatatttttgtgcccgccaaaaattcgcatcgagatactcaggtgaccaggggagctattttgatctgtggggaaggggcaccctaattgttgtgagttcc

SEQ ID NO: 26480 - RNA, 384 nt, synthetic construct
  misc_feature 1..384: note = derived and/or modified sequence opt3 from anti-HIV-1_HeavyChain
  source 1..384: mol_type = other RNA
agccacgacctggagcagtccggctctgccatgaagaaacccggggcttcagtgagagtcagttgctggaccagcgaagatatcttcgacacaactgagctcatttactgggttaggcaagcacctggacagggtcttgaatggataggctgggtgaagatcgtatccgggacggtgaactttgcctctctggatttccggaatcgcatttcgttgtcacgagaccgtgatttaagcaccgcgcatatggacatcagaggactgaggcaggatgacacagctacttatttttgtgcccggcagaaattcgagagtcgctactccggcgatcaaggttcttattttgacctatgggggagaggaaccctcattatcgtcagctcc

SEQ ID NO: 26481 - RNA, 384 nt, synthetic construct
  misc_feature 1..384: note = derived and/or modified sequence opt3 from anti-HIV-1_HeavyChain
  source 1..384: mol_type = other RNA
agacacacctggaacgagagcggctccggggtgaagaaacccggagcctctgtcagggtttcatgctggagtagcgaagacatcttcgagcggacagaactgattcattgggtgcgccaggctcctggtcaaggcctcgagtggatagggtgggtaaagactgtgacgggagcagtcaattttggctcccttgatttccgacaccgtatctctctgaccagagacagggatttgtttacagcccatatggacattcggggtttaactcagggggataccacaacctacttctgtgcgcgccagaaatttgaatcgagatatactggaggccagggctggtacttcgacctgtgggggaggggaacacacatcgtggtttcaagc

SEQ ID NO: 26482 - RNA, 384 nt, synthetic construct
  misc_feature 1..384: note = derived and/or modified sequence opt3 from anti-HIV-1_HeavyChain
  source 1..384: mol_type = other RNA
agacacacctgggaacaggtgtggagcggcgtcaagaaacccggggcctccgttagggtgtcttgctggtcaagtgaggacatcttcgagcggacagaactgattcattgggtacgccaagctcctggacagggtctcgagtggataggctgggtgaagactgtcacgggggcagtgaactttggaagccttgatttccgacaccgtatctccctgaccagagacagggatttgtttacagcccatatggacattcggggcttaactcagggtgataccgcgacatacttctgtgctcgccagaaatttgaatctagatataccgggggacaaggctggtacttcgacctgtggggcagggggactcacatcgttgtgtcgtca

SEQ ID NO: 26483 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgaccgtcagttgctggacaagcgaagacatcttcgatactacggagctcatttactgggttagacaggcacctggacagggtcttgaatggataggctgggtgaagatcgtatccgggaccgtgaactttgcctctctggacttcaggaatcggatttcgttgtcacgcgatcgagacttaagcacagcgtatatggatatccgtggactgactcaggacgataccgctacatacttttgtgccagacaaaaattcgcaagtaggtattccggcgaccagggttcttactttgatctatgggggcggggaaccctcattgtcgtgagctcc

SEQ ID NO: 26484 - RNA, 384 nt, synthetic construct
  misc_feature 1..384: note = derived and/or modified sequence opt3 from anti-HIV-1_HeavyChain
  source 1..384: mol_type = other RNA
agacacgacctggagcagagcggctccggggtgaagaaacccggagcctctgtcagggtttcatgctggagtagcgaagatatcttcgagcggaccgaactcattcattgggtgcgccaagctcctggtcagggccttgagtggatagggtgggtaaagacagtgactggagcagtcaactttggctccctggacttccgacaccgtatctctttgacgagagatagggacttatttaccgcccatatggatattcggggtctgacacagggggacactgcgacctacttctgtgctcgccagaaatttgaatcgagatatacaggaggccaaggctggtacttcgatctatgggggaggggaacccacatcgtggtttcaagc

SEQ ID NO: 26485 - RNA, 384 nt, synthetic construct
  misc_feature 1..384: note = derived and/or modified sequence opt3 from anti-HIV-1_HeavyChain
  source 1..384: mol_type = other RNA
gtgaccacatggaacaagagcggctccgccatgaaaaagcccggggcttctgtcagagtttcatgctggactagcgaggacatcttcgatacgaccgaactgatttactgggtgaggcaggcacctggacggggtctcgagtggataggctgggtaaaaacagtgagcgggactgtcaattttggatcctctgacttccgcaaccgaatctcgcttacccgtgatagagacctgtcaacagcccacatggatattaggggcttgacccaagacgatactgcgacatatttttgtgctcggcagaagttcgaaagtttatacagtgacgatcagggttcctattttgacctgtgggggcgcggaaccctaatcattgtgtctagc

SEQ ID NO: 26486 - RNA, 384 nt, synthetic construct
  misc_feature 1..384: note = derived and/or modified sequence opt3 from anti-HIV-1_HeavyChain
  source 1..384: mol_type = other RNA
agacacacctggaacaatacaggcagcggggtgaagaaacccggagcctccgtcagggtttcttgcctggcttcagaggacatcttcgaacggactgagctcattcattgggtgcgccaggcacctggtcaaggccttgaatggatagggtgggtaaagacggtgaccggagccgtcaactttggcagtctggatttccgacaccgtatcagcttgacaagagacagggatttatttactgcgcatatggacattcggggtctgacccagggggatacagctacctacttctgtgcccgccagaaatttgagtccagatatactggaggccagggctggtacttcgacctatgggggaggggaacacacatcgtggtttcttcg

SEQ ID NO: 26487 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgcctcgcaagcgaagacatcttcgagaggaccgaacttatttactgggttcggcaggcccctggacgcggtccagagtggataggctgggtgaagacagtatccgggactgtgaactttggatcttcggatttccgaaatcgtatctcactgacgagagacagggatttgagcaccgcgcatatggacattcggggcttaacacaggatgacactgctacctatttttgtgcccgccagaaattcgaaagtctgtactccgatgaccaaggttcttattttgatctatgggggagaggaacactcatcattgtcagctcc

SEQ ID NO: 26488 - RNA, 384 nt, synthetic construct
  misc_feature 1..384: note = derived and/or modified sequence opt3 from anti-HIV-1_HeavyChain
  source 1..384: mol_type = other RNA
agacacacctggaacaatacaggcagcggggtgaagaaacccggagcctccgtcagggtttcttgctggacttcagacgatatcttcgagcggacggaactgattcattgggtgcgccaggctcctggtcaaggcctcgagtggatagggtgggtaaagaccgtgagtggaacagtcaactttgcaagccttgacttccgaaatcgtatctccctgtctagagatagggacttgtcgactgcctacatggatattcggggcttaacccaggacgatacagcgacctatttttgtgctcgccagaaattcgcctcaagatacagcggtgaccaggggagttattttgatctgtggggaaggggcactctaatcgtggtttcctct

SEQ ID NO: 26489 - RNA, 384 nt, synthetic construct
  misc_feature 1..384: note = derived and/or modified sequence opt3 from anti-HIV-1_HeavyChain
  source 1..384: mol_type = other RNA
ggcacccccgggaacaagagcggatccggtgtgaaaaagcctggcgcctctgtcagagtttcatgctggagtagcgaggacatcttcgaaaggacagagctgattcactgggtgcggcaggctccagggcaaggactcgaatggataggctgggtaaaaactgtgacgggtgcagtcaattttgggtcccttgatttccgccatcgaatctctctgacccgtgacagagatttgtttacagcccacatggacattaggggattaactcagggcgataccgcgacatacttctgtgctcggcagaagtttgagtcgcgctataccggcgggcagggatggtacttcgacctgtggggtagaggcactcatatcgtggtttcaagc

SEQ ID NO: 26490 - RNA, 384 nt, synthetic construct
  misc_feature 1..384: note = derived and/or modified sequence opt3 from anti-HIV-1_HeavyChain
  source 1..384: mol_type = other RNA
ggcacccccgggagcgagtccggatctggtgtgaagagacctggcgcctcagtcagggttagttgctggacaagcgaagacatcttcgagactacggaactgattcactgggtgcggcaggctccagggcaaggactcgagtggataggctgggtaaaaaccgtgtccggtgcagtcaactttgggtctcttaatttccgccatcgagtgtcgctgacacgtgatagagacttgtttactgcccacatggatatcaggggattaacccagggcgacacagcgacctacttctgtgctcggcagaagtttgaatcacgctatactggcgggcagggatggtacttcgatctgtggggtagaggcacacatattgttgtgagcagt

SEQ ID NO: 26491 - RNA, 384 nt, synthetic construct
  misc_feature 1..384: note = derived and/or modified sequence opt3 from anti-HIV-1_HeavyChain
  source 1..384: mol_type = other RNA
gtgacccccggcacaaacctggggctcagaatgaagaaacctggagccagcgtcagggtttcctgctggacttctgaggacatcttcgatacgaccgaacttatttactgggtgcggcaggctccaggtcaaggcctggagtggatagggtgggtaaagatcgtgtcaggaacagtcaattttgcaagtttggacttccgcaaccgaattagcttatcccgtgatagagacctgtctactgcctatatggatatcaggggcctaacccaggacgatacagcgacctacttttgtgctcggcagaaattcgcctcgcgctattcaggtgaccaggggagctactttgatctctggggaagaggcactctgattgtggttagttcc

SEQ ID NO: 26492 - RNA, 384 nt, synthetic construct
  misc_feature 1..384: note = derived and/or modified sequence opt3 from anti-HIV-1_HeavyChain
  source 1..384: mol_type = other RNA
agacacgacctggagcagagcggcgccggggtgaagaaacccggagcttccgtcagggtttcttgctggtcaagtgaagatatcttcgagcggaccgaactcattcattgggtgcgccaagcacctggtcagggccttgagtggatagggtgggtaaagacagtgactggagccgtcaactttggcagcctggacttccgacaccgtatctccttgacgagagatagggacttatttaccgcgcatatggatattcggggtctgacacagggggacactgctacctacttctgtgcccgccagaaatttgaatctagatatacaggaggccaaggctggtacttcgatctatgggggaggggaacccacatcgtggtttcgtca

SEQ ID NO: 26493 - RNA, 384 nt, synthetic construct
  misc_feature 1..384: note = derived and/or modified sequence opt3 from anti-HIV-1_HeavyChain
  source 1..384: mol_type = other RNA
caggtgcacctggagcaaagcggctccggggtcaagaaacccggagcctctgttagagtgtcatgctggaccagtgaagacatcttcgaaaagagcgagctcattcattgggtaaggcaggctcctggtcagggccttgagtggatagggtgggtgaaaacagtcactggagcagtgaactttggctcctctgatttccggcagcgcgtttcgctgacgccagaccgagatttgtttaccgcccacatggacatccgtggtttaacacaaggggatactgcgacctacttctgtgctagacagaagtttgaatcaaggtatacaggaggccagggctggtacttcgacctgtgggggcggggaacccatattgtggtcagcagt

SEQ ID NO: 26494 - RNA, 384 nt, synthetic construct
  misc_feature 1..384: note = derived and/or modified sequence opt3 from anti-HIV-1_HeavyChain
  source 1..384: mol_type = other RNA
ggcaccacatgggagcagagcgggtccggagtgaagaaacccggtgcctctgtcagagtttcatgctggactagcgaagacatcttcgagaagagtgaactgattcactgggtgaggcaagctcctggccaggggctcgagtggataggatgggtaaaaacggtgaccggcgcagtcaactttggttcccttgatttccggcatcgcatctctctgacacgagaccgtgatttgtttactgcccacatggacattagagggttaacccagggagatacagcgacctacttctgtgctaggcagaagtttgaatcgcggtatactggcggccaagggtggtacttcgacctgtggggacgcggtacacatatcgtggtttcaagc

SEQ ID NO: 26495 - RNA, 384 nt, synthetic construct
  misc_feature 1..384: note = derived and/or modified sequence opt3 from anti-HIV-1_HeavyChain
  source 1..384: mol_type = other RNA
agccacgacctggagcagtccggctctgaatggaagaaacccggggcctcagtgagagtcagttgctggaccagcgaggatatcttcgacacaactgaactcattcattgggttaggcaagctcctggacagggtcttgagtggataggctgggtgaagacggtaaccggggcagtgaactttggatccctggatttccggcaccgcatctctttgacacgagaccgtgatttatttactgcccatatggacattagaggcctgacccagggtgatacagcgacctacttctgtgctaggcagaaatttgaatcgcggtatactgggggacaaggctggtacttcgacctatggggccgcgggacacacatcgtcgtgtcaagc

SEQ ID NO: 26496 - RNA, 384 nt, synthetic construct
  misc_feature 1..384: note = derived and/or modified sequence opt3 from anti-HIV-1_HeavyChain
  source 1..384: mol_type = other RNA
cagagcagacccggcaacaagtccgggtctgccatgaaaaagcctggagcttcagtgagggtcagttgctggaccagcgaggacatcttcgaacggacagagctgctctgggttcgccaagcaccaggtcgaggccttgaatggattgggtgggtgaaaactgtatccggaacggtgaattttggttcttcggatttccgtaacagaatatcactgaccagggaccgggatttgagcacagcccacatggacatccgcggcttaactcaggatgacaccgcgacatacttttgtgctagacagaagttcgagagtctgtattccgatgaccaggggtcttactttgatctatggggaaggggcaccctcattatcgtcagctcc

SEQ ID NO: 26497 - RNA, 384 nt, synthetic construct
  misc_feature 1..384: note = derived and/or modified sequence opt3 from anti-HIV-1_HeavyChain
  source 1..384: mol_type = other RNA
ggcaccacatggagcaagtccgggtctggagtgaaaaagcccggtgcctcagtcagagttagttgctggactagcgaggacatcttcgaaaggacggagctgatttactgggtgcggcaggctcctggccaagggctcgaatggataggatgggtaaaaatcgtgtccggcaccgtcaactttgcatctcttgatttccgcaatcgaatttcgctgtcacgtgacagagatttgagcacagcccacatggacatcaggggtttaactcaggatgacaccgcgacatatttttgtgctcggcagaagttcgccagtcgctactccggggatcagggatcttattttgacctgtggggcagaggcaccctaattatcgtgagctcc

SEQ ID NO: 26498 - RNA, 387 nt, synthetic construct
  misc_feature 1..387: note = derived and/or modified sequence opt3 from anti-HIV-1_HeavyChain
  source 1..387: mol_type = other RNA
caggcccacctggagcaaagcggctccggggtgaagaaacccggagcttctgtcagagtttcatgctggaccagtgaagacatcctcaggaagaaacgggtggatagcgtaggttgtgacacagcacctggccaggggcttgagtggattggatgggtgaagactgtcacgggcgccgtgaacttcggttcctctgattttcgccagcgagtttcgctgacccgtgacagagatttgttcacagcgcatatggacataagggggttaactcaggatgacaccgctacatacttttgcgcccggcaaaaattcgcatcacgctatagcggagatcagggcagttactttgacctgtggggcagagggaccctaatcgtggtctcctct

SEQ ID NO: 26499 - RNA, 387 nt, synthetic construct
  misc_feature 1..387: note = derived and/or modified sequence opt3 from anti-HIV-1_HeavyChain
  source 1..387: mol_type = other RNA
aaggcccacctgggcaacaaaagcgggtccggagtgaagaaacccggtgcttctgtcagagtttcatgctggagtagcgaggacatcttcgaaaggaccgagctcattcattgggtgcggcaggcacctggccaagggcttgaatggataggatgggtaaagacagtgactggcgccgtcaattttggttccctggatttccgccaccgaatctctttgacgcgtgacagagatttatttaccgcgcatatggacattagggggctgacacagggagatactgctacctacttctgtgcccggcagaaatttgagtcgcgctatacaggcggccaggggtggtacttcgacctatggggaagaggtacccacatcgtggtttcaagc

SEQ ID NO: 26500 - RNA, 384 nt, synthetic construct
  misc_feature 1..384: note = derived and/or modified sequence opt3 from anti-HIV-1_HeavyChain
  source 1..384: mol_type = other RNA
accacagtgggcactatcctggggagagccatgaagaaacccggagctagcgtcagggtttcctgctggacgtctgaggacattttcgataccacagaactcatatactgggtgcggcaggcacctggtcaaggccttgagtggatcgggtgggtaaagattgtgtcaggaactgtcaactttgccagtctggacttccgcaatcgaatcagcttgtcccgtgatagagacttatctaccgcgtatatggatattaggggcctgacacaggacgataccgctacttacttttgtgcccggcagaaattcgcatcgcgctattcaggtgaccaggggagctactttgatctatggggaagaggcacactcatcgtggttagttcc

SEQ ID NO: 26501 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgaaggtcagttgctggaccagcgaagacatcttcgatacaactgagctcatttactgggttagacaggcacctggacagggtcttgaatggataggctgggtgaaaatcgtatccgggacggtgaactttgcctctctggacttcaggaatcggatttcgttgtcacgcgatcgagacttaagcaccgcgtatatggatatccgtggactgacacaggacgatactgctacctacttttgtgccagacaaaagttcgcaagtaggtattccggcgaccagggttcttactttgatctatgggggcggggaacactcattgtcgtgagctcc

SEQ ID NO: 26502 - RNA, 387 nt, synthetic construct
  misc_feature 1..387: note = derived and/or modified sequence opt3 from anti-HIV-1_HeavyChain
  source 1..387: mol_type = other RNA
cagagccacctggagcaagtgtgggtctgccagtccaagaaacccggcgcctctgttagagtgtcatgttggaccagtgaagacatcttcgatacaactgagctcatttactgggtaaggcaggctcctgggcagggacttgaatggataggttgggtgaagatcgtcagcggcacggtgaactttgcatccctggacttccggaatcgcatttctttgtcgcgagatcgtgacttatcaaccgcccatatggatatcagagggctgacacaagacgatactgcgacctatttttgcgctaggcagaaattcgccagccggtacagtggagaccagggctcctattttgatctatggggtcgcgggacactcattatcgtttctagc

SEQ ID NO: 26503 - RNA, 384 nt, synthetic construct
  misc_feature 1..384: note = derived and/or modified sequence opt3 from anti-HIV-1_HeavyChain
  source 1..384: mol_type = other RNA
agacacaccgtggagcagagcggctccggggtcaagaaacccggagcctctgttagggtgtcatgctggagtagcgaagacatcttcgagcggacagaactgattcattgggtacgccaagctcctggtcagggcctcgagtggatggggtgggtgaagactgtcacgggagcagtgaactttggctcccttgatttccgacaccgtatatctctgaccagagacagggatttgtttacagcccatatggacatccggggtttaactcagggggataccgcgacatacttctgtgctcgccagaaatttgaatcgagatataccggaggccaaggctggtacttcgacctgtgggggaggggaactcacattgttgtgtcaagc

SEQ ID NO: 26504 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgcagcgcaagggaagacatcttcgataccacagagctcatttactgggttcggcaggcccctggacagggtcttgaatggataggctgggtgaagatcgtatgtgggactgtgaactttgcgtccctggacttccgcaatcgaatttctttgtcgcgtgatagagacttatcaacggctcatatggatatcaggggactgacccaggacgatacagccacttatttttgcgcacggcaaaaattcgccagccgctacagtggcgaccagggttcctattttgatctatgggggagaggaaccctcattatcgtctctagc

SEQ ID NO: 26505 - RNA, 387 nt, synthetic construct
  misc_feature 1..387: note = derived and/or modified sequence opt3 from anti-HIV-1_HeavyChain
  source 1..387: mol_type = other RNA
gaggtgcagagaggcgggagggtcgttggacgggacgtgaagaaacccggtgccagcgtacgcgtgtcctgctggacctctgaagatatcttccacacagagctgatttactgggtccgacaagctcctggccaggggctcgaatggataggatgggtgaagatcgtttcaggcactgtgaactttgcaagtcttgacttccgtaatagaattagcctgtccagggatcgggacttgtctacggcctatatggatatccgcggtttaacccaggacgatacagcgacttacttttgtgctagacagaaattcgcctcgaggtattcaggggaccaaggaagctactttgatctgtggggccggggcaccctaattgtcgtgagttcc

SEQ ID NO: 26506 - RNA, 384 nt, synthetic construct
  misc_feature 1..384: note = derived and/or modified sequence opt3 from anti-HIV-1_HeavyChain
  source 1..384: mol_type = other RNA
ggcaccacatggaacgagagcgggtccggagtgaagaaacccggtgcctctgtcagagttccttgctggtcaagtgaagacatcttcgagaggactgaactgattcaccgggtgcgccaggctccaggccaagggctcgagtggataggatgggtaaagacggtgaccggcgcagtcaattttggtagcccgaacttccgacatcgtatctcccttacaagagatagggacctgtttactgcccacatggatattcgggggttgacccagggagacacagcgacctacttctgtgctcgccagaaatttgaatctagatatactggcggccaggggtggtacttcgatttatggggaaggggtacacatatcgtggtttcgtca

SEQ ID NO: 26507 - RNA, 384 nt, synthetic construct
  misc_feature 1..384: note = derived and/or modified sequence opt3 from anti-HIV-1_HeavyChain
  source 1..384: mol_type = other RNA
agaagcaactgggtgcagtccggcgccgacgtcaagaaacccggggcttctgttaagtcaagttgctggaccagcgaggatatcttcgacacaactgaactgatttactgggtgaggcaagcacctggacagggtctcgagtggataggctgggtaaaaatcgtgtccgggacggtcaattttgcctctcttgatttccggaaccgcatttcgctgtcacgagaccgtgatttgagcaccgcgtatatggacatcagaggattaacacaggatgacactgctacctacttttgtgccaggcagaagttcgcaagtcggtattccggcgatcaaggttcttactttgacctgtgggggcgcggaacactaattgtggttagctcc

SEQ ID NO: 26508 - RNA, 384 nt, synthetic construct
  misc_feature 1..384: note = derived and/or modified sequence opt3 from anti-HIV-1_HeavyChain
  source 1..384: mol_type = other RNA
cccgtgcagctggtccaaagcggcgccgaggttaagaaacctggggcttccgtgaaggtatcttgctggacctcagaagacatcttcgagagaacagaactcattcactgggtgaggcaggcaccaggacagggtcttgagtggataggctgggtcaaaactgtgacgggggccgttaactttggaagtctggatttccggcatcgcatcagcttgacccgagaccgtgatttatttacagcgcacatggacattagaggcctgactcagggtgataccgctacatacttctgtgccaggcaaaagtttgaatcccggtataccgggggacagggctggtacttcgacctatggggccgcgggactcatatcgtggtctcttcg

SEQ ID NO: 26509 - RNA, 399 nt, synthetic construct
  misc_feature 1..399: note = derived and/or modified sequence opt3 from anti-HIV-1_HeavyChain
  source 1..399: mol_type = other RNA
agagagtacctggaacagagcggcgggggagtgaagaaactcggtgcctccgtcagggtttcttgccgggcttcagaggaccttttcggcgatgaagcaatctatgacgatgagctgattcactggttgcgccaagtgcccgggcagcgacctgaatggatgggatggatacgtccaaagaccggcgccagaaaccaggcgaggcagtttcaaccgcggatcaatttaagtcgcgacagagctctgaacacagcctacctagatctcagctccctgacttctgcagactcggccacgtatttctgtgctaggcagacctttaaacccgatttctactttgcagaccagggttggtcattcaatctttgggggcggggagcccgcgtaattgtgagcagt

SEQ ID NO: 26510 - RNA, 399 nt, synthetic construct
  misc_feature 1..399: note = derived and/or modified sequence opt3 from anti-HIV-1_HeavyChain
  source 1..399: mol_type = other RNA
caggtgcaactggtccagagcggcaccgaggttaagaaacccggggcctccctcagggtgtcttgcagggcttcagaagaccttttcggagataagatcatttacgacgatgaggtaatacactggctgcggcagttgcctggtcagcgcccagaatggatgggctggatccgaccgaaaagtggggcacgtaaccaagccagacagtttcagcccaggattagcttaacacgggaccgcgcgctgtccactgcttatctagatctcaattctctgacgtcggccgactcaggaacctacttctgtgcaagacagacatttaagcctgatttctattttgccgaccaaggctggagcttcaacctttggggtagaggggctcattttatcgtgagttcc

SEQ ID NO: 26511 - RNA, 399 nt, synthetic construct
  misc_feature 1..399: note = derived and/or modified sequence opt3 from anti-HIV-1_HeavyChain
  source 1..399: mol_type = other RNA
caggcccacctggagcaaagcggctccggggtgaagaaacccggagcttctgtcagagtttcatgcagggcaagtgaagacctcttcggtgatgagatcatttacgacgatgaagtgatacattggcttcggcaggtacctggccagcgcccagagtggatggggtggatccgaccgaagaccggagcccgtaaccaggcgagacaatttcagcccaggattagcctgacacgggaccgcgctttgtccactgcctatttagatctaaattctctgacgtcggcagactcaggcacctacttctgtgccagacagacatttaaacctgatttctattttgctgaccagggttggagcttcaacctctgggggaggggagcacactttatcgtgagttcc

SEQ ID NO: 26512 - RNA, 399 nt, synthetic construct
  misc_feature 1..399: note = derived and/or modified sequence opt3 from anti-HIV-1_HeavyChain
  source 1..399: mol_type = other RNA
gggaacatctggagcgagtccgggggaggtgtgaagaaacccggcgcctctgtcagagtttcatgcagggctagtgaagacctgttcggggatgagattatatacgacgatgaagtgatccactggctccggcaggtacctggacaacgcccagagtggatgggctggattcgaccgaagaatggtgggcgtaaccaggcaagacagtttcagcccaggatcagccttacccgggaccgcgccctgaatacagcgtatttggatttaaactccctgacttctgctgactcgggaacgtacttctgtgccagacaaacctttaaacctgatttctattttgcagaccagggctggtcattcaatctatggggcaggggcgcccgggtgattgtcagcagt

SEQ ID NO: 26513 - RNA, 399 nt, synthetic construct
  misc_feature 1..399: note = derived and/or modified sequence opt3 from anti-HIV-1_HeavyChain
  source 1..399: mol_type = other RNA
caggtgcaactggtccagagcggggccgaggttaagaaacccggggcttccctcagagtgccttgcagggcatctgaagaccttttcggagatgagatcatttacgacgatgaagtaatacactggctgcgccaggtgccaggtcagcggccggagtggatgggctggatccgacccaagaccggggcccgtaaccaagcgagacagtttcagcctaggatttcattgacacgggaccgcgctttaagtactgcctatctggatctaaatagcctcacgtccgcagactctggaacctacttctgtgccagacagacatttaaaccagatttctattttgctgaccaaggctggtcgttcaacctgtggggtaggggcgcacattttatcgtctcaagc

SEQ ID NO: 26514 - RNA, 390 nt, synthetic construct
  misc_feature 1..390: note = derived and/or modified sequence opt3 from anti-HIV-1_HeavyChain
  source 1..390: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagatcgtgagcggagccgtcaactttggctccccaaatttccgccagcgagtgtctctgactcgtgatagagacttgtttacggcgcacatggatattaggggtttaacccaaggggacacagctacttacttctgtgcccggcagaaatttgaacgcggaggccagggctggatcttcgatctgtgggggagaggaaccctaattgcagtttcgtcagccagcaggagtgct

SEQ ID NO: 26515 - RNA, 393 nt, synthetic construct
  misc_feature 1..393: note = derived and/or modified sequence opt3 from anti-HIV-1_HeavyChain
  source 1..393: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgtcgacggctcatatggacatcaggggtctaacccaggatgacacagccacttatttctgtgcacggcaaaaatttgcccgcggggatcagggatggttctttgacctctggggcagaggcaccctgattgttgtgtcaagcgctagtacaaggtccacc

SEQ ID NO: 26516 - RNA, 414 nt, synthetic construct
  misc_feature 1..414: note = derived and/or modified sequence opt3 from anti-HIV-1_HeavyChain
  source 1..414: mol_type = other RNA
caggtgcaactggtccagagcggcgccgaggttaagaaacccggggcttccgtgaccgtatcttgcaaggcatcaagatacacattcatcaactattacattcactgggtgaggcaggcccctggacagggtctcgaatggataggctgggtcaaaccagtgagtggggcggttaattttggaagcccgaacttccggcatcgcgtgtcccttactcgagaccgtgatctgtttacggctcacatggacatcagaggcttgacccaaggtgatacagccacttatttctgtgcaaggcagaagtttgcccgcggggaccagggatggttctttgatttatggggccggggcaccctgattgtcgtgtcttcggcttcaacaaaagggcccagcgtattccctcatgacctaaga

SEQ ID NO: 26517 - RNA, 414 nt, synthetic construct
  misc_feature 1..414: note = derived and/or modified sequence opt3 from anti-HIV-1_HeavyChain
  source 1..414: mol_type = other RNA
caggtgcaactggtccagagcggcgccgaggttaagaaacccggggcttccgtgaaggtatcttgcaaagcatcaggatacaccatcacaagacactatatgcattgggtgaggcaggcccctggtcagggcctcgaatggattgggtgggtcaagactgtgacgggagcggttaacttcggcagtccaaattttcggcaccgcgtgagccttacccgagaccgtgatctgttcacagctcatatggacataagaggtttgactcaaggggataccgccacatacttttgtgcaaggcagaaattcgagcggggaggccagggctggtattttgacttatgggggcgcggaaccctgatcgtcgtgtcctctgcctcgactaagggtccgtcagtattcccccacgatctaaga

SEQ ID NO: 26518 - RNA, 408 nt, synthetic construct
  misc_feature 1..408: note = derived and/or modified sequence opt3 from anti-HIV-1_HeavyChain
  source 1..408: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctccccaaatttccggcaccgcgtgtctctgacgcgagatcgtgacttgtttaccgcgcatatggatatcagaggtttaacacagggggacactgctacctacttctgtgccaggcaaaagtattacgcaggaggccagggctggtattttgatctgtgggggcggggaacactaattgttgtgtcgtcagccagcaccaaaggtccgagtgacgatctccgc

SEQ ID NO: 26519 - RNA, 411 nt, synthetic construct
  misc_feature 1..411: note = derived and/or modified sequence opt3 from anti-HIV-1_HeavyChain
  source 1..411: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagatcgtgagcggagccgtcaactttggctccccaaatttccgccagcgagtgtctctgactcgtgatagagacttgtttacggcgcacatggatattaggggtttaacccaaggggacacagctacttacttctgtgcccggcagaaatttgaacgcggaggccagggctggatcttcgatctgtgggggagaggaaccctaattgcagtttcgtcagccagcacaaagggtccgagtgtgtatgacctcagg

SEQ ID NO: 26520 - RNA, 417 nt, synthetic construct
  misc_feature 1..417: note = derived and/or modified sequence opt3 from anti-HIV-1_HeavyChain
  source 1..417: mol_type = other RNA
caggtgcaactggtccagagcggctccggggttaagaaacccggagcctctgtgagagtatcatgctggaccagtgaggacatcttcgaaaggacagagctcattcactgggtgcggcaggctcctggtcagggccttgaatggatagggtgggtcaagactgtgagcggagcagttaactttggctccccaaatttccgccatcgagtgtctctgacgcgtgatagagacttgtttaccgcccacatggatatcaggggtttaacacaaggggacactgcgacctacttctgtgctcggcagaaatttgagcgcggaggccagggctggtatttcgatctgtgggggagaggaacactaattgtcgtgtcgtcagccagcaccaagggtccgagtgtatttccccatgacctcagg

SEQ ID NO: 26521 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctccccaaatttccggcaccgcgtgtctctgacgcgagatcgtgacttgtttaccgcgcatatggatatcagaggtttaacacagggggacactgctacctacttctgtgccaggcaaaagtttgaacggggaggccagggctggtatttcgatctgtgggggcgcggaacactaattgttgtgtcgtcagcaagcaccaaaggtccgagtgtctttcccactatctacgtg

SEQ ID NO: 26522 - RNA, 417 nt, synthetic construct
  misc_feature 1..417: note = derived and/or modified sequence opt3 from anti-HIV-1_HeavyChain
  source 1..417: mol_type = other RNA
caggtgcaactggagcagagcggctccggggtcaagaaactcggagcctctgttagagtgtcatgctggaccagtgaagacatcttcgaggatgaacttattcactgggtaaggcaggctcccggtcagggcctggagtggatagggtgggtgaaggcagtcagcggagccgtgaactacggctccttggactttcggcatcgcgtttctttaacacgagatcgtgacctgttcactgcgcacatggatatcagaggtctaacgcaagacgataccgctacatatttttgtgccaggcagaaattcgcacgcggggaccagggatggtttttcgatctctggggccggggcactctgattgtggtctcgtcagggcttcatcagggacctatcggtctgccaccgagattgagcagg

SEQ ID NO: 26523 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagatcgtgagcggagccgtcaactttggctccccaaatttccgccagcgagtgtctctgactcgtgatagagacttgtttacggcgcacatggatattaggggtttaacccaaggggacacagctacttacttctgtgcccggcagaaatttgaacgcggaggccagggctggatcttcgatctgtgggggagaggaaccctaattgcagtttcgtcagccagcccgagggctcatcggagttcccccacaatctgcgtg

SEQ ID NO: 26524 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagctccgatttccgccagcgagtgtctctgacccgtgacagagatttgtttacagcgcacatggacatcaggggtttaactcaaggggataccgctacatacttctgtgcccggcagaaattttatgcaggaggccagggctggtacttcgacctgtgggggcgcggaaccctaattgttgtgtcgtcagccagcactaagggtccaagtgtctttccgcatgatctcaga

SEQ ID NO: 26525 - RNA, 414 nt, synthetic construct
  misc_feature 1..414: note = derived and/or modified sequence opt3 from anti-HIV-1_HeavyChain
  source 1..414: mol_type = other RNA
caggtgcacctggtccaaagcggcgccgaggttaagagacccggggcttccgtgaaagtatcttgcaaggcatcaggatacaccttcacagactattttatccattgggtgaggcaggcccctggtcagggcctcgaatggattgggtgggtcaaaactgtgagtggagcggttaacttcggcagccttaattttcggcaccgcgtgtccctgacgcgagatcgtgacttgttcaccgctcatatggatataagaggtttaacacagggggacactgccacctacttttgtgcaaggcaaaagttcgcccggggagatcagggctggtttttcgacctgtggggccgcgggacactaatcgtcgtgtcttcggcttcaaccaaaggaccaagcgtatttccgcacgatctcaga

SEQ ID NO: 26526 - RNA, 420 nt, synthetic construct
  misc_feature 1..420: note = derived and/or modified sequence opt3 from anti-HIV-1_HeavyChain
  source 1..420: mol_type = other RNA
caggtgcaactggtccagagcggcgccgaggttaagaaacccggggcttccgtgaaggtatcttgcaaagcatcaggatacatcttcaccggtagttatatgcactgggtgagacaggcccctggccagacatttgaatggctcgggtggatgaagccagtcactggagcggtgaactacgctaggcaattccagggccgggttagcttttatcgcacgcgagagcttggtattgcctacatggacctgcgtgatttgaaattcgacgataccgcagtgtatttttgtgccagaaagacaaagggggacgtctccggagatgacaggggcttctttttcgatttatggggccgggggactcgcgtgatagtatcttcggcttcaaccaaaggaccgagcgtttttccccatgacctgaga

SEQ ID NO: 26527 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctccccaaatttccggcaccgcgtgtctctgacgcgagatcgtgacttgtttaccgcgcatatggatatcagaggtttaacacagggggacactgctacctacttctgtgccaggcaaaagtttgaacggggaggccagggctggtatttcgatctgtgggggcgcggaacactaattgttgtgtcgtcagcaagcaccaaaggtccgagtgtctttccccacgacctcaga

SEQ ID NO: 26528 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagggtagcgaactcattcattgggtgaggcaggcacctggccaggggcttgagtggataggatgggtaaagacagtgactggcgccgtcaactttggttccccaaatttccggcaccgcgtgtctctgacgcgagatcgtgacttgtttaccgcgcatatggatatcagagggttaacacagggagacactgctacctacttctgtgccaggcaaaaatttgaacggggcggccaggggtggtatttcgatctgtggggacgcggtacactaattgttgtgtcgtcagcaagcaccaagggcccgagtgtctttccccacgacctcaga

SEQ ID NO: 26529 - RNA, 420 nt, synthetic construct
  misc_feature 1..420: note = derived and/or modified sequence opt3 from anti-HIV-1_HeavyChain
  source 1..420: mol_type = other RNA
caggtgcaactggtccagagcggcgccgaggttaagaaacccggggcttccgtgaaggtatcttgcaaagcatcaggatacaccttcacaggttattacatccactgggtgagacaggcccctggccaggggctcgaatggatgggatggattaacccaaatagtggcgcgactaactatgctcaaaagtttcagggtaggcttacgatagcccgggacaccagcatctccacagcatacatggatctgcgcaatttgcgattcgacgatactgccgtctatttttgtgctcgtaaaaccgcaggggacgtgtctggagataacagaggctacttctttgacttatggggcagggggtcgcgggttattgtgtcaagcgccagtacaaagggaccgtccgtcttcccccatgatctgcgc

SEQ ID NO: 26530 - RNA, 414 nt, synthetic construct
  misc_feature 1..414: note = derived and/or modified sequence opt3 from anti-HIV-1_HeavyChain
  source 1..414: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagttttatgcaggaggccagggctggtacttcgacctgtgggggcggggaacactaattgttgtgtcaagcgccagtaccaaaggtccatccgtctttcatgatctccgc

SEQ ID NO: 26531 - RNA, 414 nt, synthetic construct
  misc_feature 1..414: note = derived and/or modified sequence opt3 from anti-HIV-1_HeavyChain
  source 1..414: mol_type = other RNA
caggccaccctggagcaaagcggctccggggtgaagaaacccggagcttctgtcagagtttcatgctggagtagcgaagacatcttcaagacagagctcattcactgggtgaggcaggcacctggtcagggccttgaatggatagggtgggtaaaagccgtgtccggagcggtcaactacggctctctggattttcggcatcgcgtgtcgttgactcgagaccgtgatttatcaacggctcacatggacatcagaggtctgacccaggatgacacagccactcatttctgtgcaaggcaaaagtttgcccgcggggatcagggatggttctttgacctatggggccggggcaccctcattgttgtgagcagtgcttccacaaaagggccatctgtcttcccgaccatctatgtg

SEQ ID NO: 26532 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtttacagcgcatatggatatcaggggtttaactcagggggacaccgctacatacttctgtgcccggcaaaaatttgaacgcggaggccagggctggtatttcgatctgtgggggagaggaaccctaattgttgtgtcttcggcatcaactaagggtccgagcgtctttcccacaatctgcgtg

SEQ ID NO: 26533 - RNA, 414 nt, synthetic construct
  misc_feature 1..414: note = derived and/or modified sequence opt3 from anti-HIV-1_HeavyChain
  source 1..414: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgagcggagccgtcaactttggctccccaaatttccgccaccgagtgtctctgacgcgtgatagagacttgtttaccgcgcatatggatatcaggggtttaacacagggggacactgctacctacttctgtgcccggcaaaaatttgaacgcggaggccagggctggattttcgatctgtgggggagaggaacactaatcgcagtttcgtcagccagcccgagggctcaccggagttctccccgctccgca

SEQ ID NO: 26534 - RNA, 414 nt, synthetic construct
  misc_feature 1..414: note = derived and/or modified sequence opt3 from anti-HIV-1_HeavyChain
  source 1..414: mol_type = other RNA
caggcccacctggagcaaagcggctccggggtgaagaaacccggagcttctgtcagagtttcatgctggaccagtgaagacatcttcaagagcgagctcattcattgggtgaggcaggcacctggtcagggccttgaatggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagtttgagcggggaggccagggctggattttcgacctgtgggggcgcggaacactaatcgcagtttcaagcgccagtaccaaaggtccatccgtgtttccgactatttgcgtc

SEQ ID NO: 26535 - RNA, 414 nt, synthetic construct
  misc_feature 1..414: note = derived and/or modified sequence opt3 from anti-HIV-1_HeavyChain
  source 1..414: mol_type = other RNA
caggcccacctggagcaaagcggccccggggtgaagaaactcggagcttccgtcagagtttcttgctggacctcagaagacatcttcgagaggacagaacttattcattgggtgcggcaggcacctggtcagggcctggagtggatagggtgggtaaaggccgtgagtggagcggtcaactacggcagcttggattttcgccaccgagtgtccttaactcgtgacagagatctgttcacggctcatatggacatcaggggtctaacccaggatgacacagccatttatttttgtgcacggcaaaaattcgcccgcggggatcagggatggtttttcgacctctggggcagaggcactctgatcgttgtgtcttcggcttcaaccaaggcacacaggagcagtccacggtccaca

SEQ ID NO: 26536 - RNA, 420 nt, synthetic construct
  misc_feature 1..420: note = derived and/or modified sequence opt3 from anti-HIV-1_HeavyChain
  source 1..420: mol_type = other RNA
caggtgcaactggtccagagcggcgccgagatgaagaaacccggggcttccgttaagctctcttgcatgacctcaggatacgtgttcacagacttttatatccactgggtaagacaggcacctggtcagggccttgaatggatggggtggattaacccaggaactggcggtacgataagtgccccgaggttcctggggcgggtgaccttgacacgcgatactagcatctccgcggcttacattgagatcaatcgagtcaccattgacgatacagccacctatttttgtgcacgtcaaaaattcgcctctagatactcgggagaccagggctcatattttgatttatggggcagggggactctgatcgtggttagcagtgcttccacaaagggacccctaggtctccctccacggtctgca

SEQ ID NO: 26537 - RNA, 414 nt, synthetic construct
  misc_feature 1..414: note = derived and/or modified sequence opt3 from anti-HIV-1_HeavyChain
  source 1..414: mol_type = other RNA
caggcccacctggagcaaagcggctccggggtgaagaaacccggagcttctgtcagagtttcatgctggacccctgaagacatcttcgagaggacagaactcattcattgggtgcggcaggcaccaggtcagggccttgagtggatagggtgggtaaagatcgtgagtggagccgtcaactttggcagcccgaatttccgccagcgagtgtccctgactcgtgatagagacttgtttacggcgcacatggatattaggggtttaacccaaggggacacagctacttacttctgtgcccggcagaaatttgaacgcggaggccagggctggatcttcgatctgtgggggagaggaaccctaattgcagtttcttcggcctcacccagggctcatcggagcagtcctcgctccgca

SEQ ID NO: 26538 - RNA, 414 nt, synthetic construct
  misc_feature 1..414: note = derived and/or modified sequence opt3 from anti-HIV-1_HeavyChain
  source 1..414: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagccagtgactggagccgtcaacctggcgccgaattttcgccaccgagtgagcttgacgcgtgatagagacttattcaccgctcatatggatatcaggggcctgacacagggtgacactgccacctacttttgtgcacggcaaaaattcgaacgcgggggacagggctggtattttgatctatggggcagagggacactcattgttgtgtcctctgcctcgaccaagggaccctcagtcttccctcacgacctgagg

SEQ ID NO: 26539 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaaggccgtgtccggagcggtcaactacggctctctggattttcgccaccgagtgtcgttgacacgtgacagagatttatcaactgctcatatggacatcaggggtctgacgcaggatgacaccgccacatatttctgtgcacggcaaaaatttgcccgcggggatcagggatggttctttgacctatggggcagaggcactctcattgttgtgagcagtgcttccaccaaggggccatctgtcttcccgcacgatctgagg

SEQ ID NO: 26540 - RNA, 414 nt, synthetic construct
  misc_feature 1..414: note = derived and/or modified sequence opt3 from anti-HIV-1_HeavyChain
  source 1..414: mol_type = other RNA
caggcccacctggagcaaagcggctccggggtgaagaaacccggagcttctgtcagagtttcatgctggaccagtgaagacatcttcgagaggagcgaactcattcattgggtgcggcaggcacctggtcagggccttgagtggatagggtgggtaaagacagtgactggagccgtcaactttggctccccaaatttccgccagcgagtgtctctgacgcgtgatagagacttgtttaccgcgcacatggatatcaggggtttaacacaaggggacactgctacctacttctgtgcccggcagaaattttatgcaggaggccagggctggtacttcgatctgtgggggcgcggaacactaattgttgtgtcgtcagccagcaccaaggctcatagaagttccccgaggtctact

SEQ ID NO: 26541 - RNA, 414 nt, synthetic construct
  misc_feature 1..414: note = derived and/or modified sequence opt3 from anti-HIV-1_HeavyChain
  source 1..414: mol_type = other RNA
caggcccacctggagcaaagcggctccggggtgaagaaacccggagcttctgtcagagtttcatgctggaccagtgaagacatcttcaagagcgagctcattcattgggtgaggcaggcacctggtcagggccttgaatggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagttttatgcaggaggccagggctggtacttcgacctgtgggggcggggaacactaattgttgtgtcaagcgccagtaccaaaggtccatccgtctttccgactatctgcgtg

SEQ ID NO: 26542 - RNA, 414 nt, synthetic construct
  misc_feature 1..414: note = derived and/or modified sequence opt3 from anti-HIV-1_HeavyChain
  source 1..414: mol_type = other RNA
caggcccacctggagcaaagcggctccggggtgaagaaactcggagcttctgtcagagtttcatgctggaccagtgaagacatcttcaagacagagcttattcattgggtgaggcaggcacccggtcagggcctggaatggatagggtgggtaaaagccgtgagcggagcggtcaactacggctccttggattttcggcaccgcgtgtctttaactcgagaccgtgatctgtcgacggctcatatggacatcagaggtctaacccaggatgacacagccacttatttctgtgcaaggcaaaagtttgcccgcggggatcagggatggttctttgacctctggggccggggcaccctgattgttgtgtcaagcgctagtacaaaagggccttccgtcttcccacacgatcttaga

SEQ ID NO: 26543 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagttttatgcaggaggccagggctggtacttcgacctgtgggggcggggaacactaattgttgtgtcaagcgccagtaccaaaggtccatccgtctttccgactatctatgtg

SEQ ID NO: 26544 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggaacctctgtcagagtttcatgctggacaagtgaagacatcttcgagaggactgaactcattcattgggtgcggcaggctcctggtcagggccttgagtggatagggtgggtaaagacggtgaccggagcagtcaactttggcagcccaaatttccgccaccgagtgtccctgacacgtgatagagacttgtttactgcccatatggatatcaggggtttaacccagggggacacagcgacctacttctgtgctcggcaaaaatttgcccgcggagatcagggctggttctttgacctgtggggcagagggactctaattgttgtgtcttcggcatcaacaaagggaccgagcgtcttccccaccatctgcgtg

SEQ ID NO: 26545 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagttttatgcaggaggccagggctggtacttcgacctgtgggggcggggaacactaattgttgtgtcaagcgccagtaccaaaggtccatccgtctttccgcagatctatgtg

SEQ ID NO: 26546 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgaaaagagcgagctcattcattgggtgaggcagacacctggtcagggccttgagtggatagggtgggtaaaaactgtgacgggagcagtcaactttggctcctctgatttccggcagcgcgtgtcgctgacccgagaccgtgatttgtttacagcccacatggacatcagaggtttaactcaaggggataccgcgacatacttctgtgctaggcagaagttttatgccggaggccagggctggtacttcgacctgtgggggcggggaaccctaattgttgtgtcaagcgcaagtactaaaggtccatccgtctttccgacaatctatgtg

SEQ ID NO: 26547 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagatcgtgagcggagccgtcaactttggctccccaaatttccgccagcgagtgtctctgactcgtgatagagacttgtttacggcgcacatgggtattagggggttaacccaaggagatacagctacttacttctgtgcccggcagaaatttgaacgcggcggccaggggtggatcttcgacctgtggggaagaggtaccctaattgcagtttcgtcagccagcacaaagggcccgagtgtgtttcccaccatctatgtc

SEQ ID NO: 26548 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgttcacggctcatatggacatcaggggtctaacccaggatgacacagccacttatttttgtgcacggcaaaaattcgcccgcggggatcagggatggtttttcgacctctggggcagaggcaccctgattgttgtgtcgtcagctagcacaaaggggcctagtgtctttccacacgatcttagg

SEQ ID NO: 26549 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtttacagcgcatatggatatcaggggtttaactcagggggacaccgctacatacttctgtgcccggcaaaaatttgaacgcggaggccagggctggattttcgatctgtgggggagaggaaccctaatcgcagtttcttcggcctcaactaagggtccgagcgtgtttcccaggagtgctgtc

SEQ ID NO: 26550 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtggatgaagatcgtaagcggagccgtgaactttggctccccaaatttccgccagcgagtctctctgactcgtgatagagacttgtttacggcgcacatggatattaggggtttaacccaaggggacacagctacttacttctgtgcccggcagaaatttgaacgcggaggccagggctggatcttcgatctgtgggggagaggaaccctaattgcagtgtcgtcagccagcacaaagggtccgagtgtttttccccatgacctcagg

SEQ ID NO: 26551 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcagcgagggttccgaactcattcattgggtgaggcaggcacctggccaggggcttgagtggataggatgggtaaagacagtgactggcgccgtcaacttcggttctgcgtactttcggcaccgcgtgtcgctgacgcgagatcgtgacttgttcaccgctcatatggatatcagagggttaacacagggagacactgccacctatttttgtgcaaggcaaaaattctacaagggcggccaggggtggtattttgatctgtggggacggggtacactaattgttgtgtcaagcgccagtaccaaaggcccatccgtcttcccgactatctgcgtg

SEQ ID NO: 26552 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactacggcagcctggattttcgccaccgagtgtccttgacccgtgacagagatttatctacagcgcatatggacatcaggggtctgactcaggatgacaccgctacatatttctgtgcccggcaaaaatttgcacgcggggatcagggatggttctttgacctatggggcagaggcaccctcattgttgtgtcgtcagccagcactaaggggccaagtgtcttcccgcacgatctgagg

SEQ ID NO: 26553 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagatcgtgtccggagccgtcaactttggctctccaaatttccgccagcgagtgtcgctgacacgtgatagagacttgtttactgcgcacatggatattaggggtttaacgcaaggggacaccgctacatacttctgtgcccggcagaaatttgaacgcggaggccagggctggatcttcgatctgtgggggagaggaactctaattgcagtttcaagcgccagtaccaagggtccgtccgtgtttcccacaatctatgtc

SEQ ID NO: 26554 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagagacccggagcttctgtcagggtttcatgctggaccagtgaagacatcttcgagacaactgaactcattcattgggtgcggcaggcacctggtcagggccttgagtggatagggtgggtaaaaacggtgagcggagccgtcaactttggctccctgaatttccgccaccgagtgtctttgacccgtgatagagacttatttacagcgcatatggatatcaggggtctgactcagggggacaccgctacatacttctgtgcccggcaaaagtttgcacgcggagatcagggctggttctttgacctatggggcagagggaccctcattgttgtgtcgtcagccagcactaaaggaccaagtgtcttcccgacaatctgcgtg

SEQ ID NO: 26555 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaacctgggcagcccaaattttcgccaccgagtgtccttgacccgtgatagagacttattcacagcgcatatggatatcaggggtctgactcagggggacaccgctacatacttttgtgcccggcaaaaattcgaacgcggaggccagggctggtattttgatctatgggggagaggaaccctcattgttgtgtcttcggcatcaactaagggtccgagcgtcttcccccacgacctgagg

SEQ ID NO: 26556 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgtcgacggctcatatggacatcaggggtctaacccaggatgacacagccacttatttctgtgcacggcaaaaatttgaacgcgggggacagggctggattttcgatctctggggcagagggaccctgatcgccgtttcaagcgctagtacaaagggaccttccgtgtttccaaccatttgcgtc

SEQ ID NO: 26557 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtttacagcgcatatggatatcaggggtttaactcagggggacaccgctacatacttctgtgcccggcaaaaatttgaacgcggaggccagggctggtatttcgatctgtgggggagaggaaccctaattgttgtgtcttcggcatcaactaagggtccgagcgtctttccccacgacctcgtg

SEQ ID NO: 26558 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaaggccgtgtccggagcggtcaactacggctctctggattttcgccaccgagtgtcgttgacacgtgacagagatttattcactgctcatatggacatcaggggtctgacgcaggatgacaccgccacatatttttgtgcacggcaaaaattcgcccgcggggatcagggatggtttttcgacctatggggcagaggcactctcattgttgtgtcaagcgctagtaccaaggggccatccgtctttccgacaatctacgtg

SEQ ID NO: 26559 - RNA, 420 nt, synthetic construct
  misc_feature 1..420: note = derived and/or modified sequence opt3 from anti-HIV-1_HeavyChain
  source 1..420: mol_type = other RNA
caggtgcacctggagcaaagcggctccggggtcaagaaacccggagcccctgttagagtgtcttgctggtcaagtgaagacatcttcgagaggaccgaactcattcattgggtacggcaggctccaggtcagggccttgagtggatagggtgggtgaagacagtcactggagcagtgaactttggcagcctggatttccgccaccgaatctccttgacgcgtgacagagatttatttaccgcccatatggacattaggggtctgacacagggggatactgcgacctacttctgtgctcggcaaaaattttatgccggaggccagggctggtacttcgacctatgggggcgcggaacactcatcgttgtgtcttcggcatcaaccaaggcccacagcgtcctgccgcccagaagtagggtg

SEQ ID NO: 26560 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagctctcgtcagagtttcttgctggacctcagaagacatcttcgagaagagtgaacttattcattgggtgaggcaggcacctggtcagggcctggagtggatagggtgggtaaaaacagtgactggagccgtcaactttggcagctccgatttccggcagcgcgtgtctttgacgcgagaccgtgatttatttaccgcgcacatggacatcagaggtctgacacaaggggatactgctacctacttctgtgccaggcagaagttttatgcaggaggccagggctggtacttcgacctatgggggcggggaacactcattgttgtgtcgtcagccagcaccaaaggtccaagtgtctttccgcatgatctgcgc

SEQ ID NO: 26561 - RNA, 414 nt, synthetic construct
  misc_feature 1..414: note = derived and/or modified sequence opt3 from anti-HIV-1_HeavyChain
  source 1..414: mol_type = other RNA
caggtgcaactggtccagagcggcgccgaggttaagaaacccggggcttccgtgaaggtatcttgccaggtgtcaggatacaccctcacagaacttagtatgcactgggtcagacaggcacctggtcaaggcctggagtggatcgggtgggtgaaaactgttacgggagccgtgaacttcggcagcccaaattttaggcatcgggtctccttgacccgcgaccgagatttattcacagcgcacatggacattcgtggtctgactcagggggataccgctacatatttttgtgccagacagaagttcgaaaggggaggccagggctggtactttgacctatgggggcggggaaccctcatagtggtatcttcggcatcaactaaaggtccgagcgttttcccccatgatctgcgc

SEQ ID NO: 26562 - RNA, 414 nt, synthetic construct
  misc_feature 1..414: note = derived and/or modified sequence opt3 from anti-HIV-1_HeavyChain
  source 1..414: mol_type = other RNA
caggcccacctggagcaaagcggctccggggtgaagaaacccggagcttctgtcagagtttcatgctggaccagtgaagacatcttcaagacagagctcattcattgggtgaggcaggcacctggtcagggccttgaatggatagggtgggtaaaaatcgtgagcggagccgtcaactttggctccccaaatttccggcagcgcgtgtctctgactcgagatcgtgacttgtttacggcgcacatggatattagaggtttaacccaaggggacacagctacttacttctgtgccaggcagaagtttgagcggggaggccagggctggatcttcgatctgtgggggcgcggaaccctaattgcagtttcgtcagccagcacaaaaggtccgagtgtgtttccccatgacctcaga

SEQ ID NO: 26563 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgttcacggctcatatggacatcaggggtctaacccaggatgacacagccacttatttttgtgcacggcaaaaattcgcccgcggggatcagggatggtttttcgacctctggggcagaggcaccctgattgttgtgtcgtcagctagcacaaaggggcctagtgtctttccaaccatctgcgtg

SEQ ID NO: 26564 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtgggtagggtgggtgaaaacagtcactggagccgtgaactttggctcctctgatttccggcagcgcgtttcgctgacgcgagaccgtgatttgtttaccgcgcacatggacataagaggtttaacacaaggggatactgctacctacttctgtgccaggcagaagttttatgcaggaggccagggctggtacttcgacctgtgggggcggggaacactaatcgtggtctcaagcgccagtaccaaaggtccatccgtgtttccgcatgatctccgc

SEQ ID NO: 26565 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagtttgaacggggaggccagggctggtatttcgacctgtgggggcgcggaacactaattgttgtgtcaagcgcaagtaccaaaggtccatccgtctttccgactatctgcgtg

SEQ ID NO: 26566 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgtcgacggctcatatggacatcaggggtctaacccaggatgacacagccacttatttctgtgcacggcaaaaatttgcccgcggggatcagggatggttctttgacctctggggcagaggcaccctgattgttgtgtcaagcgctagtacaaaggggccttccgtcttcccacagatctgcgtg

SEQ ID NO: 26567 - RNA, 414 nt, synthetic construct
  misc_feature 1..414: note = derived and/or modified sequence opt3 from anti-HIV-1_HeavyChain
  source 1..414: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggccaccagatctccgatcgggtgtctctgacgccagaccgcgatttgttcaccgcgcatatggacattcgaggtttaacacaaggggatactgctacctacttttgtgcccgtcagaagttctatgcaggaggccagggctggtactttgacctgtgggggagaggaacactaatcgttgtgtcgtcagccagcaccaaaggtccgagtgtcttccccactatttgcgtg

SEQ ID NO: 26568 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgaaaagagcgagctcattcattgggtgaggcgggcacctggtcagggccttgagtggatagggtgggtaaaaacagtgactggagccgtcaactttggctcctctgatttccgccagcgagtgtcgctgacgcgtgacagagatttgtttaccgcgcacatggacatcaggggtttaacacagggggatactgctacctacttctgtgcccggcaaaagttttatgcaggaggccagggctggtacttcgacctgtgggggcgcggaacactaattgttgtgtcaagcgccagtaccaaagctcatagatcctctccaactatctgcgtc

SEQ ID NO: 26569 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgttcacggctcatatggacatcaggggtctaacccaggatgacacagccacttatttttgtgcacggcaaaaattcgcccgcggggatcagggatggtttttcgacctctggggcagaggcaccctgattgttgtgtcgtcagctcctacaaaggggccaagcgtctttccgaccatctgcgtg

SEQ ID NO: 26570 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagctccgatttccgccagcgagtgtctctgacccgtgacagagatttgtttacagcgcacatggacatcaggggtttaactcaaggggataccgctacatacttctgtgcccggcagaaattttatgcaggaggccagggctggtacttcgacctgtgggggcgcggaaccctaattgttgtgtcgtcagccagcactaagggtccaagtgtctttccgcagatctatgtg

SEQ ID NO: 26571 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgaggtcgtgacttgtttaccgcgcacatggatatcagagggttaacacaaggagacactgctacctacttctgtgccaggcagaagttttatgcaggcggccaggggtggtacttcgatctgtggggacggggtacactaattgttgtgtcaagcgccagtaccaaaggcccatccgtctttccgactatctgcgtg

SEQ ID NO: 26572 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtctacagcgcatatggatatcaggggtttaactcaggacgataccgctacatacttttgtgcccggcaaaaattcgcacgcggggaccagggatggtttttcgatctgtggggcagaggcaccctaattgttgtgtcgtcagccagcactaaggggccgagtgtctttccccacgaccatgtg

SEQ ID NO: 26573 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtttacagcgcatatggatatcaggggtttaactcagggggacaccgctacatacttctgtgcccggcaaaaattttatgcaggaggccagggctggtacttcgatctgtgggggcgcggaaccctaattgttgtgtcttcggcctcaactaagggtccgagcgtctttccccagatctgcgtg

SEQ ID NO: 26574 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagatcgtgagcggagccgtcaactttggctccccaaatttccgccagcgagtgtctctgactcgtgatagagacttgtttacggcgcacatggatattaggggtttaacccaaggggacacagctacttacttctgtgcccggcagaaatttgaacgcggaggccagggctggatcttcgatctgtgggggagaggaaccctaattgttgtgtcgtcagcaagcacaaagggtccgagtgtctttcccaccatctgcgtg

SEQ ID NO: 26575 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctgggcaagtgaagacatcttcgagaggaccgaactcattcattgggtgcggcaggcccctggtcagggccttgagtggatagggtgggtaaagacagtgactggagcggtcaactttggcagcccaaatttccgccaccgagtgtccctgacgcgtgatagagacttgtttaccgctcatatggatatcaggggtttaacacagggggacactgccacctacttctgtgcacggcaaaaattttatgccggaggccagggctggtacttcgatctgtgggggcgcggaacactaattgttgtgtcttcggcttcaaccaagggtccgagcgtctttccccacgacctcctg

SEQ ID NO: 26576 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagtttgaacggggaggccagggctggattttcgacctgtgggggcgcggaacactaatcgcagtttcaagcgccagtaccaaaggtccatccgtgtttccgcatgatctcaga

SEQ ID NO: 26577 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaaggccgtgagcggagcggtcaactacggctccctggattttcgccaccgagtgtctttgactcgtgacagagatttatcgacggctcatatggacatcaggggtctgacccaggatgacacagccacttatttctgtgcacggcaaaaatttgcccgcggggatcagggatggttctttgacctatggggcagaggcaccctcattgttgtgtcaagcgctagtacaaaggggccatccgtcttcccgcacgatctgagg

SEQ ID NO: 26578 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggagcgaactcattcattgggtgcggcaggcacctggtcagggccttgagtggatagggtgggtaaagacagtgactggagccgtcaactttggctccccaaatttccgccaccgagtgtctctgacgcgtgatagagacttgtttaccgcgcatatggatatcaggggtttaacacagggggacactgctacctacttctgtgcccggcaaaaatattacgcaggaggccagggctggtattttgatctgtgggggcgcggaacactaattgttgtgtcgtcagccagcaccaagggtccgagtgtcttccccactatctgcaga

SEQ ID NO: 26579 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagtttgaacggggaggccagggctggtatttcgacctgtgggggcgcggaacactaattgttgtgtcaagcgcaagtaccaaaggtccatccgtctttccgcatgatctcaga

SEQ ID NO: 26580 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgttcacggctcatatggacatcaggggtctaacccaggatgacacagccacttatttttgtgcacggcaaaaattcgcccgcggggatcagggatggtttttcgacctctggggcagaggcaccctgattgttgtgtcgtcagctagcacaaaggggcctagtgtctttccaaccatctacgtg

SEQ ID NO: 26581 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagttttataaaggaggccagggctggtacttcgacctgtgggggcggggaacactaattgttgtgtcaagcgcaagtaccaagggtccatccgtctttccgcatgatctccgc

SEQ ID NO: 26582 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggaaccgtcaactttggcagcctgaatttccgccagcgagtgtccttgacacgtgatagagacttatttactgcccacatggatatcaggggtctgacccaagacgatacagcgacctacttctgtgctcggcagaaatttgcccgcggggaccagggatggttctttgatctatggggcagaggcactctcattgttgtgtcttcggcatcaacaaaggggccaagcgtcttcccgcatgacctgagg

SEQ ID NO: 26583 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggcctagtgaagacatcttcgaaaagagcgagctcattcattgggtgaggcaggcaccaggtcagggccttgagtggatagggtgggtaaaaaccgtgacaggagccgtcaactttggctcctctgatttccggcagcgcgtgtcgctgactcgagaccgtgatttgtttacggcgcacatggacatcagaggtttaacccaaggggatacagctacttacttctgtgccaggcagaagtttgaacggggaggccagggctggattttcgacctgtgggggcgcggaaccctaatcgcagtttcaagcgccagtacaaaaggtccgtccgtgtttccccatgatctcaga

SEQ ID NO: 26584 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagagacccggagcttctgtcagggtttcatgctggaccagtgaagacatcttcgagacaactgaactcattcattgggtgcggcaggcacctggtcagggccttgagtggatagggtgggtaaaaacggtgagcggagccgtcaactttggctccctgaatttccgccaccgagtgtctttgacccgtgatagagacttatttacagcgcatatggatatcaggggtctgactcagggggacaccgctacatacttctgtgcccggcaaaagtttgcacgcggagatcagggctggttctttgacctatggggcagagggaccctcattgttgtgtcgtcagccagcactaaaggaccaagtgtcttcccgcacgatctgagg

SEQ ID NO: 26585 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtggaaaagcccggagcttctgtcagagtttcatgctggaccagtgaggacatcttcgaaaggagcgagctcattcattgggtgcggcaggcacctggtcagggccttgaatggatagggtgggtaaaaacagtgactggagccgtcaactttggctccccaaatttccgccaccgagtgtctctgacgcgtgatagagacttgtttaccgcgcatatggatatcaggggtttaacacagggggacactgctacctacttctgtgcccggcaaaagtattacgcaggaggccagggctggtattttgatctgtgggggcgcggaacactaattgttgtgtcgtcagccagcaccaaaggtccgagtgtcttcccccacgacctcaga

SEQ ID NO: 26586 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagatcgtgagcggagccgtcaactttggctccccaaatttccgccagcgagtgtctctgactcgtgatagagacttgtttacggcgcacatggatattaggggtttaacccaaggggacacagctacttacttctgtgcccggcagaaatttgaacgcggaggccagggctggatcttcgatctgtgggggagaggaaccctaattgcagtttcgtcagccagcacaaagggtccgagtgtgtttccccatgacctcagg

SEQ ID NO: 26587 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagaaacttgtttacagcgcatatggacatcaggggtttaactcagggggataccgctacatacttctgtgcccggcaaaaatttgaacgcggaggccagggctggtatttcgacctgtgggggagaggaaccctaattgttgtgtcttcggcatcaactaagggtccgagcgtctttccccacgatctcagg

SEQ ID NO: 26588 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagatcgtgagcggagccgtcaactttggctccccaaatttccgccagcgagtgtctctgactcgtgatagagacttgtttacggcgcacatggatattaggggtttaacccaaggggacacagctacttacttctgtgcccggcagaaattttatgcaggaggccagggctggtacttcgatctgtgggggcgcggaaccctaatcgttgtgtcgtcagccagcacaaagggtccgagtgtctttccccatgacctcaga

SEQ ID NO: 26589 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactacggcagcctgaattttcgctcccgaatctctttgacccgtgatagagacttattcacagcgcacatggatattaggggtctgactcagggggacaccgctacatatttttgtgcccggcaaaaattcgaacgcggaggccagggctggatctttgatctatgggggagaggaaccctcattgcagtgtcgtcagccagcactaagggtccaagtgttttcccgcatgacctgagg

SEQ ID NO: 26590 - RNA, 417 nt, synthetic construct
  misc_feature 1..417: note = derived and/or modified sequence opt3 from anti-HIV-1_HeavyChain
  source 1..417: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgcatatggatatcagaggactgacacagggcgacactgctacctatttttgtgccaggcaaaaattctacgccggtgggcagggatggtattttgatctatggggccggggcacactcattgtcgtgagttccgcatctaccaaggggccaagcgttttcccgcacgacctgcgc

SEQ ID NO: 26591 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggattgaactcatacattgggtgcggcaggcacctggtcagggccttgagtggatcgggtgggtaaagacagtgactggagccgtcaactttggcagcccaaatttccgccaccgagtgtccctgacgcgtgatagagacttgtttaccgcgcatatggatattaggggtttaacacagggggacactgctacctacttctgtgcccggcaaaaatttgaacgcggaggccagggctggtatttcgatctgtgggggagaggaacactaatcgttgtgtcttcggcatcaaccaagggtccgagcgtctttccccacgacctcagg

SEQ ID NO: 26592 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccagcgagtgtctttaactcgtgacagagatctgttcacggctcacatggacatcaggggtctaacccaaggggatacagccacttatttttgtgcacggcagaaattctacgccggaggccagggctggtattttgacctctgggggcgcggaaccctgattgttgtgtcgtcagctagcacaaagggtcctagtgtcttcccacatgatcttaga

SEQ ID NO: 26593 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggagtagcgaagacatcttcgagagggcagaactcattcattgggtgcggcaggcccctggtcagggccttgagtggatagggtgggtaaagaccgtgacaggagcggtcaactttggctccccaaatttccgccagcgagtgtctctgactcgtgatagagacttgtttacggctcacatggatatcaggggtttaacccaaggggacacagccacttacttctgtgcacggcagaaatttgaacgcggaggccagggctggattttcgatctgtgggggagaggaaccctaatcgccgtttcgtcagctagcacaaagggtccgagtgtgtttccccatgacctcagg

SEQ ID NO: 26594 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaaggccgtgagcggagcggtcaactacggctccctggattttcgccaccgagtgtctttgactcgtgacagagatttattcacggctcatatggacatcaggggtctgacccaggatgacacagccacttatttttgtgcacggcaaaaattcgcccgcggggatcagggatggtttttcgacctatggggcagaggcaccctcattgttgtgtcgtcagctagcacaaaggggccaagtgtctttccgcacgatctgagg

SEQ ID NO: 26595 - RNA, 417 nt, synthetic construct
  misc_feature 1..417: note = derived and/or modified sequence opt3 from anti-HIV-1_HeavyChain
  source 1..417: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgcatatggatatcagaggactgacacaggacgatactgctacctatttttgtgccaggcaaaaattcgagcggggcggtcaggggtggtactttgacctatggggacgcggcacactcattgtcgtgagttccgcatctaccaagggcccaagcgttttcccgcacgatctgaga

SEQ ID NO: 26596 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgtcaactttggctccctggatttccgccaccgaatctctttgacgcgtgacagagatttatttaccgcgcatatggacattaggggtctgacacagggggatactgctacctacttctgtgcccggcaaaaattttatgcaggaggccagggctggtacttcgacctatgggggcgcggaacactcatcgtggtttcgtcagccagcaccaagggtccaagtgtgtttccgcacgatctgaga

SEQ ID NO: 26597 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaagatgacactgctatttacttctgtgccaggcagaagtttgcacgcggggatcagggatggttctttgacctgtggggccggggcaccctaatcgttgtgtcaagcgccagtacaaaagggccatccgtcttcccgcatgatctcaga

SEQ ID NO: 26598 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagggacccggtgcttctgtcagagtttcatgctggaccagtgaagacatcttcgagacaactgaactcattcattgggtgaggcaggcacctggccaggggcttgagtggataggatgggtaaaaacggtgagcggcgccgtcaactttggttccctgaatttccggcaccgcgtgtctttgacccgagatcgtgacttatttacagcgcatatggatatcagagggctgactcagggagacaccgctacatacttctgtgccaggcaaaagtttgcacggggcgatcagggctggttctttgacctatgggggcgcggaaccctcattgttgtgtcgtcagccagcactaaaggtccaagtgtcttcccgcacgatctgaga

SEQ ID NO: 26599 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagggtagcgaactcattcattgggtgaggcaggcacctggccaggggcttgagtggataggatgggtaaagacagtgactggcgccgtcaactttggttccgcgtacttccggcaccgcgtgccactgacgcgagatcgtgacttgtttaccgctcatatggatatcagagggttaacacagggagacactgccacctatttctgtgcaaggcaaaaattttacaagggcggccaggggtggtatttcgatctgtggggacggggtacactaattgttgtgtcttcggcctcaaccaaaggcccgagcgtctttccccacgacctccgc

SEQ ID NO: 26600 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtttacagcgcatatggatatcaggggtttaactcagggggacaccgctacatacttctgtgcccggcaaaaatttgaacgcggaggccagggctggtatttcgatctgtgggggagaggaaccctaattgttgtgtcttcggcatcaactaagggtccgagcgtctttccccacgacctcagg

SEQ ID NO: 26601 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaagtcggagcttctgttagagtgtcatgctggaccagtgaagacatcttcgagaggacagaactcattcattgggtacggcaggcacccggtcagggccttgagtggatagggtgggtgaaggccgtcagcggagcggtgaactacggctccctggattttcgccaccgagtttctttgactcgtgacagagatttattcacggctcatatggacatcaggggtctgacccagggggatacagccacttatttttgtgcacggcaaaaattctacgccggaggccagggctggtattttgacctatgggggcgcggaaccctcattgtggtctcgtcagctagcacaaagggtcctagtgtgttcccacacgatctgaga

SEQ ID NO: 26602 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtttacagcgcatatggatatcaggggtttaactcaggacgataccgctacatacttctgtgcccggcaaaaatttgcacgcggggaccagggatggttctttgatctgtggggcagaggcaccctaattgttgtgtcttcggcctcaactaaggggccgagcgtcttcccccacgacctcagg

SEQ ID NO: 26603 - RNA, 417 nt, synthetic construct
  misc_feature 1..417: note = derived and/or modified sequence opt3 from anti-HIV-1_HeavyChain
  source 1..417: mol_type = other RNA
cagagccacctggagcaatccggctctgccatgaagaaacccggggcttcagtgagagtcagttgctggaccagcgaagacatcttcgagaggacagaactcatttactgggttcggcaggcacctggacgcggtcttgagtggataggctgggtgaagactgtatccgggacggtgaactttggatcttcggatttccgaaatcgtatctcactgaccagagacagggatttgagcacagcccatatggacattcggggcttaactcaggatgacaccgcgacatatttttgtgctcgccagaaattcgccagaggtgatcaagggtggtttttcgacctgtggggaaggggcaccctaatcgtcgtgagttccgcatctactaagggcccaagcgtttttccgcacgatctccgg

SEQ ID NO: 26604 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcgaatccggcgtgaagaaactcggggcttctgtcagagtttcatgctggaccagtgaggacatcttcgaaaggacagagcttattcattgggtgcggcaggcacccggacagggtctggaatggataggctgggtaaaggccgtgagcggggcggtcaactacggatccttggattttcgccaccgagtgtctttaactcgtgacagagatctgttcacggctcatatggacatcaggggcctaacccaggatgacacagccacttatttttgtgcacggcaaaaattcgcccgcggtgatcaggggtggtttttcgacctctggggaagaggcaccctgattgttgtgtcgtcagctagcacaaagggccctagtgtctttccacacgatcttagg

SEQ ID NO: 26605 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagttttatgcaggaggccagggctggtacttcgacctgtgggggcggggaacactaattgttgtgtcaagcgccagtaccaaaggtccatccgtctttccgactacactccgc

SEQ ID NO: 26606 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaagtcggagcttctgttagagtgtcatgctggaccagtgaagacatcttcgagaggacagaactcattcattgggtacggcaggcacccggtcagggccttgagtggatagggtgggtgaagactgtcacgggagccgtgaactttggcagctccgatttccgccagcgagtttctctgacccgtgacagagatttgtttacagcgcacatggacatcaggggtttaactcaaggggataccgctacatacttctgtgcccggcagaaattttatgcaggaggccagggctggtacttcgacctgtgggggcgcggaaccctaattgtggtctcgtcagccagcactaagggtcctagtgtgtttccacatgatctcaga

SEQ ID NO: 26607 - RNA, 420 nt, synthetic construct
  misc_feature 1..420: note = derived and/or modified sequence opt3 from anti-HIV-1_HeavyChain
  source 1..420: mol_type = other RNA
caggccagacccggcgctaacagggggagcggagtgaagaaacctggtgcatccgtccgggtttcttgctggacctcagaggacatcttcgaacgcacagagctgattcactgggtgcgacaagccccaggccaggggctcgaatggataggatgggtaaagatcgtgagtggcgcggtcaattttggtagcccgaacttccgtcagagagtgtcccttactagggatcgggacctgtttacggctcatatggatattcgcgggttgacccagggagacacagccacttacttctgtgcaagacaaaaatttgagaggggcggccaggggtggatcttcgatttatggggacggggtaccctgattgccgtttcttcggcttcaacaaagggccccagcgtgtttcctcacgacctacgc

SEQ ID NO: 26608 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggagcgaactcattcattgggtgcggcaggcacctggtcagggccttgagtggatagggtgggtaaagacagtgactggagccgtcaactttggctccccaaatttccgccaccgagtgtctctgacgcgtgatagagacttgtttaccgcgcatatggatatcaggggtttaacacagggggacactgctacctacttctgtgcccggcaaaaatattacgcaggaggccagggctggtattttgatctgtgggggcgcggaacactaattgttgtgtcgtcagccagcaccaagggtccgagtgtcttcccccacgacctcaga

SEQ ID NO: 26609 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagggtagcgaactcattcattgggtgaggcaggcacctggccaggggcttgagtggataggatgggtaaagacagtgactggcgccgtcaactttggttccgcgtacttccggcaccgcgtgtctctgacgcgagatcgtgacttgtttaccgctcatatggatatcagagggttaacacagggagacactgccacctatttctgtgcaaggcaaaaattttacaagggcggccaggggtggtatttcgatctgtggggacggggtacactaattgttgtgtcgtcagccagcaccaaaggcccaagtgtctttccgcacgacctccgc

SEQ ID NO: 26610 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgtcgacggctcatatggacatcaggggtctaacccaggatgacacagccacttatttctgtgcacggcaaaaatttgcccgcggggatcagggatggttctttgacctctggggcagaggcaccctgattgttgtgtcaagcgctagtacaaaggggccttccgtccttccaccgaggtctgca

SEQ ID NO: 26611 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccgggatgaagaaacccggagcttctgtgagagtctcatgctggagtagcgaagacatcttcgagaggaccgaactcattcattgggttcggcaggcacctggtcagggccttgagtggatagggtgggtgaagacagtaactggagccgtgaactttggctcctctgatttccgccagcgagtctcgctgacgcgtgacagagatttgtttaccgcgcacatggacatcaggggtttaacacaaggggatactgctacctacttctgtgcccggcagaaattttatgcaggaggccagggctggtacttcgacctgtgggggcgcggaacactaattgtggtttcaagcgccagtaccaagggtccatccgtgtttccgcatgatctcaga

SEQ ID NO: 26612 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaaggaacccggaacctctgtcagagtttcatgctggacaagtgaggacatcttcgaaaggactgagctcattcattgggtgcggcaggctcctggtcagggccttgaatggatagggtgggtaaaaacggtgaccggagcagtcaactttggcagcccaaatttccgccaccgagtgtccctgacacgtgatagagacttgtttactgcccatatggatatcaggggtttaacccagggggacacagcgacctacttctgtgctcggcaaaagtttgagcgcggaggccagggctggattttcgatctgtgggggagaggaactctaatcgccgtttcttcggcatcaacaaaaggtccgagcgtgtttccccagaccctcagg

SEQ ID NO: 26613 - RNA, 417 nt, synthetic construct
  misc_feature 1..417: note = derived and/or modified sequence opt3 from anti-HIV-1_HeavyChain
  source 1..417: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggcatcgcgtctcgttgacccgagatcgtgacttatcaacagcgcacatggatattagaggactgactcaggacgataccgctacatatttttgtgccaggcaaaaattcgcacggggcgaccagggttggtttttcgatctatgggggcgcggaaccctcatcgtggttagcagtgcctccactaagggcccatctgtgtttccgcatgacctgaga

SEQ ID NO: 26614 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagacaactgaactcattcattgggtgaggcaggcacctggtcagggccttgagtggatagggtgggtaaagacggtgagcggagccgtcaactttggctccctgaatttccggcaccgcgtgtctttgacccgagatcgtgacttatttacagcgcatatggatatcagaggtctgactcagggggacaccgctacatacttctgtgccaggcaaaaatttgcacggggagatcagggctggttctttgacctatggggccgcgggaccctcattgttgtgtcgtcagccagcactaagggaccaagtgtcttcccgcacgatctgaga

SEQ ID NO: 26615 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaagtcggagcttctgttagagtgtcatgctggaccagtgaagacatcttcgagaggacagaactcattcattgggtacggcaggcacccggtcagggccttgagtggatagggtgggtgaagactgtcacgggagccgtgaactttggcagccctaatttccgccaccgagtttccctgacccgtgatagagacttgtttacagcgcatatggatatcaggggtttaactcagggggacaccgctacatacttctgtgcccggcaaaaatttgaacgcggaggccagggctggtatttcgatctgtgggggagaggaaccctaattgtggtctcttcggcatcaactaagggtccaagcgtgtttccgcacgacctcagg

SEQ ID NO: 26616 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggcgctggggtgaagaaacccggagcatccgtcagagtttcttgctggacctcagaagacatcttcgagaggacagaactcattcattgggtgcggcaggcccctggtcagggccttgagtggatagggtgggtaaagactgtgagtggagcggtcaactttggcagcccaaatttccgccaccgagtgtccctgacgcgtgatagagacttgtttaccgctcatatggatatcaggggtttaacacagggggacactgccacctacttctgtgcacggcaaaaatttgaacgcggaggccagggctggtatttcgatctgtgggggagaggaacactaattgttgtgtcttcggcctcaaccaagggtccgagcgtctttccccacgacctcagg

SEQ ID NO: 26617 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactacggcagcctgaattttcgctcccgaatctctttgacccgtgatagagacttattcacagcgcacatggatattaggggtctgactgaaggggacaccgctacatatttttgtgcccggcagaaattctacgcaggaggccaaggctggtattttgatctatgggggcgcggaaccctcatcgtggtttcgtcagccagcactaagggtccaagtgtgttcccgcatgacctgaga

SEQ ID NO: 26618 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgcctcgcaagtgaagacatcttcgagaggaccgaacttattcattgggtgcggcaggcccctggtcagggcctggagtggatagggtgggtaaagacagtgactggagcggtcaactttggcagcccaaatttccgccaccgagtgtccttgacgcgtgatagagacttatttaccgctcatatggatatcaggggtctgacacagggggacactgccacctacttctgtgcacggcaaaaatttgaacgcggaggccagggctggtatttcgatctatgggggagaggaacactcattgttgtgtcttcggcctcaaccaagggtccgagcgtctttccccacgacctgagg

SEQ ID NO: 26619 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgtcaactttggctccctggatttccgccaccgaatctctttgacgcgtgacagagatttatttaccgcgcatatggacattaggggtctgacacagggggatactgctacctacttctgtgcccggcaaaaatttgaacgcggaggccagggctggatcttcgacctatgggggagaggaacactcattgcagtgtcgtcagccagcaccaagggtccaagtgtttttccgcacgatctgagg

SEQ ID NO: 26620 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccagcgagtgtccctgacccgtgatagagacttgtttacagcgcacatggatatcaggggtttaactcaaggggacaccgctacatacttctgtgcccggcagaaatttgaacgcggaggccagggctggtatttcgatctgtgggggagaggaaccctaattgttgtgtcttcggcatcaactaagggtccgagcgtctttccccatgacctcagg

SEQ ID NO: 26621 - RNA, 417 nt, synthetic construct
  misc_feature 1..417: note = derived and/or modified sequence opt3 from anti-HIV-1_HeavyChain
  source 1..417: mol_type = other RNA
caggtgcacctggagcaaagcggctccggggtcaagaaacccggagcctctgttagagtgtcatgctggaccagtgaagacatcttcgagaggacagaactcattcattgggtacggcaggctcctggtcagggccttgagtggatagggtgggtgaagactgtcacgggagcagtgaactttggcagcccaaatttccgccaccgagtttccctgacccgtgatagagacttgtttacagcccatatggatatcaggggtttaactcagggggacaccgcgacatacttctgtgctcggcaaaaatttgaacgcggaggccagggctggtatttcgatctgtgggggagaggaaccctaattgtggtctcttcggcctcaactaagggtccgagcgtgtttccccacgacctcagg

SEQ ID NO: 26622 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgagcggagccgtcaactttggctccccaaatttccgccagcgagtgtctctgacgcgtgatagagacttgtttaccgcgcacatggatatcaggggtttaacacaaggggacactgctacctacctgtgtgcccggcagaaattcgaacgcggaggccagggctggatttttgatctatgggggagaggaacactcatcgcagtttcgtcagccagcaccaagggtccgagtgtgttcccccatgacctgagg

SEQ ID NO: 26623 - RNA, 417 nt, synthetic construct
  misc_feature 1..417: note = derived and/or modified sequence opt3 from anti-HIV-1_HeavyChain
  source 1..417: mol_type = other RNA
cagagccacctggagcaatccggctctgccatgaagaaacccggggcttcagtgagagtcagttgctggaccagcgaagacatcttcgagaggacagaactcatttactgggttcggcaggcacctggacgcggtcttgagtggataggctgggtgaagactgtatccgggacggtgaactttggatcttcggatttccgacatcgtgtctcactgaccagagacagggatttgtttacagcccacatggacatccggggcttaactcagggtgataccgcgacatatttctgtgctcgccagaaattttacaaagggggacaaggctggtatttcgacctgtggggcagagggaccctaattgtggttagcagtgcctccactaagggaccatctgtgtttccgcatgatctcagg

SEQ ID NO: 26624 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgccagaccgagatttgtttaccgcgcacatggacatccgtggtttaacacaaggggatactgctacctacttctgtgccagacagaagttttatgcaggaggccagggctggtacttcgacctgtgggggaggggaacactaattgttgtgtcaagcgccagtaccaaaggttcctctgtctttccgcatgatctccgg

SEQ ID NO: 26625 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgccagaccgagatttgtttaccgcgcacatggacatccgtggtttaacacaaggggatactgctacctacttctgtgccagacagaagttttatgcaggaggccagggctggtacttcgacctgtgggggaggggaacactaattgttgtgtcaagcgccagtaccaaaggtccgtccgtctttccccatgatctccgg

SEQ ID NO: 26626 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgtcgacggctcatatggacatcaggggtctaacccaggatgacacagccacttatttctgtgcacggcaaaaatttgcccgcggggatcagggatggttctttgacctctggggcagaggcaccctgattgttgtgtcaagcgctagtacaaaggggccttccgtcttcccacacgatcttagg

SEQ ID NO: 26627 - RNA, 417 nt, synthetic construct
  misc_feature 1..417: note = derived and/or modified sequence opt3 from anti-HIV-1_HeavyChain
  source 1..417: mol_type = other RNA
caggtgcacctggagcaaagcggctccggggtcaagaaactcggagcctctgttagagtgtcatgctggaccagtgaagacatcttcgagaggacagaacttattcattgggtacggcaggctcccggtcagggcctggagtggatagggtgggtgaaggcagtcagcggagccgtgaactacggctccttggattttcgccaccgagtttctttaactcgtgacagagatctgttcacggcgcatatggacatcaggggtctaacccaggatgacacagctacttatttttgtgcccggcaaaaattcgcacgcggggatcagggatggtttttcgacctctggggcagaggcaccctgattgtggtctcgtcagccagcacaaaggggcctagtgtgtttccacacaggtccacc

SEQ ID NO: 26628 - RNA, 420 nt, synthetic construct
  misc_feature 1..420: note = derived and/or modified sequence opt3 from anti-HIV-1_HeavyChain
  source 1..420: mol_type = other RNA
caggtgtacatggagcaagccggcgctggggtcaagaaacccggagcaagcgttaccctgtcctgcaagacagccgacgaagatgtgttcgacgcggcttatatgcactgggtaagacaggcccctggtcagacttttgagtggctcggctggatgaaaccagtgacgggggcagtctcttacgccaggaagttccagggacgggtgtcattttatatgacccgcgaacttggcatggcttacatggatctgcgaaacttgcgtttcgacgatacagcagtttatttttgtgccagaaaaactgctggtgacgtgagtggggataataggggatacttctttgacttatggggccggggcagccgcgtcatcgtgtcctctgcctcgaccaaggggccgtcagtattcacaatttatgtt

SEQ ID NO: 26629 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgttcacggctcatatggacatcaggggtctaacccaggatgacacagccacttatttttgtgcacggcaaaaattcgcccgcggggatcagggatggtttttcgacctctggggcagaggcaccctgattgttgtgtcgtcagctagcacaaaggggcctagtgtctttccacacgatccggca

SEQ ID NO: 26630 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgtcgacggctcatatggacatcaggggtctaacccaggatgacacagccacttatttctgtgcacggcaaaaatttgcccgcggggatcagggatggttctttgacctctggggcagaggcaccctgattgttgtgtcaagcgctagtacaaaggggccttccgtccttccaccgaggtctacc

SEQ ID NO: 26631 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaaggccgtgtccggagcggtcaactacggctctctggattttcgccaccgagtgtcgttgacacgtgacagagatttattcactgctcatatggacatcaggggtctgacgcaggatgacaccgccacatatttttgtgcacggcaaaaattcgcccgcggggatcagggatggtttttcgacctatggggcagaggcactctcattgttgtgtcaagcgctagtaccaaggggccatccgtctttccgcacgatctgagg

SEQ ID NO: 26632 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccgaatggaagaaactcggggcttctgtgagagtctcatgctggaccagtgaggacatcttcgaaaggacagagcttattcattgggttcggcaggcacccggacagggtctggaatggataggctgggtgaaggccgtaagcggggcggtgaactacggatccttggattttcgccaccgagtctctttaactcgtgacagagatctgtcgacggctcatatggacatcaggggcctaacccaggatgacacagccacttatttctgtgcacggcaaaaatttgcccgcggtgatcaggggtggttctttgacctctggggaagaggcaccctgattgtggtttcaagcgctagtacaaagggcccttccgtgttcccacacgatcttagg

SEQ ID NO: 26633 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccgaagtgaagaaacccggggcttctgtcagagtttcatgctggaccagtgaggacatcttcgaaaagagcgagctcattcattgggtgaggcaggcacctggacagggtcttgaatggataggctgggtaaaaacagtgactggggccgtcaactttggatcctctgatttccggcagcgcgtgtcgctgacgcgagaccgtgatttgtttaccgcgcacatggacatcagaggcttaacacaaggtgatactgctacctacttctgtgccaggcagaagttttatgcagggggacagggctggtacttcgacctgtggggccgggggacactaattgttgtgtcaagcgccagtaccaaaggaccatccgtctttccgcatgatctccgc

SEQ ID NO: 26634 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaagactgtgacgggagccgtcaactttggcagccctaatttccgccaccgagtgtccttgacccgtgatagagacttatttacagcgcatatggatatcaggggtctgactcagggggacaccgctacatacttctgtgcccggcaaaaatttgaacgcggaggccagggctggtatttcgatctatgggggagaggaaccctcattgttgtgtcttcggcatcaactaagggtccaagcgtctttccgcacgacctgagg

SEQ ID NO: 26635 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcctcaggaaaagcgagcttattcattgggtgcggcaggcacctggtcagggcctggaatggatagggtgggtaaagacagtgactggagccgtcaacttcggctcctctgattttcgccagcgagtgtcgttgacgcgtgacagagatttattcaccgcgcacatggacatcaggggtctgacacaaggggatactgctacctacttttgtgcccggcagaagttctatgcaggaggccagggctggtactttgacctatgggggcgcggaacactcattgttgtgtcaagcgccagtaccaaaggtccatccgtcttcccgcatgatctgaga

SEQ ID NO: 26636 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcgcttccggcgtgaagagacccggggcatctgtcagggtttcatgcctcgccagtgaagacatcttcgagcggagcgaacttatttactgggtgcgccaggcgcctggacagggtctggagtggataggctgggtaaaaatcgtgtccggggctgtcaactttggatctccaaatttccgacagcgtgtgtcgttgaccagagatagggacttatttacagcccatatggatattcggggcctgactcaaggtgacacggcaacctatttctgtgcccgccagaagtttgaaagagggggacagggctggatcttcgatctatggggcagggggacactcattgctgtttcaagcgcaagtactaaaggaccgtccgtgtttccccacgacctgcgg

SEQ ID NO: 26637 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagagacccggagcttctgtcagggtttcatgctggaccagtgaagacatcttcgagacaactgaactcattcattgggtgcggcaggcacctggtcagggccttgagtggatagggtgggtaaaaacggtgaccggagccgtcaactttggcagcgcgtacttccgccaccgagtgtccctgacacgtgatagagacttgtttactgctcatatggatatcaggggtttaacccagggggacacagccacctatttctgtgcacggcaaaagttttacaaaggaggccagggctggtatttcgatctgtgggggcgcggaactctaattgttgtgtcttcggcctcaacaaagggtccaagcgtctttccgcacgacctcaga

SEQ ID NO: 26638 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcgcttccggcgtgaagagacccggggcatctgtcagggtttcatgctggaccagtgaagacatcttcgagcggagcgaactcatttactgggtgcgccaggcccctggacagggtcttgagtggataggctgggtaaaaacagtgtccggggcggtcaactttggatctactgatttccgacatcgtgtgtcgctgacgagagacagggatttgtttaccgctcacatggacatccggggcttaacacagggtgatactgccacctatttctgtgcacgccaaaagtttgaaagagggggacagggctggtacttcgacctgtggggcagggggacactaattgttgtgtcaagcgccagtaccaaaggaccatccgtctttccgcatgatctccgg

SEQ ID NO: 26639 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgtcgacggctcatatggacatcaggggtctaacccaggatgacacagccacttatttctgtgcacggcaaaaatttgcccgcggggatcagggatggttctttgacctctggggcagaggcaccctgattgttgtgtcaagcgctagtacaaaggggccttccggacttccaccgaggtctgca

SEQ ID NO: 26640 - RNA, 417 nt, synthetic construct
  misc_feature 1..417: note = derived and/or modified sequence opt3 from anti-HIV-1_HeavyChain
  source 1..417: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgcatatggatatcagaggactgacacagggcgacactgctacctatttttgtgccaggcaaaaattcgagcggggtgggcagggatggatttttgatctatggggccgcggcacactcatcgcagtcagttccgcctctaccaaggggccaagcgtgttcccgctgagatccgct

SEQ ID NO: 26641 - RNA, 423 nt, synthetic construct
  misc_feature 1..423: note = derived and/or modified sequence opt3 from anti-HIV-1_HeavyChain
  source 1..423: mol_type = other RNA
caggtgcaaatggagcaggccggcgctgggatgaagaaacccggagcaagcatgaccgtctcctgcaagacagccgacgaagatatcttcgacgcggcttacatgcactgggttagacaggcccctggtcagacttttgagtggctgggctggatgaaaccagtgacgggggcagtaaactatgccaggcaattccagggacgggcttctttttaccgcacccgagaactcggcattgcatatatggatcttcgtgacctgaagttcgatgacacagccgtgtacttttgtgctagaaaaactaagggtgatgtctcaggggacgataggggattctttttcgacttgtggggccggggcacccgcgtgatagttagtagcgcctccacaaaggggccgtctgtgtttccccatgatttaaga

SEQ ID NO: 26642 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgtcaactttggctccctggatttccgccaccgaatctctttgacgcgtgacagagatttatttaccgcgcatatggacattaggggtctgacacagggggatactgctacctacttctgtgcccggcaaaaattttataagggaggccagggctggtacttcgacctatgggggcgcggaacactcatcgtggtttcgtcagcaagcaccaaaggtccaagtgtgtttccgcagatttgcaga

SEQ ID NO: 26643 - RNA, 414 nt, synthetic construct
  misc_feature 1..414: note = derived and/or modified sequence opt3 from anti-HIV-1_HeavyChain
  source 1..414: mol_type = other RNA
caggcccacctggagcaaagcggcgctggggtgaagaaacccggagcatccgtcagagtttcttgctggacctcagaagacatcttcgagaagagtgaactcattcattgggtgaggcaggcccctggtcagggccttgagtggatagggtgggtaaaaacagtgactggagcggtcaacctggtgcaccagatcagcgatcgggtttccttgacgcgcgaccgagatttatctaccgctcatatggacattcgtggcctgacacaagatgacactgccacctacttttgtgcaagacagaagttcgccaggggtgatcaggggtggtttttcgacctatggggacggggcacactcatcgtggtctcgtcagctagcaccaaaggcccaagtgtgtttccgcacgatctgcgc

SEQ ID NO: 26644 - RNA, 420 nt, synthetic construct
  misc_feature 1..420: note = derived and/or modified sequence opt3 from anti-HIV-1_HeavyChain
  source 1..420: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgtcgacggctcatatggacatcaggggtctaacccaggatgacacagccacttatttctgtgcacggcaaaaatttgcccgcggggatcagggatggttctttgacctctggggcagaggcaccctgattgttgtgtcaagcgctagtacaaaggggccttccggacttccaccgaggctgtgcgtc

SEQ ID NO: 26645 - RNA, 417 nt, synthetic construct
  misc_feature 1..417: note = derived and/or modified sequence opt3 from anti-HIV-1_HeavyChain
  source 1..417: mol_type = other RNA
caggccagactggagcaaagcggctccggggtgaagaaacccggagcttctgtcagggtttcatgctggaccagtgaagacatcttcgagggtagcgaactcattcactgggtgcggcaggcacctggccaggggcttgagtggataggatgggtaaagacagtgactggcgccgtcaactttggttccgcgtacttccgccatcgagtgtctctgacgcgtgatagagacttgtttaccgctcacatggatatcagggggttaacacagggagacactgccacctatttctgtgcacggcaaaaatttgcccgcggcgatcagggctggttctttgacctgtgggggagaggaacactaattgttgtgtcgtcagctagcaccaagggtccaagtgtcttcccgcatgattccgca

SEQ ID NO: 26646 - RNA, 414 nt, synthetic construct
  misc_feature 1..414: note = derived and/or modified sequence opt3 from anti-HIV-1_HeavyChain
  source 1..414: mol_type = other RNA
caggtgcaactggtccagagcggcgccgaggttaagaaacccgggtcctctgtgaaggtatcatgcaaagtgagtggaggtgtcttcaccagctacgctgtgacatgggttagacaggcacctggccaggggctcgaatggatcggatgggtgaaggccgtctccggcgcggtgaactatggttctcttgactttaggcaccgggtatcgctgactcgcgatcgagacttgttcacggctcatatggatattcgtgggttaacccaagacgatacagccatatacttttgtgcaagacagaaattcgccaggggagaccagggctggtttttcgatctgtggggccgggggactctaatcgttgtgtcaagcgctagtaccaagggaccatccgtctttccgcacgacctccgc

SEQ ID NO: 26647 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgagcggagccgtcaactttggctccccaaatttccgccagcgagtgtctctgacgcgtgatagagacttgtttaccgcgcacatggatatcaggggtttaacacaaggggacactgctacctacttctgtgcccggcagaaatttgaacgcggaggccagggctggattttcgatctgtgggggagaggaacactaatcgcagtttcgtcagccagcaccaagggtccgagtgtgtttccccatgacctcagg

SEQ ID NO: 26648 - RNA, 417 nt, synthetic construct
  misc_feature 1..417: note = derived and/or modified sequence opt3 from anti-HIV-1_HeavyChain
  source 1..417: mol_type = other RNA
cagagccacctggagcaatccggctctgccatgaagaaacccggggcttcagtgaccgtcagttgctggacaagcgaagacatcttcgatactacggagctcatttactgggttagacaggcacctggacagggtcttgaatggataggctgggtgaagatcgtatccgggaccgtgaactttgcctctctggacttcaggaatcggatttcgttgtcacgcgatcgagacttaagcacagcgcatatggatatccgtggactgactcaggacgataccgctacatatttttgtgccagacaaaaattcgcaagtaggtactccggcgaccagggttcttattttgatctatgggggcggggaaccctcattatcgtcagctccgcctcaactaagggcccaagtgacgatctgcgc

SEQ ID NO: 26649 - RNA, 414 nt, synthetic construct
  misc_feature 1..414: note = derived and/or modified sequence opt3 from anti-HIV-1_HeavyChain
  source 1..414: mol_type = other RNA
caggtgcaactggtccagagcggcgccgaggttaagaaacccggggcttccgtgaaggtatcttgcaaatcaagtggatacagcttcaccagatttgacatcacatgggtgaggcaggcacctggtcagggcctcgaatggattgggtgggtcaagactgtgtccggagccgttaacttcggctctcttaattttcggcaccgcgtgtcgctgacgcgagatcgtgacttgttcaccgcgcatatggatataagaggtttaacacaaggggacactgctacctatttttgtgccaggcagaaattcgcacggggagatcagggctggtttttcgacctgtggggccgcgggacactaatcgtcgtgtcaagcgccagtaccaagggaccatccgtatttccgcacgatctcaga

SEQ ID NO: 26650 - RNA, 420 nt, synthetic construct
  misc_feature 1..420: note = derived and/or modified sequence opt3 from anti-HIV-1_HeavyChain
  source 1..420: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagttttatgcaggaggccagggctggtacttcgacctgtgggggcggggaacactaattgttgtgtcaagcgccagtaccaaaggtccaatcggcctcccgccccgcctgtgcgtc

SEQ ID NO: 26651 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggcgctggggtgaagaaacccggagcatccgtcagagtttcttgctggacctcagaagacatcttcgagaggacagaactcattcattgggtgcggcaggcccctggtcagggccttgagtggatagggtgggtaaagactgtgacgggagcggtcaactttggcagtccaaatttccgccaccgagtgagcctgacccgtgatagagacttgtttacagctcatatggatatcaggggtttaactcagggggacaccgccacatacttctgtgcacggcaaaaatttgaacgcggaggccagggctggtatttcgatctgtgggggagaggaaccctaattgttgtgtcctctgcctcgactaagggtccgtcagtctttccccacgacctcagg

SEQ ID NO: 26652 - RNA, 420 nt, synthetic construct
  misc_feature 1..420: note = derived and/or modified sequence opt3 from anti-HIV-1_HeavyChain
  source 1..420: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgttcacggctcatatggacatcaggggtctaacccaggatgacacagccacttatttttgtgcacggcaaaaattcgcccgcggggatcagggatggtttttcgacctctggggcagaggcaccctgattgttgtgtcgtcagctagcacaaaggggcctagtggaccatccccggaaatctgcgtc

SEQ ID NO: 26653 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggcgctggggtgaagagacccggagcatccgtcagggtttcttgctggacctcagaagacatcttcgagacaactgaactcattcattgggtgcggcaggcccctggtcagggccttgagtggatagggtgggtaaaaacggtgagtggagcggtcaactttggcagcctgaatttccgccaccgagtgtccttgacccgtgatagagacttatttacagctcatatggatatcaggggtctgactcagggggacaccgccacatacttctgtgcacggcaaaagtttgcccgcggagatcagggctggttctttgacctatggggcagagggaccctcattgttgtgtcttcggcttcaactaaaggaccaagcgtcttcccgcacgatctgagg

SEQ ID NO: 26654 - RNA, 417 nt, synthetic construct
  misc_feature 1..417: note = derived and/or modified sequence opt3 from anti-HIV-1_HeavyChain
  source 1..417: mol_type = other RNA
agagcccacctggagcagagcggctccggggtgaagaaactcggagcttctgtcagggtttcatgctggaccagtgaagacatcttcgagcggacagaacttattcattgggtgcgccaagcacccggtcagggcctggagtggatagggtgggtaaaggccgtgagcggagcggctaactacggctcccctaattttcgacagcgtgtctctttgactagagatagggacttattcacggcccacatggatatccggggtctgacccagggggacacagcaacttatttttgtgcccgccaaaaattcgaaagaggaggccagggctggatttttgatctatgggggaggggaaccctcatcgctgtgtcgtcagcaagcacaaagggtccaagtgttttcccgcatgacctgcgg

SEQ ID NO: 26655 - RNA, 417 nt, synthetic construct
  misc_feature 1..417: note = derived and/or modified sequence opt3 from anti-HIV-1_HeavyChain
  source 1..417: mol_type = other RNA
caggtgcacctggagcaaagcggctccggggtcaagaaactcggagcctctgttagagtgtcatgctggaccagtgaagacatcttcgagaggacagaacttattcattgggtacggcaggctcccggtcagggcctggagtggatagggtgggtgaaggcagtcagcggagccgtgaactacggctccttggattttcgccaccgagtttctttaactcgtgacagagatctgttcacggcgcatatggacatcaggggtctaacccaggatgacacagctacttatttttgtgcccggcaaaaattcgcacgcggggatcagggatggtttttcgacctctggggcagaggcaccctgattgtggtctcgtcagccagcacaaaggggcctagtgtgtttccacacgatcttagg

SEQ ID NO: 26656 - RNA, 417 nt, synthetic construct
  misc_feature 1..417: note = derived and/or modified sequence opt3 from anti-HIV-1_HeavyChain
  source 1..417: mol_type = other RNA
agagcccacctggagcagagcggctccggggtgaagaaacccggagcttctgtcagggtttcatgctggaccagtgaagacatcttcgagcggacagaactcattcattgggtgcgccaagcacctggtcagggccttgagtggatagggtgggtaaagatcgtgagcggagccgtcaactttggctccccaaatttccgacagcgtgcgtctctgactagagatagggacttgtttacggctcacatggatattcggggtttaacccagggggacacagccacttacttctgtgcacgccaaaaatttgaaagaggaggccagggctggatcttcgatctgtgggggaggggaaccctaattgccgtgtcgtcagctagcacaaagggtccgagtgtttttcccaccatctatgtg

SEQ ID NO: 26657 - RNA, 414 nt, synthetic construct
  misc_feature 1..414: note = derived and/or modified sequence opt3 from anti-HIV-1_HeavyChain
  source 1..414: mol_type = other RNA
caggtgcaactggtccagagcgaggccgaagttaagaaacccggcgcttccgtgaagatctcttgcgcaacctcagggtacgccttcacactctattaccttcactgggtaagacaggcgcctggacagggtctggagtggattggctgggtgaaaactgtcacgggggctgtgaactttggaagtgcctatttcaggcatcgggttagcttgacccgcgaccgagatttatttacagcacacatggacatacgtggcctgactcaaggtgataccgccacatacttctgtgctagacagaagttttataaagggggacagggctggtacttcgacctatggggcagggggaccctcatcgtggtctcctctgcatcgactaagggaccatcagtgtttccgcatgatctgcgg

SEQ ID NO: 26658 - RNA, 420 nt, synthetic construct
  misc_feature 1..420: note = derived and/or modified sequence opt3 from anti-HIV-1_HeavyChain
  source 1..420: mol_type = other RNA
caggcccaccccgagcaaagcggctccggggtgaagaaacctggagcttctgtcagagtttcatgctggaccagtgaagacatcttcgagaggacagaactgattcattgggtgcggcaggcaccaggtcagggcctcgagtggatagggtgggtaaagatcgtgagcggagccgtcaactttggctccccgaatttccgccagcgagtgtctcttactcgtgatagagacctgtttacggcgcacatggatattaggggtttgacccaaggggacacagctacttacttctgtgcccggcagaaatttgaacgcggaggccagggctggatcttcgatttatgggggagaggaaccctgattgcagtttcgtcagccagcacaaagggtcccagtggcctacctccaaggctctgcgtg

SEQ ID NO: 26659 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgagcggagccgtcaactttggctccccaaatttccgccaccgagtgtctctgacgcgtgatagagacttgtttaccgcgcatatggatatcaggggtttaacacagggggacactgctacctacttctgtgcccggcaaaaatttgaacgcggaggccagggctggtatttcgatctgtgggggagaggaacactaattgttgtgtcgtcagcaagcaccaagggtccgagtgtctttccccctaggtccact

SEQ ID NO: 26660 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagagacccggagcttctgtcagggtttcatgctggaccagtgaagacatcttcgagaaaagcgaactcattcattgggtgcggcaggcacctggtcagggccttgagtggatagggtgggtaaagacagtgactggagccgtcaactttggctccccaaatttccgccaccgagtgtctctgacgcgtgatagagacttgtttaccgcgcatatggatatcaggggtttaacacagggggacactgctacctacttctgtgcccggcaaaaatttgaacgcggaggccagggctggtatttcgatctgtgggggagaggaacactaattgttgtgtcgtcagcaagcaccaagggtccgagtgtctttccccacgacctcagg

SEQ ID NO: 26661 - RNA, 417 nt, synthetic construct
  misc_feature 1..417: note = derived and/or modified sequence opt3 from anti-HIV-1_HeavyChain
  source 1..417: mol_type = other RNA
ggcgcccacctggagcagagcgggtccggagtgaagaaacccggtgcttctgtcagagtttcatgctggaccagtgaagacatcttcgaaaagagcgagctcattcattgggtgaggcaagcacctggccaggggcttgagtggataggatgggtaaaaacagtgactggcgccgtcaactttggttcctctgatttccggcagcgcgtgtcgctgacgcgagaccgtgatttgtttaccgcgcacatggacatcagagggttaacacagggagatactgctacctacttctgtgccaggcaaaagttttatgcaggcggccaggggtggtacttcgacctgtggggacggggtacactaattgttgtgtcaagcgccagtaccaaaggcccatccgtctttccgcatgatctccgc

SEQ ID NO: 26662 - RNA, 417 nt, synthetic construct
  misc_feature 1..417: note = derived and/or modified sequence opt3 from anti-HIV-1_HeavyChain
  source 1..417: mol_type = other RNA
agacacgacctggagcagagcggctccggggtgaagaaacccggagcctctgtcagggtttcatgctggaccagtgaagatatcttcgagcggacagaactcattcattgggtgcgccaagctcctggtcagggccttgagtggatagggtgggtaaagatcgtgagcggagcagtcaactttggctccccaaatttccgacagcgtgtgtctctgactagagacagggatttgtttacggcccacatggacattcggggtttaacccagggggatacagcgacttacttctgtgctcgccaaaaatttgaaagaggaggccagggctggatcttcgacctgtgggggaggggaaccctaattgccgtttcgtcagcaagcacaaagggtccgagtgtgtttccccatgatctccgg

SEQ ID NO: 26663 - RNA, 420 nt, synthetic construct
  misc_feature 1..420: note = derived and/or modified sequence opt3 from anti-HIV-1_HeavyChain
  source 1..420: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgtcaactttggctccctggatttccgccaccgaatctctttgacgcgtgacagagatttatttaccgcgcatatggacattaggggtctgacacagggggatactgctacctacttctgtgcccggcaaaaatttgaatcgcgctatacaggaggccagggctggtacttcgacctatgggggagaggaacccacatcgtggtttcaagcgcaagtactaagggtccatccgtgacaatttatgtc

SEQ ID NO: 26664 - RNA, 414 nt, synthetic construct
  misc_feature 1..414: note = derived and/or modified sequence opt3 from anti-HIV-1_HeavyChain
  source 1..414: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagttttatgcaggaggccagggctggtacttcgacctgtgggggcggggaacactaattgttgtgtcaagcgccagtccaggtccgatcggcccctcccctcgctctgct

SEQ ID NO: 26665 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcgcttccggcgtgaagagacccggggcatctgtcagggtttcatgctggaccagtgaagacatcttcgagcggacagaactcattcattgggtgcgccaggcccctggacagggtcttgagtggataggctgggtaaaaactgtgacgggggcggtcaactttggaagctccgatttccgacagcgtgtgtctctgaccagagacagggatttgtttacagctcacatggacatccggggcttaactcaaggtgataccgccacatacttctgtgcacgccagaagttttatgccgggggacagggctggtacttcgacctgtggggcagagggaccctaattgttgtgtcgtcagctagcactaaaggaccaagtgtctttccgcatgatctcagg

SEQ ID NO: 26666 - RNA, 417 nt, synthetic construct
  misc_feature 1..417: note = derived and/or modified sequence opt3 from anti-HIV-1_HeavyChain
  source 1..417: mol_type = other RNA
caggtgcaactggtccagagcggcgccgaggttaagaaacccggggcttccgtgagagtatcttgctggacctcagaagacatcttcgagaagagtgaactcattcactgggtgaggcaggcacctggacagggtcttgagtggataggctgggtcaaaacagtgactggggccgttaactttggaagctccgatttccggcaacgcgtgtctctgacgcgagaccgtgatttgtttaccgcgcatatggacatcagaggcttaacacagggtgatactgctacctacttctgtgccaggcagaagttttatgcagggggacagggctggtacttcgacctgtggggccgggggacactaattgtcgtgtcgtcagccagcaccaaaggaccaagtgtatttccgactatctatgtt

SEQ ID NO: 26667 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagcgcatagggtgggtaaagactgtgacgggagccgtcaactttggcagcccaaatttccgacaccgtgtgtccctgaccagagatagggacttgtttacagcgcatatggatatccggggtttaactcagggggacaccgctacatacttctgtgcccgccaaaaatttgaaagaggaggccagggctggtatttcgatctgtgggggaggggaaccctaattgttgtgtcttcggcatcaactaagggtccgagcgtctttcccacaatctgcgtg

SEQ ID NO: 26668 - RNA, 420 nt, synthetic construct
  misc_feature 1..420: note = derived and/or modified sequence opt3 from anti-HIV-1_HeavyChain
  source 1..420: mol_type = other RNA
cagagccacctggagcaatccggctctgccatgaagaaacccggggcttcagtgagagtcagttgctggaccagcgaagacatcttcgatacaactgagctcattcattgggttaggcaggcacctggacagggtcttgaatggataggctgggtgaagacggtatccggggccgtgaactttggatctctgaatttccggcaccgcgtctcgttgacccgagaccgtgatttatttacagcgcatatggacatcagaggcctgactcagggtgataccgctacatacttctgtgccaggcaaaaatttgcacgcggggaccagggatggttctttgatctatggggccggggcaccctcattgtggtttcaagcgccagtactaacgggccaatcggaccgtcccccacagacctgaga

SEQ ID NO: 26669 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaactcggagcttctgtcagagtttcatgctggaccagtgaagacatcttcgagaggacagaacttattcagtgggtgcggcaggcacccggtcagggcctggagtggatggggtgggtaaaggccgtgagcggagcggtcaactacggctccttggattttcgccatcgagtgtctttaactcgtgacagagatctgttcacggctcacatggacataaggggtctaacccaagatgacacagccacttatttttgtgcacggcagaaattcgcccgcggggatcagggatggtttttcgacctctggggcagaggcaccctgatcgttgtgtcgtcagctagcacaaaggggcctagtgtctttccacatgatcttagg

SEQ ID NO: 26670 - RNA, 417 nt, synthetic construct
  misc_feature 1..417: note = derived and/or modified sequence opt3 from anti-HIV-1_HeavyChain
  source 1..417: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaaggccgtatccggggcggtgaactatggatctctggactttcggcatcgcgtctcgttgacgcgagatcgtgacttatcaaccgctcacatggatatcagaggcctgacacaggacgatactgccacctacttctgtgcaaggcaaaaatttgcccggggtgaccaggggtggttctttgatctatggggacgcggcacactcattgtggttagcagtgcttccaccaagggcccatctgtgttcccgcatgacctgaga

SEQ ID NO: 26671 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgtcgacggctcatatggacatcaggggtctaacccaggatgacacagccacttatttctgtgcacggcaaaaatttgcccgcggggatcagggatggttctttgacctctggggcagaggcaccctgattgttgtgtcaagcgctagtacaaaggggccttccgtcttcccaaccatctacgtg

SEQ ID NO: 26672 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtttacagcgcatatggatatcaggggtttaactcagggggacaccgctacatacttctgtgcccggcaaaaatttgaacgcggaggccagggctggtatttcgatctgtgggggagaggaaccctaattgttgtgtcttcggcatcaactaagggtccgagcgtctttccccacgaccctagg

SEQ ID NO: 26673 - RNA, 423 nt, synthetic construct
  misc_feature 1..423: note = derived and/or modified sequence opt3 from anti-HIV-1_HeavyChain
  source 1..423: mol_type = other RNA
caggtgtacatggagcaagccggcgctgggatgaagaaacccggagcaagcatgaccgtctcctgcaagacagccgacgaagatatcttcgacgcggcttatatgcactgggttagacaggcccctggtcagacttttgagtggctgggctggatgaaaccagtgacgggggcagtaaactacgccaggcagttccaaggacgggtgtctttttatcgcacccgagaactcggcattgcttacatggatcttcgtgacctgaagttcgatgacacagcagtctatttttgtgccagaaaaactaagggtgatgtgtcaggggacgataggggattctttttcgacttgtggggccggggcacccgcgttatagtgagtagcgcttccacaaaggggccgtctgtctttccccatgatttaaga

SEQ ID NO: 26674 - RNA, 423 nt, synthetic construct
  misc_feature 1..423: note = derived and/or modified sequence opt3 from anti-HIV-1_HeavyChain
  source 1..423: mol_type = other RNA
caggtgtacatggagcaagccggcgggggaatgaagaaacccggtgctagcatgaccgtctcctgcaagacagcagacgaagatatcttcgacgccgcgtatatgcactgggttagacaggctaggggccagacttttgagtggctggggtggatgaaacctgtgacgggagccgtaaactacgcacggcagttccaaggccgcgtgtctttttatcgaacccgtgaactcggtattgcctacatggatcttagagacctgaagttcgatgacacagctgtctatttttgtgcaaggaaaactaagggggatgtgtcaggagacgatcggggcttctttttcgacttgtggggccgcgggaccagagttatagtgagtagcgcctccacaaagggaccatctgtctttccgaccatctacgtg

SEQ ID NO: 26675 - RNA, 423 nt, synthetic construct
  misc_feature 1..423: note = derived and/or modified sequence opt3 from anti-HIV-1_HeavyChain
  source 1..423: mol_type = other RNA
caggtgtacatggagcaagccggcgctggggtcaagaaacccggagcaagcgttaccctgtcctgcaagacagccgacgaagatgtgttcgacgcggcttatatgcactgggtaagacaggcccctggtcagacttttgagtggctcggctggatgaaaccagtgacgggggcagtctcttacgccaggaagttccagggacgggtgtcattttatatgacccgcgaacttggcatggcttacatggatctgcgaaacttgcgtttcgacgatacagcagtttatttttgtgccagaaaaactgctggtgacgtgagtggggataataggggatacttctttgacttatggggccggggcagccgcgtcatcgtgtcctctgcctcgaccaaggggccgtcagtattccccacaatttatgtt

SEQ ID NO: 26676 - RNA, 423 nt, synthetic construct
  misc_feature 1..423: note = derived and/or modified sequence opt3 from anti-HIV-1_HeavyChain
  source 1..423: mol_type = other RNA
caggtgtacagcggcgccgggagaggaggtgtcaagaaacccggcgcttccgttaccctgtcttgcaagacagcagacgaggatgtgttcgacgccgcgtatatgcactgggtaaggcaagctcctgggcagacttttgaatggctcggatggatgaaaccagtgacgggcgccgtcaactacgcacggaagttccagggtcgcgtgtcattttatcgaacccgtgagcttgggatcgcctacatggatctgagaaatttgaggttcgacgatacagctgtttatttttgtgcacggaaaactgccggagacgtgagtggcgataagcgcggcttctttttcgacttatgggggagaggaagcagggtcattgtgtcctctgcttcgaccaagggtccgtcagtatttcccacaatatacgtt

SEQ ID NO: 26677 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgagcggagccgtcaactttggctccccaaatttccgccaccgagtgtctctgacgcgtgatagagacttgtttaccgcgcatatggatatcaggggtttaacacagggggacactgctacctacttctgtgcccggcaaaaatttgaacgcggaggccagggctggtatttcgatctgtgggggagaggaacactaattgttgtgtcgtcagcatttaccaagggtccgagcgtcttcccccacgacctcagg

SEQ ID NO: 26678 - RNA, 414 nt, synthetic construct
  misc_feature 1..414: note = derived and/or modified sequence opt3 from anti-HIV-1_HeavyChain
  source 1..414: mol_type = other RNA
caggtgcaactgggccagagcggggccgagatgaagaaacccggatcctctgtcaaggtttcatgcaaagctagtggtggcaccttcagacacagccctatctcctgggtgaggcaggcaccagggcagggactcgaatggattggctgggtaaaggccgtgtctggtgcggtcaactacgggtcgcttgactttcggcatcgcgtgtcactgacacgagatcgtgacttgagcactgctcacatggatataagaggattaacgcaagacgataccgccacatatttctgtgcaaggcagaaatttgcccggggcgaccagggctggttctttgatctgtgggggcgcggaactctaatcgttgtgagttccgcttctaccaagggtccgagcgtcttcccccatgacctcaga

SEQ ID NO: 26679 - RNA, 417 nt, synthetic construct
  misc_feature 1..417: note = derived and/or modified sequence opt3 from anti-HIV-1_HeavyChain
  source 1..417: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagacggtaaccggggccgtgaactttggatccccaaatttccggcatcgcgtctctctgacacgagaccgtgatttgtttactgcgcacatggacatcagaggcttaacccagggtgatacagctacctatttctgtgccaggcaaaaatttgagcgcgggggacagggctggtacttcgacctgtggggccgggggactctaattgtggtttcgtcagcaagcacaaagggaccgagtgtgtttccccatgatctcaga

SEQ ID NO: 26680 - RNA, 423 nt, synthetic construct
  misc_feature 1..423: note = derived and/or modified sequence opt3 from anti-HIV-1_HeavyChain
  source 1..423: mol_type = other RNA
caggtgtacatggagcaagccggcgctggggtcaagaaacccggagcaagcgttaccctgtcctgcaagacagccgacgaagatgtgttcgacgcggcttatatgcactgggtaagacaggcccctggtcagacttttgagtggctcggctggatgaaaccagtgacgggggcagtctcttacgccaggaagttccagggacgggtgtcattttatatgacccgcgaacttggcatggcttacatggatctgcgaaacttgcgtttcgacgatacagcagtttatttttgtgccagaaaaactgctggtgacgtgagtggggataataggggatacttctttgacttatggggccggggcagctgggtcatcgtgtcctctgcctcgaccaaggggccgtcagtattcccccatgatctgcgc

SEQ ID NO: 26681 - RNA, 423 nt, synthetic construct
  misc_feature 1..423: note = derived and/or modified sequence opt3 from anti-HIV-1_HeavyChain
  source 1..423: mol_type = other RNA
caggtgtacatggagcaagccggcgggggagtcaagaaacccggtgctagcgttaccctgtcctgcaagacagcagacgaagatgtgttcgacgccgcgtatatgcactgggtaagacaggctcctggccagacttttgagtggctcgggtggatgaaaccagtgacgggagccgtcaactacgcaaggaagttccagggccgggtgtctttttatcgcacccgagaacttggtatcgcctacatggatctgcgtaatttgagattcgacgatacagctgtttatttttgtgcaaggaaaactgccggggacgtgtcaggagataagcggggcttctttttcgacttatggggccgcgggagtagagtcattgtgagctccgcttctaccaagggaccgtcggtatttcccacaatatgcgtt

SEQ ID NO: 26682 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcgcggcctggagtggatagggtgggtaaaggccgtgagcggagcggtcaactacggctccttggattttcgacaccgtgtgtctttaactagagacagggatctgttcacggctcatatggacatccggggtctaacccaggatgacacagccacttatttttgtgcacgccagaaattcgccagaggggatcaaggatggtttttcgacctctggggcaggggcaccctgattgttgtgtcgtcagctagcacaaaggggcctagtgtctttccacacgatcttcgg

SEQ ID NO: 26683 - RNA, 423 nt, synthetic construct
  misc_feature 1..423: note = derived and/or modified sequence opt3 from anti-HIV-1_HeavyChain
  source 1..423: mol_type = other RNA
caggtgtacatggagcaagccggcgggggagtcaagaaacccggtgctagcgttaccctgtcctgcaagacagcagacgaagatgtgttcgacgccgcgtatatgcactgggtaagacaggctcctggccagacttttgagtggctcgggtggatgaaaccagtgacgggagccgtcaactacgcaaggaagttccagggccgggtgtctttttatcgcacccgagaacttggtatcgcctacatggatctgcgtaatttgagattcgacgatacagctgtttatttttgtgcaaggaaaactgccggggacgtgtcaggagataagcggggcttctttttcgacttatggggccgcgggagtagagtcattgtgagctccgcttctaccaagggaccgtcggtatttcccacaatatacgtt

SEQ ID NO: 26684 - RNA, 423 nt, synthetic construct
  misc_feature 1..423: note = derived and/or modified sequence opt3 from anti-HIV-1_HeavyChain
  source 1..423: mol_type = other RNA
caggtgttcatggagcaagccggcgctgggatgaagaaacccggagcaagcatgaccgtctcctgcaagacagccgacgaagatgtttttgacgcggcttacatgcactgggtgagacaggcccctggtcagactttcgagtggctgggctggatgaaaccagtaacgggggcagtgaactatgccaggaagtttcagggacgggtctctttctaccgcacccgagaactcggcatcgcttatatggatcttcgtaatctgagatttgacgatacagcagtgtacttctgtgccaggaaaactgctggtgacgtttcaggggataagcggggatttttctttgacttgtggggccgcggcagtagagtgattgtcagctccgcctctaccaaggggccgtcggtgttcccccatgatttaagg

SEQ ID NO: 26685 - RNA, 423 nt, synthetic construct
  misc_feature 1..423: note = derived and/or modified sequence opt3 from anti-HIV-1_HeavyChain
  source 1..423: mol_type = other RNA
caggtgtacatggagcaagccggcgctggggtcaagaaacccggagcaagcgttaccctgtcctgcaagacagccgacgaagatgtgttcgacgcggcttatatgcactgggtaagacaggcccctggtcagacttttgagtggctcggctggatgaaaccagtgacgggggcagtcaactacgccaggaagttccagggacgggtgtctttttatcgcacccgagaacttggcatcgcttacatggatctgcgtaatttgagattagacgatacagcagtttatttctgtgccaggaaaactgctggtgacgtgtcaggggataagcggggatttttctttgacctgtggggccgcggcagtagagtcattgtgagctccgcctctaccaaggggccgtcggtattcccccatgatctaagg

SEQ ID NO: 26686 - RNA, 420 nt, synthetic construct
  misc_feature 1..420: note = derived and/or modified sequence opt3 from anti-HIV-1_HeavyChain
  source 1..420: mol_type = other RNA
cagagccacctggagcaatccggctctgccatgaagaaacccggggcttcagtgagagtcagttgctggaccagcgaagacatcttcgagaggacagaactcatttactgggttcggcaggcacctggacgcggtcttgagtggataggctgggtgaagactgtatccgggacggtgaactttggatcttcggatttccgaaatcgtatctcactgaccagagacagggatttgagcacagcccatatggacattcggggcttaactcaggatgacaccgcgacatatttttgtgctcgccagaaattcgaaagtctgtactccgatgaccaaggttcttattttgatctatgggggagaggaaccctcatcattgtcagctccgcctcaactaagggcccaagtgtgttcccgacaatc

SEQ ID NO: 26687 - RNA, 423 nt, synthetic construct
  misc_feature 1..423: note = derived and/or modified sequence opt3 from anti-HIV-1_HeavyChain
  source 1..423: mol_type = other RNA
caggtgtacatggagcaagccggcgggggagtcaagaaacccggtgctagcgttaccctgtcctgcaagacagcagacgaagatgtgttcgacgccgcgtatatgcactgggtaagacaggctcctggccagacttttgagtggctcgggtggatgaaaccagtgacgggagccgtctcttacgcaaggaagttccagggccgggtgtcattttatatgacccgcgaacttggtatggcctacatggatctgcgaaacttgcgtttcgacgatacagctgtttatttttgtgcaagaaaaactgccggggacgtgagtggagataataggggctacttctttgacttatggggccgggggagccgcgtcatcgtgtcctctgcttcgaccaagggaccgtcagtattccccacaatttgcgtt

SEQ ID NO: 26688 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagtattacgcaggaggccagggctggtattttgacctgtgggggcggggaacactaattgttgtgtcaagcgccagtaccaaaggtccatccgtcttcccgcatgatctccgc

SEQ ID NO: 26689 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgtcaactttggctccctggatttccgccaccgaatctctttgacgcgtgacagagatttatttaccgcgcatatggacattaggggtctgacacagggggatactgctacctacttctgtgcccggcaaaaatttgaatcgcgctatacaggaggccagggctggtacttcgacctatgggggagaggaacccacatcgtggtttcaagcgcaagtactaagggtccatccgtgtttccgcatgatctcagg

SEQ ID NO: 26690 - RNA, 423 nt, synthetic construct
  misc_feature 1..423: note = derived and/or modified sequence opt3 from anti-HIV-1_HeavyChain
  source 1..423: mol_type = other RNA
caggtgtacatgggcgccgggagaggaggtgtcaagaaacccggcgctagcgttaccctgtcctgcaagacagcagacgaggatgtgttcgacgccgcgtatatgcactgggtaaggcaagctcctgggcagacttttgaatggctcggatggatgaaaccagtgacgggcgccgtcaactacgcacggaagttccagggtcgcgtgtctttttatcgaacccgtgagcttgggatcgcctacatggatctgagaaatttgaggttcgacgatacagctgtttatttttgtgcacggaaaactgccggagacgtgtcaggcgataagcgcggcttctttttcgacttatgggggagaggaagtagggtcattgtgagctccgcttctaccaagggtccgtcggtatttcccacaatatacgtt

SEQ ID NO: 26691 - RNA, 423 nt, synthetic construct
  misc_feature 1..423: note = derived and/or modified sequence opt3 from anti-HIV-1_HeavyChain
  source 1..423: mol_type = other RNA
caggtgtacatggagcaagccggcgggggaatgaagaaacccggtgctagcatgaccgtctcctgcaagacagcagacgaagatatcttcgacgccgcgtatatgcactgggttagacaggctcctggccagacttttgagtggctggggtggatgaaaccagtgacgggagccgtaaactacgcaaggcagttccaaggccgggtgtctttttatcgcacccgagaactcggtattgcctacatggatcttcgtgacctgaagttcgatgacacagctgtctatttttgtgcaagaaaaactaagggggatgtgtcaggagacgataggggcttctttttcgacttgtggggccgggggacccgcgttatagtgagtagcgcctccacaaagggaccgtctgtctttcccaccatctgcgtg

SEQ ID NO: 26692 - RNA, 423 nt, synthetic construct
  misc_feature 1..423: note = derived and/or modified sequence opt3 from anti-HIV-1_HeavyChain
  source 1..423: mol_type = other RNA
caggtgtacatggagcaagccggcgggggaatgaagaaacccggtgctagcatgaccgtctcctgcaagacagcagacgaagatatcttcgacgccgcgtatatgcactgggttagacaggctcctggccagacttttgagtggctggggtggatgaaaccagtgacgggagccgtaaactacgcaaggcagttccaaggccgggtgtctttttatcgcacccgagaactcggtattgcctacatggatcttcgtgacctgaagttcgatgacacagctgtctatttttgtgcaagaaaaactaagggggatgtgtcaggagacgataggggcttctttttcgacttgtggggccgggggacccgcgttatagtgagtagcgcctccacaaagggaccgtctgtctttccccatgatttaaga

SEQ ID NO: 26693 - RNA, 423 nt, synthetic construct
  misc_feature 1..423: note = derived and/or modified sequence opt3 from anti-HIV-1_HeavyChain
  source 1..423: mol_type = other RNA
caggtgtacatggagcaagccggcgctggggtcaagaaacccggagcaagcgttaccctgtcctgcaagacagccgacgaagatgtgttcgacgcggcttatatgcactgggtaagacaggcccctggtcagacttttgagtggctcggctggatgaaaccagtgacgggggcagtcaactacgccaggaagttccagggaaaagtgtctttttatcggacccgcgaacttggcatcgcttacatggatctgcgaaatttgcgtttcgacgatacagcagtttatttttgtgccagaaagactgctggtgacgtgtcaggggataagaggggattctttttcgacttatggggccggggcagtcgcgtcattgtgagctccgcctctaccaaagggccgtcggtatttccccatgatctgaga

SEQ ID NO: 26694 - RNA, 423 nt, synthetic construct
  misc_feature 1..423: note = derived and/or modified sequence opt3 from anti-HIV-1_HeavyChain
  source 1..423: mol_type = other RNA
caggtgtacatggagcaagccggcgctggggtcaagaaacccggagcaagcgttaccctgtcctgcaagacagccgacgaagatgtgttcgacgcggcttatatgcactgggtaagacaggcccctggtcagacttttgagtggctcggctggatgaaaccagtgacgggggcagtcaactacgccaggaagttccagtctcgggtgtcattttatggaacccgcgaacttggcatcgcttacatggatctgcgaaatttgcgtttcgacgatacagcagtttatttttgtgccagaaaaactgctggtgacgtgagtggggataagaggggattctttttcgacttatggggccggggcagccgcgtcattgtgtcctctgcctcgaccaaggggccgtcagtatttccccatgatctgaga

SEQ ID NO: 26695 - RNA, 420 nt, synthetic construct
  misc_feature 1..420: note = derived and/or modified sequence opt3 from anti-HIV-1_HeavyChain
  source 1..420: mol_type = other RNA
cagggccacaccgtggagcaaagcgggtccggagtcaagaaactgggtgcctctgttagagtgtcatgctggacaagtgaagacatcttcgagactacggaactcattcattgggtaaggcaggctcccggccaggggcttgagtggataggatgggtgaagaccgtcagcggcgcagtgaactttggttccctgaatttccggcaccgcgtttctttgacacgagatcgtgacttatttactgcccatatggatatcagagggctgacccagggagacacagcgacctacttctgtgctaggcaaaaatttgcccggggcgatcagggctggttctttgacctatgggggcgcggaactctcattgtggtctcgtcagcaagcacaaagggtcctagtgtgttcccacacgatctgaga

SEQ ID NO: 26696 - RNA, 420 nt, synthetic construct
  misc_feature 1..420: note = derived and/or modified sequence opt3 from anti-HIV-1_HeavyChain
  source 1..420: mol_type = other RNA
caggccaccccctggagcaacctgggcagaggggtgaagaaactcggagcttccgtcagggtttcttgctggacatcagaggacatcttcgaacggactgagcttattcactgggtgcgccaagcacctggtcagggcctggaatggatagggtgggtaaagacggtgaccggagccgtcaattttggcagtccaaacttccgacatcgtgtgagcttgacaagagatagggacttatttactgcgcacatggatatccggggtctgacccagggggacacagctacctacttctgtgcccgccagaaatttgagagaggaggccaaggctggtatttcgatctatgggggaggggaactctcattgttgtgtcctctgcatcgacaaagggtccgtcagtctttccccatgacctgcgg

SEQ ID NO: 26697 - RNA, 423 nt, synthetic construct
  misc_feature 1..423: note = derived and/or modified sequence opt3 from anti-HIV-1_HeavyChain
  source 1..423: mol_type = other RNA
caggtgttcatggagcaagccggcgctgggatgaagaaacccggagcaagcatgaccgtctcctgcaagacagccgacgaagatgtttttgacgcggcttatatgcactgggtgagacaggcccctggtcagactttcgagtggctgggctggatgaaaccagtaacgggggcagtgtcttatgccaggaagtttcagggacgggtctcattctacatgacccgcgaactcggcatggcttatatggatcttcgaaacctgcgttttgacgatacagcagtgtacttctgtgccagaaaaactgctggtgacgttagtggggataataggggatactttttcgacttgtggggccggggcagccgcgtgatcgtctcctctgcctcgaccaaggggccgtcagtgtttccccatgatttaaga

SEQ ID NO: 26698 - RNA, 423 nt, synthetic construct
  misc_feature 1..423: note = derived and/or modified sequence opt3 from anti-HIV-1_HeavyChain
  source 1..423: mol_type = other RNA
caggtgtacatggagcaaagcggcgggggagtcaagaaacccggtgcctccgttaccctgtcttgcaagacagctgacgaagatgtgttcgacgcagcctatatgcactgggtaagacaggcgcctggccagacttttgagtggctcgggtggatgaaaccagtgacgggagctgtctcatacgccaggaagttccagggccgggtgagtttttatcgcacccgagaacttggtatcgcatacatggatctgcgtaacttgagattcgacgatacagccgtttatttttgtgctaggaaaactgcaggggacgtgagcggagataagcggggcttctttttcgacttatggggccgcgggtccagagtcattgtgtcttcggcctcaaccaagggaccgagcgtatttccccatgatctgagg

SEQ ID NO: 26699 - RNA, 423 nt, synthetic construct
  misc_feature 1..423: note = derived and/or modified sequence opt3 from anti-HIV-1_HeavyChain
  source 1..423: mol_type = other RNA
caggtgtacatggagagaggcaggggaggggtcaagaaacccggtgccagcgttaccctgtcctgcaagacagctgacgaagatgtgttcgacgcagcctatatgcactgggtacggcaagcgcctggccagacttttgagtggctcgggtggatgaaaccagtgacgggagctgtcaactacgcccgcaagttccagggccgagtgtctttttatcgtaccagagaacttggtatcgcatacatggatctgaggaatttgcggttcgacgatacagccgtttatttttgtgctcgcaaaactgcaggggacgtgtcaggagataagagaggcttctttttcgacttatggggcagggggagtcgggtcattgtgagctccgcctctaccaagggaccgtcggtatttccccatgatctgcgc

SEQ ID NO: 26700 - RNA, 423 nt, synthetic construct
  misc_feature 1..423: note = derived and/or modified sequence opt3 from anti-HIV-1_HeavyChain
  source 1..423: mol_type = other RNA
caggtgtacatggagcaagccggcgggggagtcaagaaacccggtgctagcgttaccctgtcctgcaagacagcagacgaagatgtgttcgacgccgcgtatatgcactgggtaagacaggctcctggccagacttttgagtggctcgggtggatgaaaccagtgacgggagccgtctcttacgcaaggcggttccagggccgcgtgtcattttatatgacccgagaacttggtatggcctacatggatctgcgtaacttgagattcgacgatacagctgtttatttttgtgcaaggaagactgccggggacgtgagtggagataatcggggctacttctttgacttatggggccgcgggagcagagtcatcgtgtcctctgcttcgaccaaaggaccgtcagtattccccacaatttgcgtt

SEQ ID NO: 26701 - RNA, 423 nt, synthetic construct
  misc_feature 1..423: note = derived and/or modified sequence opt3 from anti-HIV-1_HeavyChain
  source 1..423: mol_type = other RNA
caggtgtacatggagcaagccggcgggggagtcaagaaacccggtgctagcgttaccctgtcctgcaagacagcagacgaagatgtgttcgacgccgcgtatatgcactgggtaagacaggctcctggccagacttttgagtggctcgggtggatgaaaccagtgacgggagccgtctcttacgcaaggaagttccagggccgggtgtcattttatatgacccgcgaacttggtatggcctacatggatctgcgaaacttgcgtttcgacgatacagctgtttatttttgtgcaagaaaaactgccggggacgtgagtggagataataggggctacttctttgacttatggggccgggggagccgcgtcatcgtgtcctctgcttcgaccaagggaccgtcagtattcccccatgatctgaga

SEQ ID NO: 26702 - RNA, 423 nt, synthetic construct
  misc_feature 1..423: note = derived and/or modified sequence opt3 from anti-HIV-1_HeavyChain
  source 1..423: mol_type = other RNA
caggtgttcatggagcaagccggcgggggaatgaagaaacccggtgctagcatgaccgtctcctgcaagacagcagacgaagatatctttgacgccgcgtacatgcactgggttagacaggctcctggccagactttcgagtggctggggtggatgaaaccagtgacgggagccgtaaactatgcaaggcagtttcaaggccgggtgtctttctaccgcacccgagaactcggtattgcctatatggatcttcgtgacctgaagtttgatgacacagctgtctacttctgtgcaagaaaaactaagggggatgtgtcaggagacgataggggctttttctttgacttgtggggccgggggacccgcgttatagtgagtagcgcctccacaaagggaccgtctgtcttcccccatgatttaaga

SEQ ID NO: 26703 - RNA, 423 nt, synthetic construct
  misc_feature 1..423: note = derived and/or modified sequence opt3 from anti-HIV-1_HeavyChain
  source 1..423: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcctggatttccgccaccgaatctccttgacccgtgacagagatttatttacagcgcatatggacattaggggtctgactcagggggataccgctacatacttctgtgcccggcaaaaatttgcatctcgctattcgggagaccagggctcatacttcgatctatggggcagagggaccctcatcgtggttagcagtgcctccactaagggaccatctgtgtttccgcacgacctg

SEQ ID NO: 26704 - RNA, 423 nt, synthetic construct
  misc_feature 1..423: note = derived and/or modified sequence opt3 from anti-HIV-1_HeavyChain
  source 1..423: mol_type = other RNA
caggtgttcatggagcaagccggcgctgggatgaagaaacccggagcaagcatgaccgtctcctgcaagacagccgacgaagatgtttttgacgcggcttacatgcactgggtgagacaggcccctggtccagatctggagtggctcggctggatgaaaccggtaactggggcagtgaactatgccaggaagttccagggacgggtctctttttaccgcacgcgagaacttggcatcgcttatatggacctgcgtgatttgagattcgacgataccgcagtgtacttttgtgccaggaaaacagctggtgacgtttcaggggataagcggggattctttttcgacttatggggccgcggcagtagagtgattgtcagctccgcctctactaaggcgcataggtcgtcacccaccatatgcgtg

SEQ ID NO: 26705 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgaatctccctgacccgtgatagagacttgtttacagcgcatatggatattaggggtttaactcagggggacaccgctacatacttctgtgcccggcaaaaatttgaatctcgctataccggaggccagggctggtacttcgatctgtgggggagaggaactcacatcgtggtttcgtcagcaagcacaaagggtccgagtgtgtttccccatgacctaagg

SEQ ID NO: 26706 - RNA, 423 nt, synthetic construct
  misc_feature 1..423: note = derived and/or modified sequence opt3 from anti-HIV-1_HeavyChain
  source 1..423: mol_type = other RNA
caggtgtacatggagcaagccggcgggggagtcaagaaacccggtgctagcgttaccctgtcctgcaagacagcagacgaagatgtgttcgacgccgcgtatatgcactgggtaagacaggctcctggccagacttttgagtggctcgggtggatgaaaccagtgacgggagccgtctcttacgcaaggaagttccagggccgggtgtcattttatatgacccgcgaacttggtatggcctacatggatctgcgaaacttgcgtttcaatgacacagctgtttatttttgtgcaagaaaaactgccggggatgtgagtggagacaacaggggctacttctttgatttatggggccgggggagccgcgtcatcgtgtcctctgcttcgaccaagggaccgtcagtattcccccatgacctgaga

SEQ ID NO: 26707 - RNA, 423 nt, synthetic construct
  misc_feature 1..423: note = derived and/or modified sequence opt3 from anti-HIV-1_HeavyChain
  source 1..423: mol_type = other RNA
caggtgtacatggagcaagccggcgggggagtcaagaaacccggtgctagcgttaccctgtcctgcaagacagcagacgaagatgtgttcgacgccgcgtatatgcactgggtaagacaggctcctggccagacttttgagtggctcgggtggatgaaaccagtgacgggagccgtcaactacgcaaggaagttccagggccgggtgtctttttatcgcacccgagaacttggtatcgcctacatggatctgcgtaatttgagattcgacgatacagctgtttatttttgtgcaaggaaaactgccggggacgtgtcaggagataaccggggctacttctttgacttatggggccgcgggagtagagtcattgtgagctccgcttctaccaagggaccgtcgggtctgccccatgatctaagg

SEQ ID NO: 26708 - RNA, 423 nt, synthetic construct
  misc_feature 1..423: note = derived and/or modified sequence opt3 from anti-HIV-1_HeavyChain
  source 1..423: mol_type = other RNA
caggtgtacatggagcaagccggcgggggagtcaagaaacccggtgctagcgttaccctgtcctgcaagacagcagacgaagatgtgttcgacgccgcgtatatgcactgggtaagacaggctcctggccagacttttgagtggctcgggtggatgaaaccagtgacgggagccgtcaactacgcaaggaagttccagggccgggtgtctttttatcgcacccgagaacttggtatcgcctacatggatctgcgtaatttgagattcgacgggacagctgtttatttttgtgcaaggaaaactgccggagatgtgtcaggcgacaagcggggcttctttttcgatttatgggggcgcggaagtagagtcattgtgagctccgcttctaccaagggtccgtcggtatttccccatgacctgagg

SEQ ID NO: 26709 - RNA, 423 nt, synthetic construct
  misc_feature 1..423: note = derived and/or modified sequence opt3 from anti-HIV-1_HeavyChain
  source 1..423: mol_type = other RNA
caggtgtacatggagcaagccggcgggggagtcaagaaacccggtgctagcgttaccctgtcctgcaagacagcagacgaagatgtgttcgacgccgcgtatatgcactgggtaagacaggctcctggccagacttttgagtggctcgggtggatgaaaccagtgacgggagccgtcaactacgcaaggaagttccagggccgggtgtctttttatcgcacccgagaacttggtatcgcctacatggatctgcgtaatttgagattcgacgatacagctgtttatttttgtgcaaggaaaactgccggggacgtgtcaggagataagcggggcttctttttcgacttatggggccgcgggagtagagtcattgtgagctccgcttctaccaagggaccgtcggtatttccccatgatctgagg

SEQ ID NO: 26710 - RNA, 423 nt, synthetic construct
  misc_feature 1..423: note = derived and/or modified sequence opt3 from anti-HIV-1_HeavyChain
  source 1..423: mol_type = other RNA
caggtgcaactggtccagagcggcgccgaggttaagaaacccggggcttccctcaaggtgtcttgcaaagcatcaggatacaccttcacagactattacatccactgggtaagacaggcccctggtcagggccttgaatggattgggtgggtgaagatagtcagtggaactgtgaactttgcgagcctggatttcaggaatcggatctccttgtctcgcgaccgagatttatcgacggcttatatggacattcgtggcctgacccaagatgacacagccacttacttttgtgcaagacagaaattcgcctcaaggtatagcggtgatcaggggagttactttgacctatggggacggggcaccctcatcgttgtgtcctctgctagcacaaagggcccatccgtcttcccgcatgatctgcgc

SEQ ID NO: 26711 - RNA, 423 nt, synthetic construct
  misc_feature 1..423: note = derived and/or modified sequence opt3 from anti-HIV-1_HeavyChain
  source 1..423: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgtcaactttggctccctggatttccgccaccgaatctctttgacgcgtgacagagatttatttaccgcgcatatggacattaggggtctgacacagggggatactgctacctacttctgtgcccggcaaaaatttgaatcgcgctatacaggaggccagggctggtacttcgacctatgggggagaggaaccctcatcgtggtttcaagcgcaagtactagggcccaccggtccccacatgatctgcgc

SEQ ID NO: 26712 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccagcgagtgtccctgacccgtgatagagacttgtttacagcgcacatggatatcaggggtttaactcaaggggacaccgctacatacttctgtgcccggcagaaatttgaatctcgctataccggaggccagggctggtacttcgatctgtgggggagaggaactcatattgttgtgtcgtcagcaagcacaaagggtccgagtgtctttccccacgacctaagg

SEQ ID NO: 26713 - RNA, 426 nt, synthetic construct
  misc_feature 1..426: note = derived and/or modified sequence opt3 from anti-HIV-1_HeavyChain
  source 1..426: mol_type = other RNA
caggtgcaactggtccagagcggcgccgaggttaagaaacccggggcttccgtgagagtatcttgctggacctcagaagacatcttcgatacaactgagctcatttactgggtgaggcaggcacctggacagggtcttgaatggataggctgggtcaagatcgtgagtgggacggttaactttgccagcctggacttccggaatcgcatttccttgtctcgagatcgtgacttatcgaccgcgtatatggatatcagaggactgacacaagacgatactgctacctacttttgtgccaggcagaaattcgcatcacggtatagcggcgaccagggtagttactttgatctatgggggcgcggaacactcattgtggtctcctctgccagcaccaagggcccatccgtgttcccgcagatctgcgta

SEQ ID NO: 26714 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgccatgaagaaacccggggcttcagtgagagtcagttgctggaccagcgaagacatcttcgagaggacagaactcatttactgggttcggcaggcacctggacgcggtcttgagtggataggctggatgaagactgtgtccgggacggtaaactttggatcttcggatttccgaaatcgtatctcactgaccagagacagggatttgagcacagcccatatggacattcggggcttaactcaggatgacaccgcgacatatttttgtgctcgccagaaattcgaaagtctgtactccgatgaccaaggttcttattttgatctatgggggagaggaaccctcatcattgtgagctccgcctcaactaaggcacacaggagtagcccaacaaccctgcgg

SEQ ID NO: 26715 - RNA, 423 nt, synthetic construct
  misc_feature 1..423: note = derived and/or modified sequence opt3 from anti-HIV-1_HeavyChain
  source 1..423: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgcatatggatatcagaggactgacacaggacgatactgctacctatttttgtgccaggcaaaaattcgcaagtcggtactccggcgaccagggttcttattttgatctatgggggcgcggaacactcattatcgtcagctccgcctcaaccaagggcccaagtgtgttcccgagaagcgct

SEQ ID NO: 26716 - RNA, 423 nt, synthetic construct
  misc_feature 1..423: note = derived and/or modified sequence opt3 from anti-HIV-1_HeavyChain
  source 1..423: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggccaccagatctccgatcgggtgtctctgtcgcgcgaccgagatttgtcaacggcgtacatggacattcgtggtttaacccaagatgacacagctacttatttctgtgccagacagaagtttgcaagcaggtacagtggggatcagggatcctatttcgacctgtggggccggggcaccctaatcgttgtgtctagcgcctccacaaaagggccatcagtctttccgcatgatctccgc

SEQ ID NO: 26717 - RNA, 423 nt, synthetic construct
  misc_feature 1..423: note = derived and/or modified sequence opt3 from anti-HIV-1_HeavyChain
  source 1..423: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgcatatggatatcagaggactgacacaggacgatactgctacctatttttgtgccaggcaaaaattcgcaagtcggtactccggcgaccagggttcttattttgatctatgggggcgcggaacactcattatcgtcagctccgcctcaaccagagctcacaggagtagcccacggtctgca

SEQ ID NO: 26718 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcaccgcatctcgctgacgcgagaccgtgatttgtttaccgcgcatatggacattagaggtttaacacagggggatactgctacctacttctgtgccaggcaaaagtttgaatcacggtatacaggaggccagggctggtacttcgacctgtgggggcgcggaacccacatcgtggttagcagtgcatccactaaaggtccatctgtgtttccgcatgatctaaga

SEQ ID NO: 26719 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttggatcttcggacttccggaatcgcatttcactgacccgagatcgtgacttgagcacagcccatatggatatcagaggcttaactcaggacgataccgcgacatatttttgtgctaggcaaaaattcgagagtctgtactccgacgatcagggttcttattttgacctatgggggcggggaaccctcattatcgtcagctccgcctcaactaagggcccaagtgtgttcccgacaatatacgtt

SEQ ID NO: 26720 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgtatatggatatcagaggactgacacaggacgatactgctacctacttttgtgccaggcaaaaattcgcaagtcggtattccggcgaccagggttcttactttgatctatgggggcgcggaacactcattgtcgtgagctccgcctcaaccaagggcccaagtgttttcccgcatgacctgaga

SEQ ID NO: 26721 - RNA, 423 nt, synthetic construct
  misc_feature 1..423: note = derived and/or modified sequence opt3 from anti-HIV-1_HeavyChain
  source 1..423: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgcatatggatatcagaggactgacacaggacgatactgctacctatttttgtgccaggcaaaaattcgcaagtcggtactccggcgaccagggttcttattttgatctatgggggcgcggaacactcattatcgtcagctccgcctcaaccaagggcccaagtgtgttcccgactatatgc

SEQ ID NO: 26722 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtctacagcgcatatggatatcaggggtttaactcaggacgataccgctacatacttttgtgcccggcaaaaattcgcacgcggggaccagggatggtttttcgatctgtggggcagaggcaccctaattgttgtgtcgtcagccctccaccaggggccgatcggactgccccctaggagcact

SEQ ID NO: 26723 - RNA, 423 nt, synthetic construct
  misc_feature 1..423: note = derived and/or modified sequence opt3 from anti-HIV-1_HeavyChain
  source 1..423: mol_type = other RNA
caggtgtacatggagcaagccggcgggggagtcaagaaacccggtgctagcgttaccctgtcctgcaagacagcagacgaagatgtgttcgacgccgcgtatatgcactgggtaagacaggctcctggccagacttttgagtggctcgggtggatgaaaccagtgacgggagccgtcaactacgcaaggaagttccagggccgggtgtctttttatcgcacccgagaacttggtatcgcctacatggatctgcgtaatttgagattcgacgatacagctgtttatttttgtgcaaggaaaactgccggggacgtgtcaggagataagcggggcttctttttcgacttatggggccgcgggagtagagtcattgtgagctccgcttctaccaagggaccgtcggtactgccccctaggtcagcc

SEQ ID NO: 26724 - RNA, 423 nt, synthetic construct
  misc_feature 1..423: note = derived and/or modified sequence opt3 from anti-HIV-1_HeavyChain
  source 1..423: mol_type = other RNA
caggtgcaactggtccagagcggcgccgaggttaagaaacccggggcttccgtgaagatctcttgcaaagcatcaggatacaccttcattagacacggtatacattggctcaggcaggtacctggccagcggccagaatggatggggtggatccgcccgaagacaggagcccgaaaccaagcgcgtcagtttcagcccagaattagtcttgctagggaccgggccctgagcactgcatatttggatttaaattccctgacgtctgccgactcgggcacctacttctgtgctcgccagacatttaaacctgatttctattttgcagaccaaggttggtcattcaacctatgggggagaggagcccactttatcgtgagcagtgctctccatcagggcccaattggcctgccccctaggtccact

SEQ ID NO: 26725 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgccatgaagaaacccggggcttcagtgagagtcagttgctggaccagcgaagacatcttcgagaggacagaactcatttactgggttcggcaggcacctggacagggtcttgagtggataggctgggtgaagatcgtatccgggactgtgaactttgcctctctggatttccgcaatcgaatttcgttgtcacgtgacagagatttaagcacggcgtatatggacatcaggggactgacccaggatgacacagctacttacttttgtgcccggcaaaaattcgcaagtcgctattccggcgatcagggttcttactttgacctatgggggagaggaaccctcattgtcgtgagctccgcctcaacaaagggcccaagtgttttcccgcatgatctgagg

SEQ ID NO: 26726 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcctggatttccgccaccgaatctccttgacccgtgacagagatttatttacagcgcatatggacattaggggtctgactcagggggataccgctacatacctatgtgcccggcaaaaattcgaatctcgctataccggaggccagggctggtactttgacctctgggggagaggaactcacatcgtggtttcgtcagcaagcacaaagggtccaagtgtgttcccgaccatttgcgtc

SEQ ID NO: 26727 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggaccagtgaagacatcttcgatacaactgagctcatttactgggtgaggcaggcacctggtcagggccttgaatggatagggtgggtaaagatcgtgagcggaacggtcaactttgcctccctggacttccggaatcgcatttctttgtcgcgagatcgtgacttatcaaccgcgtatatggatatcagaggcctgacacaggacgatactgctacctacttttgtgccaggcaaaaattcgcaagccggtatagtggtgaccaggggtcctactttgatctatggggacgcggcacactcattgtggtttctagcgcctccaccaagggcccatcagtgttcccgcagatctgcgtc

SEQ ID NO: 26728 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcctggatttccgccaccgaatctccttgacccgtgacagagatttatttacagcgcatatggacattaggggtctgactcagggggataccgctacatacttctgtgcccggcaaaaatttgaatctcgctataccggaggccagggctggtacttcgacctatgggggagaggaactcacatcgtggtttcgtcagcaagcacaaagggtccaagtgtgtttccgaccatttgcgtc

SEQ ID NO: 26729 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagtttgaatcactgtatagcgacgatcagggaagttacttcgacctatggggccggggcacactcattatcgtttcctctgcaagcaccaaagggccatccgtgtttccgactatttgcgtc

SEQ ID NO: 26730 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgagcggagccgtcaactttggctccccaaatttccgccaccgagtgtctctgacgcgtgatagagacttgtttaccgcgcatatggatatcaggggtttaacacagggggacactgctacctacttctgtgcccggcaaaaatttgaatcgcgctatacaggaggccagggctggtacttcgatctgtgggggagaggaacccacattgttgtgtcaagcgcaagtactaagggtccgtccgtctttccccatgacctaagg

SEQ ID NO: 26731 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgcatatggatatcagaggactgacacaggacgatactgctacctatttttgtgccaggcaaaaattcgcaagtcggtactccggcgaccagggttcttattttgatctatgggggcgcggaacactcattatcgtcagctccgcctcaaccaagggcccaagtgtgttcccgactatatgcgtt

SEQ ID NO: 26732 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggaaccgtcaactttggcagcctgaatttccgccagcgagtgtccttgacacgtgatagagacttatttactgcccacatggatatcaggggtctgacccaagacgatacagcgacctacttctgtgctcggcagaaatttgcctctcgctattcgggggaccagggatcatacttcgatctatggggcagaggcactctcattgttgtgagcagtgcatccacaaaggggccatctgtctttccgaccatctgcgtg

SEQ ID NO: 26733 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgcatatggatatcagaggactgacacaggacgatactgctacctatttttgtgccaggcaaaaattcgcaagtcggtactccggcgaccagggttcttattttgatctatgggggcgcggaacactcattatcgtcagctccgcctcaaccaagggccacagaagtagcccaactatatgcgtg

SEQ ID NO: 26734 - RNA, 423 nt, synthetic construct
  misc_feature 1..423: note = derived and/or modified sequence opt3 from anti-HIV-1_HeavyChain
  source 1..423: mol_type = other RNA
caggtgtacatggagcaagccggcgctgggatgaagaaacccggagcaagcatgaccgtctcctgcaagacagccgacgaagatgttttcgacgcggcttatatgcactgggtgagacaggcccctggtcagacttttgagtggctgggctggatgaaaccagtaacgggggcagtgaactacgccaggaagttccagggacgggtctctttttatcgcacccgagaactcggcatcgcttacatggatcttcgtaatctgagattcgacgatacagcagtgtatttttgtgccaggaaaactgctggtgacgtttcaggggataagcggggattctttttcgacttgtggggccgcggcagtagagtgattgtcagctccgcctctaccaaggggccgtcggtgtttcccacaatatacgta

SEQ ID NO: 26735 - RNA, 423 nt, synthetic construct
  misc_feature 1..423: note = derived and/or modified sequence opt3 from anti-HIV-1_HeavyChain
  source 1..423: mol_type = other RNA
cagagccacctggagcaatccggctctgccatgaagaaacccggggcttcagtgagagtcagttgctggaccagcgaagacatcttcgatacaactgagctctactgggttaggcaggcacctggacagggtcttgaatggattggctgggtgaagatagtatccgggacggtgaactttgcctctctggacttccggaatcgcatctcgttgtcacgagatcgtgacttaagcaccgcgtatatggatattagaggactgacacaggacgatactgctacctacttttgtgccaggcaaaaattcgcaagtcggtattccggcgaccagggttcttactttgatctatgggggcgcggaacactcatcgtcgtgagctccgcctcaaccaagggcccaagtgttttcccgcatgacctgaga

SEQ ID NO: 26736 - RNA, 423 nt, synthetic construct
  misc_feature 1..423: note = derived and/or modified sequence opt3 from anti-HIV-1_HeavyChain
  source 1..423: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcccggcagttccaaggacgcgtctctttttatcgaacccgtgagctgggcattgcgtacatggacttgagagatttaaaattcgacgatacagctgtgtatttttgtgccaggaagactaaaggtgacgtttcgggggatgaccggggattctttttcgatctgtggggccgcggcaccagagtgatcgtctcaagcgcaagtacaaaggggccatccgtgtttccgcatgaccccgcc

SEQ ID NO: 26737 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagtttgaatcacggtatacaggaggccagggctggtacttcgacctgtgggggcgcggaacccatattgttgtgagcagtgcatccactaaaggtccatctgtctttccgacaatctgcgtg

SEQ ID NO: 26738 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggaccagtgaagacatcttcgagaggagcgaactcattcattgggtgcggcaggcacctggtcagggccttgagtggatagggtgggtaaagacagtgactggagccgtcaactttggctccccaaatttccgccagcgagtgtctctgacgcgtgatagagacttgtcgaccgcgcacatggatatcaggggtttaacacaagacgatactgctacctacttttgtgcccggcagaaattcgaatcactgtatagcgacgatcaggggagttactttgacctatggggacgcggcacactcattatcgtttcctctgcaagcaccaagggcccgtccgtgttccccactatttgcgtc

SEQ ID NO: 26739 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcgcttccggcgtgaagagacccggggcatctgtcagggtttcatgctggaccagtgaagacatcttcgagcggacagaactcatttactgggtgcgccaggcccctggacagggtcttgagtggataggctgggtaaaaactgtgagcggggcggtcaactttggatcccaggatttccgagaccgtttttctctgacgagagatagggacttgttcaccgctcatatggatatccggggcttaacacaaggtgacactgccacctatttttgtgcacgccagaagttcgcctcgagatactcaggggatcagggaagctattttgacctgtggggcaggggcacactaattgtggttagttccgcttctaccaaagggccaagcgtgttcccgactatctgcgtc

SEQ ID NO: 26740 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgttcacggctcatatggacatcaggggtctaacccaggatgacacagccacttatttttgtgcacggcaaaaattcgaatcgcgctacaccgggggacagggctggtattttgatctctggggcagagggacacacattgttgtgtcaagcgccagtaccaagggaccttccgtcttcccaactatctgcgtg

SEQ ID NO: 26741 - RNA, 423 nt, synthetic construct
  misc_feature 1..423: note = derived and/or modified sequence opt3 from anti-HIV-1_HeavyChain
  source 1..423: mol_type = other RNA
caggtgcacatggagcaagccggcgggggaatgaagaaacccggtgctagcatgaccgtctcctgcaagacagcagacgaagatatcttcgacgccgcgtacatgcattgggttagacaggctcctggccagacttttgagtggctggggtggatgaaaccagtgacgggagccgtaaactatgcaaggcagttccaaggccgggtgtcttttctccaggatcagggtattcgcatagcctacatggaccttcgagatctgaagttcgacgataccgctgtctatttttgtgcacgtaaaacaaagggggacgtgtcaggagatgacagaggcttctttttcgatttgtggggcagggggactcgggttatcgtgagtagctccttacaccagggaccgattggtctgccccctcgctctgcc

SEQ ID NO: 26742 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcaccgcatctcgctgacgcgagaccgtgatttgtttaccgcgcatatggacattagaggtttaacacagggggatactgctacctacttctgtgccaggcaaaagtttgaatcacggtatacaggaggccagggctggtacttcgacctgtgggggcgcggaacccacatcgtggttagcagtgcatccactaaaggtccatctgtgtttccgacaatttatgtc

SEQ ID NO: 26743 - RNA, 426 nt, synthetic construct
  misc_feature 1..426: note = derived and/or modified sequence opt3 from anti-HIV-1_HeavyChain
  source 1..426: mol_type = other RNA
caggtgtacatggagcaagccggcgggggagtcaagaaacccggtgctagcgttaccctgtcctgcaagacagcagacgaagatgtgttcgacgccgcgtatatgcactgggtaagacaggctcctggccagacttttgagtggctcgggtggatgaaaccagtgacgggagccgtcaactacgcaaggaatttccagggccgggtgtctttttatcgcacccgagaacttggtatcgcctacatggatctgcgtaacttgagattcgacgatacagctgtttatttttgtgcaaggaagactaaaggggacgtgtcaggagatgaccggggcttctttttcgatttatggggccgcgggaccagagtcattgtgagtagcggactgcatcaaagggcccaccggtcctctccgacaatatgcgta

SEQ ID NO: 26744 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgtatatggatatcagaggactgacacaggacgatactgctacctacttttgtgccaggcaaaaattcgcaagtcggtattccggcgaccagggttcttactttgatctatgggggcgcggaacactcattgtcgtgagctccgcctcaaccaagggcccaagtgttttcccgactatctgcgtg

SEQ ID NO: 26745 - RNA, 423 nt, synthetic construct
  misc_feature 1..423: note = derived and/or modified sequence opt3 from anti-HIV-1_HeavyChain
  source 1..423: mol_type = other RNA
caggtgtacatggagcaagccggcgtcggggttaagaaacccggagctagcgtgaccctgtcctgcaagacagcagacgaagatgtattcgacgccgcgtatatgcactgggtgagacaggctcctggtccagatctcgagtggcttggctggatgaaaccggtcactggggccgtgaactacgcaaggaagtttcagggacgggtttctttctatcgcacgcgagaactgggcatcgcctacatggacttgcgtaatttaagatttgatgacaccgctgtgtatttctgtgcaaggaaaacagccggtgatgtctcaggggacaagcggggatttttctttgatctgtggggccgcggcagtagagtgattgtaagctccgcttctactaaggggccctcggttttccctaccatatgcgtg

SEQ ID NO: 26746 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgcatatggatatcagaggactgacacaggacgatactgctacctatttttgtgccaggcaaaaattcgcaagtcggtactccggcgaccagggttcttattttgatctatgggggcgcggaacactcattatcgtcagctccgcctcaaccaagggcccaagtgtgttcccgcacgacctgaga

SEQ ID NO: 26747 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgactggagcggtcaactttggcagcttggatttccgccaccgaatctccttaacgcgtgacagagatctgtttaccgctcatatggacattaggggtctaacacagggggatactgccacctacttctgtgcacggcaaaaatttgaatctcgctatacaggaggccagggctggtacttcgacctctgggggagaggaacccacatcgtggtttcgtcagccagcactaagggtcctagtgtgtttccacatgatctgagg

SEQ ID NO: 26748 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagcgcatagggtgggtaaagactgtgacgggagccgtcaactttggcagcctggatttccgacaccgtatctccttgaccagagacagggatttatttacagcgcatatggacattcggggtctgactcagggggataccgctacatacttctgtgcccgccaaaaatttgaatctagatataccggaggccagggctggtacttcgacctatgggggaggggaactcacatcgtggtttcgtcagcaagcacaaagggtccaagtgtgtttccgaccatttgcgtc

SEQ ID NO: 26749 - RNA, 423 nt, synthetic construct
  misc_feature 1..423: note = derived and/or modified sequence opt3 from anti-HIV-1_HeavyChain
  source 1..423: mol_type = other RNA
gaggtgtacatggaaagaggcaggggaggggtcaagaaacccggtgccagcgctaccctgtcctgcaagacagcagacgaggatgttttcgacgccgcgtatatgcactgggtgcggcaggctcctggccaaacttttgaatggctcgggtggatgaaaccagtaacgggagccgtgtcttacgcacgcaagttccagggccgagtctcattttatatgacccgtgagcttggtatggcctacatggatctgagaaacttgaggttcgacgatacagctgtgtatttttgtgcacggaaaactgccggggacgttagtggagataatcgcggctacttctttgacttatggggcagagggagcagggtgatcgtctcctctgcttcgaccaagggaccgtcagtgttcccccatgatctgcgg

SEQ ID NO: 26750 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgcaagagtctcatgctggagtagcgaagacatcttcgagaggattgaactcatacattgggttcggcaggcccctggtcagggccttgagtggatcgggtgggtgaagaccgtagcgggagctgtgaactttggctccctggatttccgccaccgaatttctttgacacgtgacagagatttatttactgcccatatggacatcaggggtctgacgcagggggataccgcaacatacttctgtgcccggcaaaaatttgaatcgcgctatactggaggccagggctggtacttcgacctatgggggagaggaacccacattgtcgtgtcaagcgctagtacaaagggtccatccgtttttccgcatgatctcagg

SEQ ID NO: 26751 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgcatatggatatcagaggactgaggcaggacgatacagctacttatttttgtgcccggcaaaaattcgagagtcgctactccggcgaccagggttcttattttgatctatgggggagaggaaccctcattatcgtcagctccgcatcaacaaagggcccaagtgtgttcccgaccatatacgtt

SEQ ID NO: 26752 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatggaatttcgttgtcacgcgatcgagacttaagcaccgcgtatatggatatccgtggcctgacacaggacgatactgctacctacttttgtgccagacaaaaattcgcaagtaggtattccggtgaccaggggtcttactttgatctatggggacggggcacactcattgtcgtgagctccgcctcaaccaagggcccaagtgttttcccgcatgacctgcgc

SEQ ID NO: 26753 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgcatatggatatcagaggactgacacaggacgatactgctacctatttttgtgccaggcaaaaattcgcaagtcggtactccggcgaccagggttcttattttgatctatgggggcgcggaacactcattgtcgtgagctccgcctcaaccaagggcccaagtgttttcccgcacgacctgaga

SEQ ID NO: 26754 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggaccagtggtgacatcctcaggaaaagcgaacttattcattgggtgcggcaggcacctggccaggggctggagtggataggatgggtaaagacagtgactggcgccgtcaacttcggttccttggattttcgccaccgaatctctttaacgcgtgacagagatctgttcaccgcgcatatggacattagggggctaacacagggagatactgctacctacttttgtgcccggcaaaagttcgaatcgcgctatacaggcggccaggggtggtactttgacctctggggaagaggtacccacatcgtggtttcaagcgcaagtactaaaggcccatccgtgttcccgcatgatctgagg

SEQ ID NO: 26755 - RNA, 426 nt, synthetic construct
  misc_feature 1..426: note = derived and/or modified sequence opt3 from anti-HIV-1_HeavyChain
  source 1..426: mol_type = other RNA
caggtgcacctggagcaaagcggctccggggtcaagaaacccggagcctctgttagagtgtcatgctggagtagcgaagacatcttcgagaggaccgaactcattcattgggtacggcaggctcctggtcagggccttgagtggatagggtgggtgaagacagtcactggagcagtgaactttggctccctggatttccgccaccgaatctctttgacgcgtgacagagatttatttaccgcccatatggacattaggggtctgacacagggggatactgcgacctacttctgtgctcggcaaaaatttgaatcgcgctatacaggaggccagggctggtacttcgacctatgggggagaggaacccacatcgttgtgtcaagcgcctgcactaagggtccaagtgtctttccgcatgatctcagg

SEQ ID NO: 26756 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagctggtccggcgtgaagaaacccggggcttctgtcagagtttcatgctggagtagcgaagacatcttcgagaggaccgaactcattcattgggtgcggcaggcacctggacagggtcttgagtggataggctgggtaaagacagtgactggggccgtcaactttggatccctggatttccgccaccgaatctctttgacgcgtgacagagatttatttaccgcgcatatggacattaggggcctgacacagggtgatactgctacctacttctgtgcccggcaaaaatttgaatcgcgctatacagggggacagggctggtacttcgacctatggggcagagggacccacatcgtggtttcaagcgcaagtactaagggaccatccgtgtttccgcatgatctcagg

SEQ ID NO: 26757 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgccatgaagaaacccggggcttcagtgagagtcagttgctggaccagcgaagacatcttcgagaggacagaactcatttactgggttcggcaggcacctggacgcggtccagagtggataggctgggtgaagactgtatccgggacggtgaactttggatcttcggatttccgaaatcgtatctcacttaccagagacagggatctgagcacagcccatatggacattcggggcttgactcaggatgacaccgcgacatatttttgtgctcgccagaaattcgaaagtttatactccgatgaccaaggttcttattttgatctgtgggggagaggaaccctaatcattgtcagctccgcctcaactaagggcccgagtgtgttcccccacgacctcagg

SEQ ID NO: 26758 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgtcaactttggctccctggatttccgccaccgaatctctttgacgcgtgacagagatttatttaccgcgcatatggacattaggggtctgacacagggggatactgctacctacttctgtgcccggcaaaaatttgaatcgcgctatacaggaggccagggctggtacttcgacctatgggggagaggaacccacatcgtggtttcaagcgcaagtactaagggtccatccgtgtttccgacaattctcagg

SEQ ID NO: 26759 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgccatgaagaaacccggggcttcagtgagagtcagttgctggaccagcgaagacatcttcgagaggacagaactcatttactgggttcggcaggcacctggacgcggtcttgagtggataggctgggtgaagactgtatccgggacggtgaactttggatcttcggatttccgaaatcgtatctcactgaccagagacagggatttgagcacagcccatatggacattcggggcttaactcaggatgacaccgcgacatatttttgtgctcgccagaaattcgaaagtctgtactccgatgaccaaggttcttattttgatctatgggggagaggaaccctcatcgccgtcagctccgcatcaactaagggcccaagtgtgttcccgcacgacctgagg

SEQ ID NO: 26760 - RNA, 426 nt, synthetic construct
  misc_feature 1..426: note = derived and/or modified sequence opt3 from anti-HIV-1_HeavyChain
  source 1..426: mol_type = other RNA
cagagccacctgaagcaatccggctctgccatgaaaaagcccggggcttcagtgagagtcagttgctggaccagcgaggacatcttcgaaaggacagagctcatttactgggttcggcaggcacctggacgcggtcttgaatggataggctgggtgaaaactgtatccgggacggtgaactttggatcttcggatttccgaaatcgtatctcactgaccagagacagggatttgagcacagcccatatggacattcggggcttaactcaggatgacaccgcgacatatttttgtgctcgccagaagttcgagagtctgtactccgatgaccaaggttcttattttgatctatgggggagaggaaccctcatcattgtcagctccgcctcaactaaaggcccaagtgtgttcccgcacgacctgagg

SEQ ID NO: 26761 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagaatgggtaaaggccgtgagcggggcggtcaactacggatccttggattttcgccaccgagtgtctttaactcgtgacagagatctgttcacggctcatatggacatcaggggcctaacccaggatgacacagccacttatttttgtgcacggcaaaaattcgagtcgcgctacaccggtgggcagggatggtattttgatctctggggcagaggcacacacattgttgtgtcaagcgccagtaccaaggggccttccgtcttcccacatgacctgagg

SEQ ID NO: 26762 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgcatatggatatcagaggactgacacaggacgatactgctacctatttttgtgccaggcaaaaattcgagagtcggtactccggcgaccagggttcttattttgatctatgggggcgcggaacactcattatcgtcagctccgcatcaaccaagggcccaagtgtgttcccgcacgacctgaga

SEQ ID NO: 26763 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctccctggatttccggaatcgcatctctttgtcgcgagaccgtgatttatcaacggcgtacatggacattagaggtctgacccaggatgacacagctacttatttttgtgccaggcaaaagttcgcaagccggtacagtggggatcagggatcctattttgacctatggggccgcggcaccctcatcgtggtttctagcgcctccacaaaagggccatcagtgttcccgcacgatctgaga

SEQ ID NO: 26764 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggaccagtgaagacatcttcgagaggagcgaactcattcattgggtgcggcaggcacctggtcagggccttgagtggatagggtgggtaaagacagtgactggagccgtcaactttggctccccaaatttccgccagcgagtgtctctgtcgcgtgatagagacttgtcaacggcgcacatggatatcaggggtttaacccaagacgatacagctacttacttttgtgcccggcagaaattcgcaagccgctatagtggggaccagggatcctactttgatctgtggggcagaggcaccctaattatcgtttctagcgcctccacaaaggggccgtcagtgttcccccatgacctcagg

SEQ ID NO: 26765 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgccatgaagaaacccggggcttcagtgagagtcagttgctggaccagcgaagacatcttcgagaggacagaactcatttactgggttcggcaggcacctggacgcggtcttgagtggataggctgggtgaagactgtatccgggacggtgaactttggatcttcggatttccgaaatcgtatctcactgaccagagacagggatttgagcacagcccatatggacattcggggcttaactcaggatgacaccgcgacatatttttgtgctcgccagaaattcgaaagtctgtactccgatgaccaaggttcttattttgatctatgggggagaggaaccctcatcattgtcagctccgcctcaactaagggcccaagtgtgttcccgcacgacctgagg

SEQ ID NO: 26766 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcgcggccttgagtggatagggtgggtaaagactgtgagcggaacggtcaactttggctcctctgatttccgaaatcgtatctcgctgaccagagacagggatttgtcaacagcccacatggacattcggggtttaactcaggatgacaccgcgacatacttttgtgctcgccagaaattcgaaagcctgtatagtgatgaccaagggtcctactttgatctatggggaagaggcaccctcatcattgtgtctagcgcctccactaagggcccatcagttttcccgcatgacctgagg

SEQ ID NO: 26767 - RNA, 426 nt, synthetic construct
  misc_feature 1..426: note = derived and/or modified sequence opt3 from anti-HIV-1_HeavyChain
  source 1..426: mol_type = other RNA
caggtgcacctggagcaaagcggctccggggtcaagaaacccggagcctctgttagagtgtcatgctggagtagcgaagacatcttcgagaggaccgaactcattcattgggtacggcaggctcctggtcagggccttgagtggatagggtgggtgaagacagtcactggagcagtgaactttggctccctggatttccgccaccgaatctctttgacgcgtgacagagatttatttaccgcccatatggacattaggggtctgacacagggggatactgcgacctacttctgtgctcggcaaaaatttgaatcgcgctatacaggaggccagggctggtacttcgacctatgggggagaggaacccacatcgttgtgtcaagcgccagtactaagggtccatccgtctttccgcatgatctcagg

SEQ ID NO: 26768 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgcatatggatatcagaggactgaggcaggacgatacagctacttatttttgtgcccggcaaaaattcgagagtcgctactccggcgaccagggttcttattttgatctatgggggagaggaaccctcattatcgtcagctccgcatcaacaaagggcccaagtgtgttcccgcacgacctgagg

SEQ ID NO: 26769 - RNA, 423 nt, synthetic construct
  misc_feature 1..423: note = derived and/or modified sequence opt3 from anti-HIV-1_HeavyChain
  source 1..423: mol_type = other RNA
caggtgtacatggagcaagccggcgctggggtcaagaaacccggagcaagcgttaccctgtcctgcaagacagccgacgaagatgtgttcgacgcggcttatatgcactgggtaagacaggcccctggtcagacttttgagtggctcggctggatgaaaccagtgacgggggcagtctcttacgccaggaagttccagggacgggtgtcattttatatgacccgcgaacttggcgttgcttacatggatctgcgaaacttgcgtttcgacgatacagcagtgtatttttgtgccagaaaaactgctggtgacgtcagtggggataataggggatacttctttgacttatggggccggggcagccgcgtgatcgtatcctctgcctcgaccaaggggccgtcagttttcccccatgatctgaga

SEQ ID NO: 26770 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtaacttaagcaccgcgcatatggacatcagaggactgaggcaggatgacacagctacttatttttgtgcccggcaaaaattcgagagtcgctactccggcgatcagggttcttattttgacctatgggggagaggaaccctcattatcgtcagctccgcatcaacaaagggcccaagtgtgttcccgcacgatctgagg

SEQ ID NO: 26771 - RNA, 423 nt, synthetic construct
  misc_feature 1..423: note = derived and/or modified sequence opt3 from anti-HIV-1_HeavyChain
  source 1..423: mol_type = other RNA
caggtgcaactggtccagagcggcgccgaggttaagaaacccggggcttccgtgaccctctcttgcaagacagcagacgaagatgtattcgacgccgcgtacatgcactgggtgagacaggctcctggacagacttttgagtggcttggttggatgaaaccagtcacgggcgccgtgtcatatgcaaggaagttccaagggcgggttagtttttacatgacccgcgaactgggaatggcctatatggatttgcgaaacttacgtttcgacgatacagctgtgtacttttgtgcaagaaaaactgccggcgacgtcagcggtgataatagggggtatttctttgacctgtggggacggggctcccgcgtgatcgtatcttcggcttcaaccaagggcccgagcgttttccccacaatttacgtg

SEQ ID NO: 26772 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggaccagtgaagacatcttcgagaggacagaactcgtgcattgggtacggcaggcacctggtcagggccttgagtggattgggtgggtgaagactgtcacgggagccgtgaactttggcagcccaaatttccgccagcgagtttccctgacccgtgatagagacttgtttacagcgcacatggatataaggggtttaactcaagacgataccgctacatacttctgtgcccggcagaaatttgcatctcgctattcgggggaccagggatcatacttcgatctgtggggcagaggcaccctaatcgtggtcagcagtgcctccactaaggggccgtctgtgtttccccatgacctcagg

SEQ ID NO: 26773 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgtatatggatatcagaggactgacacaggacgatactgctacctacttttgtgccaggcaaaaattcgcaagtcggtattccggcgaccagggttcttactttgatctatgggggcgcggaacactcattatcgtcagctccgcctcaaccaagggcccactgggccttccgcatgacctgaga

SEQ ID NO: 26774 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgtcgacggctcatatggacatcaggggtctaacccaggatgacacagccacttatttctgtgcacggcaaaaatttgcctcacgctacagcggggatcagggaagttatttcgacctctggggcagaggcaccctgattgttgtgtcctctgctagcacaaaggggccttccgtctttccacacgatcttagg

SEQ ID NO: 26775 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggaccagtgaagacatcttcgagaggacagaactcatttactgggtgcggcaggcacctggtcagggccttgagtggatagggtgggtaaagatcgtgagcggaactgtcaactttgcctccctggatttccgcaatcgaatttctttgtcgcgtgacagagatttatcaacggcgcatatggacatcaggggcctgacccaggatgacacagctacttatttttgtgcccggcaaaaattcgcaagccgctacagtggtgatcaggggtcctattttgacctatggggaagaggcaccctcattatcgtgtctagcgcctccacaaagggcccatcagttttcccgcacgatctgagg

SEQ ID NO: 26776 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgcaaccgaatctccctgacccgtgatagagacttgtctacagcgcacatggatattaggggtttaactcaggacgataccgctacatacttttgtgcccggcaaaaattcgaatcgctgtattcagacgatcaggggagctactttgacctatggggacgcggcaccctcatcattgtgagttccgcatctactaagggcccgagcgttttcccccatgatctgaga

SEQ ID NO: 26777 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagtttgaatcactgtatagcgacgatcagggaagttacttcgacctatggggccggggcacactcattatcgtttcctctgcaagcaccaaagggccatccgtgtttccgcatgatctgcgc

SEQ ID NO: 26778 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagctccgatttccgcaatcgaatctctctgacccgtgacagagatttgtcgacagcgcacatggacattaggggtttaactcaggatgacaccgctacatacttttgtgcccggcaaaaattcgaatcactgtatagcgatgaccaggggagttactttgatctatggggacgcggcaccctcatcattgtgtcctctgcaagcactaagggcccatccgttttcccgcatgacctgaga

SEQ ID NO: 26779 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgccatgaagaaacccggggcttcagcaagagtgagttgctggaccagcgaagacatcttcgatacaactgagctcatttactgggtcaggcaggcccctggacagggtcttgaatggataggctgggttaagatcgtgtccgggacggtaaactttgcgtctctggacttccggaatcgcatttcgttgtcacgagatcgtgacttaagcaccgctcatatggatatcagaggactgacacaggacgatactgccacctatttttgtgcaaggcaaaaattcgccagtcggtactccggcgaccagggttcttattttgatctatgggggcgcggaacacacattgtggtcagctccgcttcaaccaagggcccaagtgtgttcccgcatgacctcaga

SEQ ID NO: 26780 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgttcacggctcatatggacatcaggggtctaacccaggatgacacagccacttatttttgtgcacggcaaaaattcgaatcgcgctacaccgggggacagggctggtattttgatctctggggcagagggacacacattgttgtgtcaagcgccagtaccaagggaccttccgtcttcccacatgacctgagg

SEQ ID NO: 26781 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgtcgacggctcatatggacatcaggggtctaacccaggatgacacagccacttatttctgtgcacggcaaaaatttgaatcacgctacaccgggggacagggctggtatttcgatctctggggcagagggacacacattgttgtgagcagtgcctccaccaagggaccttctgtctttccacatgacctgagg

SEQ ID NO: 26782 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgccatgaagaaacccggggcttcagtgagagtcagttgctggaccagcgaagacatcttcgagaggacagaactcatttactgggttcggcaggcacctggacgcggtcttgagtggataggctgggtgaagactgtatccgggacggtgaactttggatcttcggatttccgaaatcgtatctcactgaccagagacagggatttgagcacagcccatatggacattcggggcttaactcaggatgacaccgcgacatatttttgtgctcgccagaaattcgccagtagatactccggtgatcaagggtcttattttgacctgtggggaaggggcaccctaatcattgtcagctccgcatcaactaagggcccaagtgtgttcccgcacgatctccgg

SEQ ID NO: 26783 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgccatgaagaaacccggggcttcagtgagagtcagttgctggaccagcgaagacatcttcgagaggacagaactcatttactgggttcggcaggcacctggacgcggtcttgagtggataggctgggtgaagactgtatccgggacggtgaactttggatcttcggatttccgaaatcgtatctcactgaccagagacagggatttgagcacagcccggatggacattcgcggcttaactcaggatgacaccgcgacatatttttgtgctagacagaaattcgaaagtctgtactccgatgaccaaggttcttattttgatctatgggggaggggaaccctcatcattgtcagctccgcctcaactaagggcccaagtgtgttcccgacagacctgcgg

SEQ ID NO: 26784 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaagatgacactgctacctacttctgtgccaggcagaagtttgcatcacggtatagcggggatcagggaagttacttcgacctgtggggccgcggcacactaattgttgtgtcctctgccagcaccaaagggccatccgtctttccgcatgatctcaga

SEQ ID NO: 26785 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgccatgaagaaacccggggcttcagtgagagtcagttgctggaccagcgaagacatcttcgagaggacagaactcatttactgggttcggcaggcacctggacgcggtcttgagtggataggctgggtgaagactgtatccgggacggtgaactttggatcttcggatttccgaaatcgtatctcactgaccagagacagggatttgagcacagcccatatggacattcggggcttaactcaggatgacaccgcgacatatttttgtgctcgccagaaattcgaaagtctgtactccgatgaccaaggttcttattttgatctatgggggagaggaaccctcatcattgtcagctccgcctcaactaacggcccaatcggcctgccgcacgaccttagg

SEQ ID NO: 26786 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagtttgaatcacggtatacaggaggccagggctggtacttcgacctgtgggggcgcggaacccatattgttgtgagcagtgcatccactaaaggtccatctgtctttccgcacgatctaaga

SEQ ID NO: 26787 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtttacagcgcatatggatatcaggggtttaactcaggacgataccgctacatacttctgtgcccggcaaaaatttgcatctcgctattcgggggaccagggatcatacttcgatctgtggggcagaggcaccctaattgttgtgagcagtgcctccactaaggggccgtctgtctttccccacgacctcagg

SEQ ID NO: 26788 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgccatgaagaaacccggggcttcagtgagagtcagttgctggaccagcgaagacatcttcgagaggacaggactcatttactgggttcggcaggcacctggtcgcggccttgaatggatagggtgggtgaagactgtatccggaacggtgaactttggttcttcggatttccgaaatcgtatctcactgaccagagacagggatttgagcacagcccatatggacattcggggcttaactcaggatgacaccgcgacatatttttgtgctcgccagaaattcgagagtctgtactccgatgaccaagggtcttattttgatctatggggaagaggcaccctcatcattgtcagctccgcctcaactaagggcccaagtgtgttcccgcacgacctgagg

SEQ ID NO: 26789 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagccagatcttccgccaccgaatttccctgacccgtgatagagacttgtttacagcgcatatggatatcaggggtttaactcaaggggacaccgctacatacttctgtgcccggcagaaatttgaatctcgctataccggaggccagggctggtacttcgatctgtgggggagaggaactcacattgtggtttcgtcagcaagcacaaagggtccaagtgtgtttccgcatgacctaagg

SEQ ID NO: 26790 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgccatgaagaaacccggggcttcagtgagagtcagttgctggaccagcgaagacatcttcgatacaactgagctcattcattgggttaggcaggcacctggacagggtcttgaatggataggctgggtgaagacggtaaccggggccgtgaactttggatccctggacttccggcaccgcatctctttgacacgagatcgtgacttatttactgcgcatatggatattagaggcctgacccagggtgacacagctacctacttctgtgccaggcaaaaatttgagtcgcggtatactgggggacagggctggtacttcgatctatggggccgcgggacacacatcgtcgtgtcaagcgcaagtaccaagggaccatccgtttttccgcatgacctcaga

SEQ ID NO: 26791 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgaagtgaagaaacccggggcctcagtcagagttagttgctggaccagcgaggacatcttcgaaaggacagagctcatttactgggtgcggcaggctcctggacgcggtcttgaatggataggctgggtaaagactgtgtccgggacggtcaactttggatcttcggatttccgaaatcgtatctcactgaccagagacagggatttgagcacagcacatatggacattcggggcttaactcaggatgacaccgccacatatttttgtgcgcgccagaaattcgagagtctgtactccgatgaccaaggttcttattttgatctatgggggagaggaaccctcatcattgtgagctccgcttcaactaagggcccaagtgttttcccgcacgacctgagg

SEQ ID NO: 26792 - RNA, 423 nt, synthetic construct
  misc_feature 1..423: note = derived and/or modified sequence opt3 from anti-HIV-1_HeavyChain
  source 1..423: mol_type = other RNA
caggtgtacatggagcaagccggcgggggagtcaagaaacccggtgctagcgttaccctgtcctgcaagacagcagacgaagatatcttcgacgccgcgtatatgcactgggtgagacaggctcctggccagacttttgagtggctcgggtggatgaaaccagtaacgggagccgtgaactacgcaaggcagttccaaggccgggtctctttttatcgcacccgagaacttggtattgcctacatggatctgcgtgacttgaagttcgatgacacagctgtgtatttttgtgcaagaaaaactaagggggatgtttcaggagacgataggggcttctttttcgacttatggggccgggggacccgcgtgatagtcagtagcgcctccacaaagggaccgtctgtgtttccccatgatctgaga

SEQ ID NO: 26793 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgaagtgaagaaacccggggcctcagtcagagttagttgctggaccagcgaggacatcttcgatacaactgaactcatttactgggtgaggcaggctcctggacagggtcttgagtggataggctgggtaaagatcgtgtccgggacggtcaactttgcatctctggacttccggaatcgcatttcgttgtcacgagatcgtgacttaagcaccgcccatatggatatcagaggactgacacaggacgatactgcgacctatttttgtgctaggcaaaaattcgccagtcggtactccggcgaccagggttcttattttgatctatgggggcgcggaacactcattatcgtgagctccgcatcaaccaagggcccaagtgttttcccgcacgacctgaga

SEQ ID NO: 26794 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgagcggagccgtcaactttggctccccaaatttccgccaccgagtgtctctgtcgcgtgatagagacttgtcaacggcgtacatggatatcaggggtttaacccaggacgatacagctacttatttttgtgcccggcaaaaattcgcaagccgctacagtggggaccagggatcctattttgatctgtggggcagaggcaccctaattgttgtgtctagcgcctccacaaaggggccgtcagtcttcccccatgacctcagg

SEQ ID NO: 26795 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgtcaactttggctccctggatttccgccaccgaatctctttgacgcgtgacagagatttatttaccgcgcatatggacattaggggtctgacacagggggatactgctacctacttctgtgcccggcaaaaatttgaatcgcgctatacaggaggccagggctggtacttcgacctatgggggagaggaacccacatcgtggtttcaagcgcaagtgccaagggtccatccgtgtttccgcatgatctcagg

SEQ ID NO: 26796 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgccatgaagaaacccggggcttcagtgagagtcagttgctggaccagcgaagacatcttcgagaggacagaactcatttactgggttcggcaggcacctggacgcggtcttgagtggataggctgggtgaagactgtatccgggacggtgaactttggatcttcggatttccgaaatcgtatctcactgaccagagacagggatttgagcacagcccatatggacattcggggcttaactcaggatgacaccgcgacatatttttgtgctcgccagaaattcgaaagtctgtactccgatgaccaaggttcttattttgatctatgggggagaggaaccctcatcgtcgtgagctccgcctcaactaagggcccaagtgttttcccgcccaggagcgca

SEQ ID NO: 26797 - RNA, 426 nt, synthetic construct
  misc_feature 1..426: note = derived and/or modified sequence opt3 from anti-HIV-1_HeavyChain
  source 1..426: mol_type = other RNA
caggtgcacatggagcaagccggcgggggagtcaagaaacccggtgctagcgttaccctgtcctgcaagacagcagacgaagatgtgttcgacgccgcgtacatgcattgggtaagacaggctcctggccagacttttgagtggctcgggtggatgaaaccagtgacgggagccgtcaactatgcaaggaagttccagggccgggtgtctttttaccgcacccgagaacttggtatcgcctatatggatctgcgtaatttgagattcgacgatacagctgtttacttttgtgcaaggaaaactaagggggacgtgtcaggagatgaccggggcttctttttcgatttatggggccgcgggaccagagtcattgtgagtagcgcctccacaaagggaccgctgaggtcttttccccggcgctcggct

SEQ ID NO: 26798 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgtcaactttggctccctggatttccgccaccgaatctctttgacgcgtgacagagatttatttaccgcgcatatggacattaggggtctgacacagggggatactgctacctacttctgtgcccggcaaaaatttgaatcgcgctatacaggaggccagggctggtacttcgacctatgggggagaggaacccacatcgtggtttcaagcgcaagtactaagggtccatccgtgtttccgacaatttatgtc

SEQ ID NO: 26799 - RNA, 426 nt, synthetic construct
  misc_feature 1..426: note = derived and/or modified sequence opt3 from anti-HIV-1_HeavyChain
  source 1..426: mol_type = other RNA
gagagccacctggaacagtccggctctgccatgaagaaacccggggcttcagtgagagtcagttgctggaccagcgaggacatcttcgatacaactgaactcatttactgggttaggcaagcacctggacagggtcttgagtggataggctgggtgaagatcgtatccgggacggtgaactttgcctctctggacttccggaatcgcatttcgttgtcacgagatcgtgacttaagcaccgcgcatatggatatcagaggactgacacaggacgatactgctacctatttttgtgccaggcagaaattcgcaagtcggtactccggcgaccaaggttcttattttgatctatgggggcgcggaacactcattatcgtcagctccgcctcaaccaagggcccaagtgtgttcccgcacgacctgaga

SEQ ID NO: 26800 - RNA, 429 nt, synthetic construct
  misc_feature 1..429: note = derived and/or modified sequence opt3 from anti-HIV-1_HeavyChain
  source 1..429: mol_type = other RNA
caggcccacctcgagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagatcgtgagcggagccgtcaactttggctccccaaatttccgccagcgagtgtctctgactcgtgatagagacttgtttacggcgcacatggatattaggggtttaacccaagacgatacagctacttacttctgtgcccggcagaaatttgcatcgcgctattcaggggaccagggaagctacttcgatctgtggggcagaggcaccctaatcgttgtgagttccgcctctacaaaggggccgagcggactgccccctaggtcctgcgtc

SEQ ID NO: 26801 - RNA, 423 nt, synthetic construct
  misc_feature 1..423: note = derived and/or modified sequence opt3 from anti-HIV-1_HeavyChain
  source 1..423: mol_type = other RNA
caggtgcacctggtccaaagcggcgccgaggttaagaaacccggggcttccgtgaaggtatcttgcaaagcatcaggatacaccttcacaacgagtggtatccattggctcagacaggtgcctggccagaggccagaatggatggggtggattcggccgaagactggagcccgcaaccaggcgcgacaatttcagccccgtataagccttaccagagacagggctctgtccacagcctatttggatttaaattctctgacttcggcagactcaggcacctacttctgtgcccggcagacatttaaacctgatttctattttgctgaccagggttggagcttcaacctatgggggcgcggagcacactttatcgtcagttccgcctctaccaagggcccaagcgtgttcccccatgatctcaga

SEQ ID NO: 26802 - RNA, 429 nt, synthetic construct
  misc_feature 1..429: note = derived and/or modified sequence opt3 from anti-HIV-1_HeavyChain
  source 1..429: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgtcaactttggctccctggatttccgccaccgaatctctttgacgcgtgacagagatttatttaccgcgcatatggacattaggggtctgacacagggggatactgctacctacttctgtgcccggcaaaaatttgaatcgcgctatacaggaggccagggctggtacttcgacctatgggggagaggaacccacatcgtggtttcaagcgcaagtactcagggtccaattggcctcccgcccaggctgtgcgtg

SEQ ID NO: 26803 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgcatatggatatcagaggactgacacaggacgatactgctacctatttttgtgccaggcaaaaattcgcaagtcggtactccggcgaccagggttcttattttgatctatgggggcgcggaacactcattatcgtcagctccgcctcaaccaagggcccaataggcctgccgcccagaagtact

SEQ ID NO: 26804 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctccctggatttccggcaccgcatctctttgacgcgagaccgtgatttatttaccgcgcatatggacattagaggtctgacacagggggatactgctacctacttctgtgccaggcaaaagtttgaatcgcggtatacaggaggccagggctggtacttcgacctatgggggcgcggaacccacatcgtggtttcaagcgcaagtactaaaggtccatccgtgtttccgacaatttgcgtc

SEQ ID NO: 26805 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgttcacggctcatatggacatcaggggtctaacccagggggatacagccacttatttttgtgcacggcaaaaattcgaatcgcgctacaccggaggccagggctggtattttgacctctgggggagaggaacacacattgttgtgtcaagcgccctgcatcagggtcctatcggccttccaccgaggagtacc

SEQ ID NO: 26806 - RNA, 429 nt, synthetic construct
  misc_feature 1..429: note = derived and/or modified sequence opt3 from anti-HIV-1_HeavyChain
  source 1..429: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcgtctcgttgtcacgagatcgtgacttaagcaccgcgtatatggatattagaggactgacacaggacgatactgctacctacttttgtgccaggcaaaaattcgcaagtcggtattccggcgaccagggttcttactttgatctatgggggcgcggaacactcatcgtggttagctccgccctgcatcagggcccaattggcccgtcacccaccatccttaga

SEQ ID NO: 26807 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgcatatggatatcagaggactgacacaggacgatactgctacctatttttgtgccaggcaaaaattcgcaagtcggtactccggcgaccagggttcttattttgatctatgggggcgcggaacactcattatcgtcagctccgcctcaaccaagggcccaagtgtgttcccgactatatacgtt

SEQ ID NO: 26808 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgtatatggatatcagaggactgacacaggacgatactgctacctacttttgtgccaggcaaaaattcgagagtcggtatacaggcggtcaggggtggtactttgacctatggggacgcggcacccatattgtcgtgtcctctgcaagcactaagggcccatccgttttcccgacaatctgcgtg

SEQ ID NO: 26809 - RNA, 426 nt, synthetic construct
  misc_feature 1..426: note = derived and/or modified sequence opt3 from anti-HIV-1_HeavyChain
  source 1..426: mol_type = other RNA
caggtgcaactggtccagagcggcgccgaggttaagaaacccggggcttccgtgagagtatcttgctggacctcagaagacatcttcgatacaactgagctcatttactgggtgaggcaggcacctggacagggtcttgaatggataggctgggtcaagatcgtgagtgggacggttaactttgccagcctggacttccggaatcgcatttccttgtctcgagatcgtgacttatcgaccgcgcacatggatatcagaggactgacacaagacgatactgctacctatttttgtgccaggcagaaattcgagtcacggtacacaggcggtcaggggtggtattttgacctatggggacgcggcacccatattgtggtcagcagtgcatccactaagggcccatctgtgttcccgacaatctgcgta

SEQ ID NO: 26810 - RNA, 426 nt, synthetic construct
  misc_feature 1..426: note = derived and/or modified sequence opt3 from anti-HIV-1_HeavyChain
  source 1..426: mol_type = other RNA
agaaggcacctggagcagagcggctccggggtgaagaaacccggagcctctgtccgggtttcatgctggagtagcgaagacatcttcgagcgcaccgaactcattcattgggtgcgacaagctcctggtcagggccttgagtggatagggtgggtaaagacagtgactggagcagtcaactttggctccctggatttccgtcacagaatctctttgacgagggaccgggatttatttaccgcccatatggacattcgcggtctgacacagggggatactgcgacctacttctgtgctagacagaaatttgaatcgaggtatacaggaggccaaggctggtacttcgacctatgggggcggggaacccacatcgtggtttcaagcgccagtactaagggtccatccgtgtttccgcatgatctccgc

SEQ ID NO: 26811 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgtatatggatatcagaggactgacacaggacgatactgctacctacttttgtgccaggcaaaaattcgagagtcggtattccggcgaccagggttcttactttgatctatgggggcgcggaacactcattatcgtcagctccgcatcaaccaagggcccaagtgtgttcccgactatatgcgtt

SEQ ID NO: 26812 - RNA, 429 nt, synthetic construct
  misc_feature 1..429: note = derived and/or modified sequence opt3 from anti-HIV-1_HeavyChain
  source 1..429: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcctggatttccgccaccgaatctccttgacccgtgacagagatttatttacagcgcatatggacattaggggtctgactcagggggataccgctacatacttctgtgcccggcaaaaatttgaatctcgctataccggaggccagggctggtacttcgacctatgggggagaggaactcacatcgtggtttcgtcagcaagcacaaagggtccacatccggtgtttccccacgatctccct

SEQ ID NO: 26813 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaactcggagcttctgtcagagtttcatgctggaccagtgaagacatcttcgagaggacagaacttatttactgggtgcggcaggcacccggtcagggcctggagtggatagggtgggtaaagatcgtgagcggaactgtcaactttgcctccttggatttccgcaatcgaatttctttatcgcgtgacagagatctgtcaacggcgtatatggacatcaggggcctaacccaggatgacacagctacttacttttgtgcccggcaaaaattcgcaagccgctatagtggtgatcaggggtcctactttgacctctggggaagaggcaccctgattgtggtttctagcgcctccacaaagggcccttcagtgttcccaaccatctatgtc

SEQ ID NO: 26814 - RNA, 429 nt, synthetic construct
  misc_feature 1..429: note = derived and/or modified sequence opt3 from anti-HIV-1_HeavyChain
  source 1..429: mol_type = other RNA
caggcccacctggagcaaagcggctccggggtgaagaaacccggagcttctgtcagagtttcatgctggaccagtgaagacatcttcgagaggacagaactcattcattgggcacggcaggcccctggtcagggccttgagtggatagggtgggtgaagactgtaacgggagcggtgaactttggcagcctggatttccgccaccgaatctccttgacccgtgacagagatttatttacagctcatatggacattaggggtctgactcagggggataccgccacatacttctgtgcacggcaaaaatttgaatctcgctataccggaggccagggctggtacttcgacctatgggggagaggaactcacatcgtcgtgtcgtcagccagcacaaagggtccactcggcctgccgcccaggcttagtcgg

SEQ ID NO: 26815 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgcatatggatatcagaggactgacacaggacgatactgctacctatttttgtgccaggcaaaaattcgcaagtcggtactccggcgaccagggttcttattttgatctatgggggcgcggaacactcattatcgtcagctccgcctcaaccaagggcccaagtggcctgccgcccagaagcgct

SEQ ID NO: 26816 - RNA, 426 nt, synthetic construct
  misc_feature 1..426: note = derived and/or modified sequence opt3 from anti-HIV-1_HeavyChain
  source 1..426: mol_type = other RNA
caggtgcaactggtccagagcggcgccgaggttaagaaacccggggcttccgtgagagtatcttgctggacctcagaagacatcttcgatacaactgagctcatttactgggtgaggcaggcacctggacagggtcttgaatggataggctgggtcaagatcgtgagtgggacggttaactttgccagcctggacttccggaatcgcatttccttgtctcgagatcgtgacttatcgaccgcgcacatggatatcagaggactgaggcaagacgatacagctacttatttttgtgcccggcagaaattcgagtcacgctacagcggcgaccagggtagttattttgatctatgggggagaggaaccctcattatcgtgtcctctgcaagcacaaagggcccatccgtcttcccgcatgacctgagg

SEQ ID NO: 26817 - RNA, 426 nt, synthetic construct
  misc_feature 1..426: note = derived and/or modified sequence opt3 from anti-HIV-1_HeavyChain
  source 1..426: mol_type = other RNA
gaggcccacctggaacagagcggctccggggtgaagaaacccggagcttctgtcagagtttcatgctggaccagtgaggacatcttcgaaaggacagagctcattcattgggtgcggcaagcacctggtcagggccttgaatggatagggtgggtaaagatcgtgagcggaactgtcaactttgcctccctggatttccgcaatcgaatttctttgtcgcgtgacagagatttatcaacggcgtacatggacatcaggggcctgacccaggatgacacagctacttatttttgtgcccggcagaaattcgcaagccgctacagtggtgatcaagggtcctattttgacctatggggaagaggcaccctcattgtggtttctagcgcctccacaaagggcccatcagtgttcccgcacgatctgagg

SEQ ID NO: 26818 - RNA, 423 nt, synthetic construct
  misc_feature 1..423: note = derived and/or modified sequence opt3 from anti-HIV-1_HeavyChain
  source 1..423: mol_type = other RNA
caggtgcaactggtccagagcggcgccgaggttaagaaacccggggcttccgtgaaggtatcttgcagagcatcaggatacaccttcggtaaccacgccatcagttgggtgaggcaggcgcctggccaggggctcgaatggatgggatggattcggccaaaaacaggcgctcgcaatcaagcccgacagtttcagccgcgtataagccttactagagacagggcactgtccacggcctatttggatttaaactctctgacctcggctgactcaggtacatacttctgtgcacggcagacttttaagcccgatttctattttgccgaccaagggtggagcttcaatctatggggacgcggcgctcattttatcgtcagttccgcctctaccaaaggccctagcgtgttcccacacgatctcaga

SEQ ID NO: 26819 - RNA, 429 nt, synthetic construct
  misc_feature 1..429: note = derived and/or modified sequence opt3 from anti-HIV-1_HeavyChain
  source 1..429: mol_type = other RNA
cagggccacaacctggagcaaagcgggtccgaagtgaagaaacccggagcctctgtcagagtttcatgctggaccagtgaggacatcttcgaaaggacagagctcattcattgggtgcggcaggctcctggtcagggccttgaatggatagggtgggtaaagactgtgacgggagcagtcaattttggcagcctggatttccgccaccgaatctccttgacccgtgacagagatttatttacagcccatatggacattaggggtctgactcagggggataccgcgacatacttctgtgctcggcaaaaatttgagtctcgctataccggaggccagggctggtacttcgacctatgggggagaggaactcacatcgtggtttcgtcagccagcacaaagggtccaagtgtgtttccgcatgatctcagg

SEQ ID NO: 26820 - RNA, 426 nt, synthetic construct
  misc_feature 1..426: note = derived and/or modified sequence opt3 from anti-HIV-1_HeavyChain
  source 1..426: mol_type = other RNA
cccaccacatggaacaagagcggctccgacgtgaaaaagcctggggcctctgtcagagtttcatgctggacgagtgaggatatcttcgaaaggactgagctgattcactgggtgcggcaggctccaggacaaggtctcgaatggataggctgggtaaaaaccgtgacaggggcagtcaattttggaagcccgaacttccgccatcgagtgtcccttactcgtgacagagatctgtctaccgcccacatggacatcaggggcttgacacaggatgacaccgcgacttacttttgtgctcggcagaagttcgagtcgttatattcagatgaccagggtagctactttgatctgtgggggcgcggaacactaattatcgttagttccgcctctaccaaaggccccagcgtgttccctcatgacctcaga

SEQ ID NO: 26821 - RNA, 432 nt, synthetic construct
  misc_feature 1..432: note = derived and/or modified sequence opt3 from anti-HIV-1_HeavyChain
  source 1..432: mol_type = other RNA
cacgtgaccccctggaacgagtacgtcggcagagccatgaagaaacctgggaggagcgttcgggtgtcctgctggacatctgaagacatcttcgatactacggagctgatttattgggtacgccaggctccaggacaaggtctcgaatggataggctgggtgaagatcgtctcagggaccgtgaattttgcaagtcttgacttccgaaaccgtattagcctgtccagagatagggacttgtctacagcctacatggatatccggggattaactcaggacgataccgcgacatatttttgtgctcgccagaaattcgcctcgagatactcaggcgaccagggtagctattttgatctgtgggggaggggaaccctaattgttgtgagttccgcatctactaagggcccgagcgtcttcccccatgacctccgg

SEQ ID NO: 26822 - RNA, 372 nt, synthetic construct
  misc_feature 1..372: note = derived and/or modified sequence opt3 from anti-HIV-1_HeavyChain
  source 1..372: mol_type = other RNA
caggtgcaactggtccagagcggcgccgaggttagaaggcccggggcttccgtgaaggtatcttgcaaagcatcaggattcagttttctcggtcactacatccattgggtgcggcaggcccctggccaggggcttgaatggattggatgggtcaaggcggtgagcggcgctgttaactatggttccctggacttccgccaccgagtgtctttgacccgtgatagagacttatcgacagcccatatggatataagggggctgactcaagacgatacggcaacctacttttgtgcccggcagaaattcgctcgcggagaccagggctggtttttcgatctatggggcagagggacactcatcgtcgtgtcaagc

SEQ ID NO: 26823 - RNA, 372 nt, synthetic construct
  misc_feature 1..372: note = derived and/or modified sequence opt3 from anti-HIV-1_HeavyChain
  source 1..372: mol_type = other RNA
caggtgcaactggtccagagcggcgccgaggttaagaaacccggggcttccgtgaaggtatcttgcaaagcatcaggatacaccttcacaagttatggtatcagctgggtgagacaggcccctggccaggggctcgaatggattggatgggtcaagatagtgtccggcgcggttaactttggttctccaaatttcaggcaacgggtgtcgcttactcgcgaccgagatctgtttacggctcacatggacatccgtgggttgacccagggagatacagccacttacttctgtgcaagacagaaatttgagaggggcggccaggggtggattttcgacttatggggacggggtaccctgatcgccgtctcaagc

SEQ ID NO: 26824 - RNA, 372 nt, synthetic construct
  misc_feature 1..372: note = derived and/or modified sequence opt3 from anti-HIV-1_HeavyChain
  source 1..372: mol_type = other RNA
caggtgcaactggtccagagcgaggccgaagttaagaaacccggcgcttccgtgaagatctcttgcgcaacctcagggtacgccttcacactctattaccttcactgggtaagacaggcgcctggacagggtctggagtggattggctgggtgaaaactgtcacgggggctgtgaactttggaagtgcctatttcaggcatcgggttagcttgacccgcgaccgagatttatttacagcacacatggacatacgtggcctgactcaaggtgataccgccacatacttctgtgctagacagaagttttataaagggggacagggctggtacttcgacctatggggcagggggaccctcatcgtggtctcctct

SEQ ID NO: 26825 - RNA, 372 nt, synthetic construct
  misc_feature 1..372: note = derived and/or modified sequence opt3 from anti-HIV-1_HeavyChain
  source 1..372: mol_type = other RNA
caggcccacctggagcaaagcggctccggggtgaagaaacccggagcttctgtcagagtttcatgctggaccagtgaagacatcttcaagacagagctcattcattgggtgaggcaggcacctggtcagggccttgaatggatagggtgggtaaaaactgtgacgggagccgtcaactttggcagcccaaatttccggcaccgcgtgtccctgacccgagatcgtgacttgtttacagcgcatatggatatcagaggtttaactcagggggacaccgctacatacttctgtgccaggcaaaagtttgagcggggaggccagggctggtatttcgatctgtgggggcgcggaaccctaattgttgtgtcttcg

SEQ ID NO: 26826 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcgcggcctggagtggatagggtgggtaaaggccgtgagcggagcggtcaactacggctccttggattttcgacaccgtgtgcctttaactagagacagggatctgttcacggctcatatggacatccggggtctaacccaggatgacacagccacttatttttgtgcacgccagaaattcgccagaggggatcaaggatggtttttcgacctctggggcaggggcaccctgattgttgtgtcttcg

SEQ ID NO: 26827 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggacccctgaagacatcttcgagaggacagaactcattcattgggtgcggcaggcaccaggtcagggccttgagtggatagggtgggtaaagatcgtgagtggagccgtcaactttggcagcccgaatttccgccagcgagtgtccctgactcgtgatagagacttgtttacggcgcacatggatattaggggtttaacccaaggggacacagctacttacttctgtgcccggcagaaatttgaacgcggaggccagggctggatcttcgatctgtgggggagaggaaccctaattgcagtttcttcg

SEQ ID NO: 26828 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcgcttccggcgtgaagagacccggggcatctgtcagggtttcatgctggaccagtgaagacatcttcgagggaagcgaactcattcattgggtgcggcaggcccctggtcagggccttgagtggatagggtgggtaaaaacagtgactggagcggtcaactttggctccgcttacttccgccaccgagtgtctctgacgcgtgatagagacttgtttaccgcccatatggatatcaggggtttaacacagggggacactgcaacctatttctgtgcccggcaaaagttttacaaaggaggccagggctggtatttcgatctgtgggggcgcggaacactaattgttgtgtcgtca

SEQ ID NO: 26829 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgagcggagccgtcaactttggctccccaaatttccgccaccgagtgtctctgacgcgtgatagagacttgtttaccgcgcatatggatatcaggggtttaacacagggggacactgctacctacttctgtgcccggcaaaaattttatgcaggaggccagggctggtacttcgatctgtgggggcgcggaacactaattgttgtgtcgtca

SEQ ID NO: 26830 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggagtagcgaagacatcttcgagagggcagaactcattcattgggtgcggcaggcccctggtcagggccttgagtggatagggtgggtaaagaccgtgacaggagcggtcaactttggctccccaaatttccgccagcgagtgtctctgactcgtgatagagacttgtttacggctcacatggatatcaggggtttaacccaaggggacacagccacttacttctgtgcacggcagaaatttgaacgcggaggccagggctggattttcgatctgtgggggagaggaaccctaatcgccgtttcgtca

SEQ ID NO: 26831 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcctggatttccgccaccgaatctccttgacccgtgacagagatttatttacagcgcatatggacattaggggtctgactcagggggataccgctacatacttctgtgcccggcaaaaatttgaacgcggaggccagggctggtatttcgacctatgggggagaggaaccctcatcgtggtttcttcg

SEQ ID NO: 26832 - RNA, 375 nt, synthetic construct
  misc_feature 1..375: note = derived and/or modified sequence opt3 from anti-HIV-1_HeavyChain
  source 1..375: mol_type = other RNA
caggtgcacctggagcaaagcggctccggggtcaagaaactcggagcctctgttagagtgtcatgctggaccagtgaagacatcttcgagaggacagaacttattcattgggtacggcaggctcccggtcagggcctggagtggatagggtgggtgaaggcagtcagcggagccgtgaactacggctccttggattttcgccaccgagtttctttaactcgtgacagagatctgtcgacggcgcatatggacatcaggggtctaacccaggatgacacagctacttatttctgtgcccggcaaaaatttgcacgcggggatcagggatggttctttgacctctggggcagaggcaccctgattgtggtctcaagc

SEQ ID NO: 26833 - RNA, 375 nt, synthetic construct
  misc_feature 1..375: note = derived and/or modified sequence opt3 from anti-HIV-1_HeavyChain
  source 1..375: mol_type = other RNA
caggcctacctggagcaaagcggctccatcatgaagaaacccggggcttctgtgagagtctcatgctggaccagtgaagacattttcgataggacagagctcatatattgggttcggcaggcacctggacagggtcttgaatggatcggctgggtgaagattgtaagcggggccgtgaactttggatccctggacttccgcaatcgagtctctttgactcgtgatagagacttatttacggcgcacatggatatcaggggcctgacccagggtgacacagctacttacttctgtgcccggcaaaaatttgagcgcgggggacagggctggtatttcgatctatggggcagagggaccctcattgtggtttcgtca

SEQ ID NO: 26834 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattaactgggtgcggcaggcacctggtcagggccttgagtggatagggtgggtaaaggccgtgagcggagcggtcaattacggctccctggattttcgccatcgagtgtctttgactcgtgacagagatttatcgacggctcacatggacatcaggggtctgacccaggatgacacagccacttatttctgtgcacggcaaaaatttgcccgcggggatcagggatggttctttgacctatggggcagaggcaccctcattgttgtgtcaagc

SEQ ID NO: 26835 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgtcaactttggctccctggatttccgccaccgaatctctttgacgcgtgacagagatttatttaccgcgcatatggacattaggggtctgacacagggggatactgctacctacttctgtgcccggcaaaaatttgaacgcggaggccagggctggtatttcgacctatgggggagaggaacactcatcgtggtttcgtca

SEQ ID NO: 26836 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggaacctctgtcagagtttcatgctggacaagtgaagacatcttcgagaggactgaactcattcattgggtgcggcaggctcctggtcagggccttgagtggatagggtgggtaaagatcgtgagcggagcagtcaactttggctccccaaatttccgccagcgagtgtctctgacgcgtgatagagacttgtttaccgcccacatggatattaggggtttaacacaaggggacactgcgacctacttctgtgctcggcagaaatttgaacgcggaggccagggctggatcttcgatctgtgggggagaggaacactaattgccgtttcgtca

SEQ ID NO: 26837 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtggtgacatcttcgaaaggacagagcttattcattgggtgcggcaggcacccggccaggggctggaatggataggatgggtaaaggccgtgagcggcgcggtcaactacggttccttggattttcgccaccgagtgtctttaactcgtgacagagatctgttcacggctcatatggacatcagggggctaacccaggatgacacagccacttatttttgtgcacggcaaaaattcgcccgcggagatcagggctggtttttcgacctctggggcagagggaccctgattgttgtgtcgtca

SEQ ID NO: 26838 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagatcgtgagcggagccgtcaactttggctccccaaatttccgccagcgagtgtctctgactcgtgatagagacttgtttacggcgcacaccgatattaggggtttaacacaaggggacactgctacctacttctgtgcccggcagaaatttgaacgcggaggccagggctggtatttcgatctgtgggggagaggaacactaatcgttgtgtcgtca

SEQ ID NO: 26839 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgcctcgcaagtgaagacatcttcgagaggaccgaacttattcattgggtgcggcaggcccctggtcagggcctggagtggatagggtgggtaaagacagtgactggagcggtcaactttggcagcccaaatttccgccaccgagtgtccttgacgcgtgatagagacttatttaccgctcatatggatatcaggggtctgacacagggggacactgccacctacttctgtgcacggcaaaaatttgaacgcggaggccagggctggtatttcgatctatgggggagaggaacactcattgttgtgtcttcg

SEQ ID NO: 26840 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggcgctggggtgaagagacccggagcatccgtcagggtttcttgctggacctcagaagacatcttcgagacaactgaactcattcattgggtgcggcaggcccctggtcagggccttgagtggatagggtgggtaaaaacggtgagtggagcggtcaactttggcagcctgaatttccgccaccgagtgtccttgacccgtgatagagacttatttacagctcatatggatatcaggggtctgactcagggggacaccgccacatacttctgtgcacggcaaaagtttgcccgcggagatcagggctggttctttgacctatggggcagagggaccctcattgttgtgtcttcg

SEQ ID NO: 26841 - RNA, 375 nt, synthetic construct
  misc_feature 1..375: note = derived and/or modified sequence opt3 from anti-HIV-1_HeavyChain
  source 1..375: mol_type = other RNA
agacacacctggaacaagagcggctccggggtgaaaaagcccggagcctctgtcagggtttcatgctggacaagtgaggacatcttcgagaaaagcgaactgattcattgggtgcggcaggctcctggtcaaggcctcgaatggatagggtgggtaaagactgtgacgggagcagtcaattttggctcctctgatttccgccagcgagtgtcgcttacccgtgacagagatctgtttacagcccacatggacatcaggggtttgactcagggggataccgcgacatacttctgtgctcggcagaaattttatgccggaggccaaggctggtacttcgacttatgggggcgcggaaccctgattgttgtgtcaagc

SEQ ID NO: 26842 - RNA, 375 nt, synthetic construct
  misc_feature 1..375: note = derived and/or modified sequence opt3 from anti-HIV-1_HeavyChain
  source 1..375: mol_type = other RNA
ggcacccccgggagcgagtccggatctggtgtgaagaaacctggcgcctcagtcagagttagttgctggacaagcgaagacatcttcgagaggactgaactgattcactgggtgcggcaggctccagggcaaggactcgagtggataggctgggtaaagatcgtgtccggtgcagtcaactttgggtctccgaatttccgccagcgagtgtcgcttacgcgtgatagagacctgtttaccgcccatatggatattaggggattgacacagggcgacactgcgacctacttctgtgctcggcagaaatttgaacgcggcgggcaaggatggatcttcgatttatggggtagaggcacactgattgccgtttcaagc

SEQ ID NO: 26843 - RNA, 378 nt, synthetic construct
  misc_feature 1..378: note = derived and/or modified sequence opt3 from anti-HIV-1_HeavyChain
  source 1..378: mol_type = other RNA
caggtgcaactggtccagagcggcaccgaggttcagaagcccggggcctccgtgaaagtatcttgcaaggctttcggatactcatttacagactattacgtgtattgggtcagacaggcacctggtcaaggcctcgaatacgtggcctggatcaacccaagtaatgggtatactaaatacgcgcagaagttccaggattgggttacgcttaccagggacagctccattaacacagcttatctgcagttggcccgggtgacttctgatgacaccgcaatatactactgtgcccgccaaaaatttgcttcgcgatattcaggagatcagggcagctacttcgacttatggggtcgtgggacactgatcgtcgtgagttcc

SEQ ID NO: 26844 - RNA, 378 nt, synthetic construct
  misc_feature 1..378: note = derived and/or modified sequence opt3 from anti-HIV-1_HeavyChain
  source 1..378: mol_type = other RNA
caggtgcaactggtccagagcggcgccgctgttaagaaacccgggtcctctgtgaaggtatcatgcaaagcaagtggatacatcttcaccggttattacattcactggataagacaggcccctggccaggggctcgagtggatgggatggatcaacccaagcacaggcgacactaagtttgcgaggcaattccagggtcgggtgtccttttatcgcacgcgagaacttgggattgcttacatggatctgcgtgacttgaaattcgatgacaccgccgtctatttttgtgcaagaaagacaaagggagatgtgtctggcgacgataggggcttctttttcgacttatgggggcggggaactcgcgttatcgtgtcgtca

SEQ ID NO: 26845 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgctgggatgaagaaacccggagcaagcatgaccgtctcctgcaagacagccgacgaagatatcttcgacgcggcttatatgcactgggttagacaggcccctggtcagacttttgagtggctgggctggatgaaaccagtgacgggggcagtaaactacgccaggcagttccaaggacgggtgtctttttatcgcacccgagaactcggcattgcttacatggatcttcgtgacctgaagttcgatgacacagcagtctatttttgtgccagaaaaactaagggtgatgtgtcaggggacgataggggattctttttcgacttgtggggccggggcacccgcgttatagtgagtagc

SEQ ID NO: 26846 - RNA, 381 nt, synthetic construct
  misc_feature 1..381: note = derived and/or modified sequence opt3 from anti-HIV-1_HeavyChain
  source 1..381: mol_type = other RNA
caggtgttcatggagcaagccggcgggggaatgaagaaacccggtgctagcatgaccgtctcctgcaagacagcagacgaagatgtttttgacgccgcgtacatgcactgggtgagacaggctcctggccagactttcgagtggctggggtggatgaaaccagtaacgggagccgtgaactatgcaaggaagtttcagggccgggtctctttctaccgcacccgagaactcggtatcgcctatatggatcttcgtgacctgaaatttgatgacacagctgtgtacttctgtgcaagaaagactaagggggatgtttcaggagacgataggggctttttctttgacttgtggggccgggggacccgcgtgattgtcagtagc

SEQ ID NO: 26847 - RNA, 381 nt, synthetic construct
  misc_feature 1..381: note = derived and/or modified sequence opt3 from anti-HIV-1_HeavyChain
  source 1..381: mol_type = other RNA
caggtgttcatggagcaagccggcgggggaatgaagaaacccggtgctagcatgaccgtctcctgcaagacagcagacgaagatgtttttgacgccgcgtacatgcactgggtgagacaggctcctggccagactttcgagtggctggggtggatgaaaccagtaacgggagccgtgaactatgcaaggcagtttcaaggccgggtctctttctaccgcacccgagaactcggtatcgcctatatggatcttcgtgacctgaagtttgatgacacagctgtgtacttctgtgcaagaaaaactaagggggatgtttcaggagacgataggggctttttctttgacttgtggggccgggggacccgcgtgattgtcagtagc

SEQ ID NO: 26848 - RNA, 381 nt, synthetic construct
  misc_feature 1..381: note = derived and/or modified sequence opt3 from anti-HIV-1_HeavyChain
  source 1..381: mol_type = other RNA
caggtgcacatggagcaagccggcgggggagtcaagaaacccggtgctagcgttaccctgtcctgcaagacagcagacgaagatgtgttcgacgccgcgtacatgcattgggtaagacaggctcctggccagacttttgagtggctcgggtggatgaaaccagtgacgggagccgtctcttatgcaaggaagttccagggccgggtgtcattttacatgacccgcgaacttggtatggcctatatggatctgcgaaacttgcgtttcgacgatacagctgtttacttttgtgcaagaaaaactgccggggacgtgagtggagataataggggctatttctttgacttatggggccgggggagccgcgtcatcgtgtcctct

SEQ ID NO: 26849 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggaatgaagaaacccggtgctagcatgaccgtctcctgcaagacagcagacgaagatatcttcgacgccgcgtatatgcactgggttagacaggctcctggccagacttttgagtggctggggtggatgaaaccagtgacgggagccgtaaactacgcaaggcagttccaaggccgggtgtctttttatcgcacccgagaactcggtatggcctacatggatcttcgtaatctgagattcgacgatacagctgtctatttttgtgcaaggaagactgccggggacgtgtcaggagataaccggggctacttctttgacttgtggggccgcgggagtagagttattgtgagctcc

SEQ ID NO: 26850 - RNA, 381 nt, synthetic construct
  misc_feature 1..381: note = derived and/or modified sequence opt3 from anti-HIV-1_HeavyChain
  source 1..381: mol_type = other RNA
caggtgtacatggagcaagccggcgggggagtcaagaaacccggtgctagcgttaccctgtcctgcaagacagcagacgaagatgtgttcgacgccgcgtatatgcactgggtaagacaggctcctggccagacttttgagtggctcgggtggatgaaaccagtgacgggagccgtctcttacgcaaggaagttccagggccgggtgtcattttatatgacccgcgaacttggtatggcctacatggatctgcgaaacttgcgtttcgacgatacagctgtttatttttgtgcaagaaaaactgccggggacgtgagtggagataataggggctacttctttgacttatggggccgggggagctgggtcatcgtgtcctct

SEQ ID NO: 26851 - RNA, 381 nt, synthetic construct
  misc_feature 1..381: note = derived and/or modified sequence opt3 from anti-HIV-1_HeavyChain
  source 1..381: mol_type = other RNA
caggtgcaactggtccagagcggcgccgaggttaagaaacccggggcttccgtgaccctctcttgcaagacagcagacgaagatgtattcgacgccgcgtacatgcactgggtgagacaggctcctggacagacttttgagtggcttggttggatgaaaccagtcacgggcgccgtgaactatgcaaggaagttccaagggcgggtttcattttaccgcacccgagaactgggaatcgcctatatggatttgcgtaatttaagattcgacgatacagctgtgtacttttgtgcaaggaaaactgccggcgacgtcagtggtgataagcgggggttctttttcgacctgtggggacgcggcagcagagtgattgtatcctct

SEQ ID NO: 26852 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtggattaagcaccgcgtatatggacatcagaggcctgacacaggatgacactgctacctacttttgtgccaggcaaaaattcgcaagtcggtattccggtgatcaggggtcttactttgacctatggggacgcggcacactcattgtcgtgagctcc

SEQ ID NO: 26853 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcgcttccggcgtgagaaggcccggggcatctgtccgggtttcatgctggaccagtgaagacatcttcgagcgcagcgaactcatttactgggtgcgacaggcccctggacgtggtcttgagtggataggctggatcaagctggtatccggggcggtgaactttggatctgtcgatttcagagacagggtgtcgttgacacgggatcgcgacttatttactgctcatatggatattagaggcctgacgcagggtgacaccgccacatatttctgtgcaaggcagaaatttgaatcacggtacactgggggacaaggctggtatttcgatctatggggccgcgggacccacatcgttgtgagcagt

SEQ ID NO: 26854 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactacggcagcctgaattttcgctcccgaatctctttgacccgtgatagagacttattcacagcgcacatggatattaggggtctgactcagggggacaccgctacatatttttgtgcccggcaaaaattcgaatcgcgctacaccggaggccagggctggtattttgatctatgggggagaggaactcatatcgtggtttcaagc

SEQ ID NO: 26855 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgagcggagccgtcaactttggctccccaaatttccgccaccgagtgtctctgacgcgtgatagagacttgtttaccgcgcatatggatatcaggggtttaacacagggggacactgctacctacttctgtgcccggcaaaaatttgaatcgcgctatacaggaggccagggctggtacttcgatctgtgggggagaggaacccacattgttgtgtcaagc

SEQ ID NO: 26856 - RNA, 384 nt, synthetic construct
  misc_feature 1..384: note = derived and/or modified sequence opt3 from anti-HIV-1_HeavyChain
  source 1..384: mol_type = other RNA
caggtgcacctggagcaaagcggctccggggtcaagaaacccggagcctctgttagagtgtcatgctggagtagcgaagacatcttcgagaggaccgaactcattcattgggtacggcaggctcctggtcagggccttgagtggatagggtgggtgaagacagtcactggagcagtgaactttggctccctggatttccgccaccgaatctctttgacgcgtgacagagatttatttaccgcccatatggacattaggggtctgacacagggggatactgcgacctacttctgtgctcggcaaaaatttgaatcgcgctatacaggaggccagggctggtacttcgacctatgggggagaggaacccacatcgttgtgtcaagc

SEQ ID NO: 26857 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgggacgagatcgtgacttatcaaccgcgtatatggatatcagaggcctgacacaggacgatactgctacctacttttgtgccaggcaaaaattcgcaagccggtatagtggtgaccaggggtcctactttgatctatggggacgcggcacactcattgtcgtgtctagc

SEQ ID NO: 26858 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggaaccgtcaactttggcagcctgaatttccgccagcgagtgtccttgacacgtgatagagacttatttactgcccacatggatatcaggggtctgacccaaggggacacagcgacctacttctgtgctcggcagaaatttgaatctcgctatactggaggccagggctggtacttcgatctatgggggagaggaacacatattgttgtgtcgtca

SEQ ID NO: 26859 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaaggaatcttcgacacaactgagctcatttactgggttaggcaggcacctggtcagggccttgaatggatagggtgggtgaagatcgtatccggaacggtgaactttgcctctctggatttccggaatcgcatttcgttgtcacgagaccgtgatttaagcaccgcgtatatggacatcagaggcctgacacaggatgacactgctacctacttttgtgccaggcaaaaattcgcaagtcggtattccggtgatcaggggtcttactttgacctatggggacgcggcacactcattgtcgtgagctcc

SEQ ID NO: 26860 - RNA, 384 nt, synthetic construct
  misc_feature 1..384: note = derived and/or modified sequence opt3 from anti-HIV-1_HeavyChain
  source 1..384: mol_type = other RNA
cagagcagactggagcaatccggctctgccatgaagaaacccggggcttcagtgagggtcagttgctggaccagcgaagacatcttcgatacaactgagctcatttactgggttcggcaggcacctggacagggtcttgaatggataggctgggtgaagatcgtatccgggacggtgaactttgcctctctggacttccgcaatcgaatttcgttgtcacgtgatagagacttaagcaccgcgcacatggatatcaggggactgacacaggacgatactgctacctatttttgtgcccggcaaaaattcgcaagtcgctactccggcgaccagggttcttattttgatctatgggggagaggaacactcattatcgtcagctcc

SEQ ID NO: 26861 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagtttgaatcacggtatacaggaggccagggctggtacttcgacctgtgggggcgcggaacccatattgttgtgagcagt

SEQ ID NO: 26862 - RNA, 384 nt, synthetic construct
  misc_feature 1..384: note = derived and/or modified sequence opt3 from anti-HIV-1_HeavyChain
  source 1..384: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctcttcggacttccggaatcgcatttcactgagccgagatcgtgacttgagtaccgcgtatatggatatcagaggattaacacaggacgatactgctacctacttttgtgccaggcaaaaattcgcatcccggtattctggcgaccagggtagctactttgatctgtgggggcgcggaacactaattatcgtctcctca

SEQ ID NO: 26863 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagatcgtgagcggaactgtcaactttgcctccctggatttccgcaatcgaatttctttgtcgcgtgacagagatttatcaacggcgtacatggacatcaggggcctgacccaggatgacacagctacttatttttgtgcccggcaaaaattcgcaagccgctacagtggtgatcaggggtcctattttgacctatggggaagaggcaccctcattgtggtttctagc

SEQ ID NO: 26864 - RNA, 384 nt, synthetic construct
  misc_feature 1..384: note = derived and/or modified sequence opt3 from anti-HIV-1_HeavyChain
  source 1..384: mol_type = other RNA
agacacacctgggagcagagcggctccggggtgaagaaacccggagcctctgtcagggtttcatgctggagtagcgaagacatcttcgagcggacagaactgattcattgggtgcgccaagctcctggtcagggcctcgagtggatagggtgggtaaagactgtgacgggagcagtcaactttggctcccttgatttccgacaccgtatctctctgaccagagacagggatttgtttacagcccatatggacattcggggtttaactcagggggataccgcgacatacttctgtgctcgccagaaatttgaatcgagatataccggaggccaaggctggtacttcgacctgtgggggaggggaactcacatcgtggtttcaagc

SEQ ID NO: 26865 - RNA, 384 nt, synthetic construct
  misc_feature 1..384: note = derived and/or modified sequence opt3 from anti-HIV-1_HeavyChain
  source 1..384: mol_type = other RNA
agacacacctgggagcagagcggctccggggtgaagaaacccggagcctctgtcagggtttcatgctggacaagtgaagacatcttcgagcggactgaactgattcattgggtgcgccaagctcctggtcagggcctcgagtggatagggtgggtaaagacggtgaccggagcagtcaactttggcagccttgatttccgacaccgtatctccctgacaagagacagggatttgtttactgcccatatggacattcggggtttaacccagggggatacagcgacctacttctgtgctcgccagaaatttgaatctagatatactggaggccaaggctggtacttcgacctgtgggggaggggaacacacatcgtggtttcgtca

SEQ ID NO: 26866 - RNA, 414 nt, synthetic construct
  misc_feature 1..414: note = derived and/or modified sequence opt3 from anti-HIV-1_HeavyChain
  source 1..414: mol_type = other RNA
caggcccacctggagcaaagcggctccggggtgaagaaacccggagcttctgtcagagtttcatgctggaccagtgaagacatcttcgagaggagcgaactcattcattgggtgcggcaggcacctggtcagggccttgagtggatagggtgggtaaagacagtgactggagccgtcaactttggctccccaaatttccgccaccgagtgtctctgacgcgtgatagagacttgtttaccgcgcatatggatatcaggggtttaacacagggggacactgctacctacttctgtgcccggcaaaaatattacgcaggaggccagggctggtattttgatctgtgggggcgcggaacactaattgttgtgtcgtcagccagcaccaagggtccgagtgtcttccacgacctcaga

SEQ ID NO: 26867 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagatcgtgagcggagccgtcaactttggctccccaaatttccgccagcgagtgtctctgactcgtgatagagacttgtttacggcgcacatggatattaggggtttaacccaaggggacacagctacttacttctgtgcccggcagaaatttgaacgcggaggccagggctggatcttcgatctgtgggggagaggaaccctaattgcagtttcgtcagccagcacaaagggtccgagtgtgtttcccaccatctgcgtc

SEQ ID NO: 26868 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaagccgtgtccggagcggtcaactacggctctctggattttcggcaccgcgtgtcgttgacacgagaccgtgatttattcactgctcatatggacatcagaggtctgacgcaggatgacaccgccatttatttttgtgcaaggcaaaagttcgcccgcggggatcagggatggtttttcgacctatggggccggggcacactcatcgttgtgtcaagcgctagtactaaagggccatccgtctttccgcacgatctgaga

SEQ ID NO: 26869 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaagtcggagcttctgttagagtgtcatgctggaccagtgaagacatcttcgagaggacagaactcattcattgggtacggcaggcacccggtcagggccttgagtggatagggtgggtgaaggccgtcagcggagcggtgaactacggctccctggattttcgccaccgagtttctttgactcgtgacagagatttattcacggctcatatggacatcaggggtctgacccaggatgacacagccatttatttttgtgcacggcaaaaattcgcccgcggggatcagggatggtttttcgacctatggggcagaggcactctcatcgtggtctcgtcagctagcaccaaggggcctagtgtgtttccacacgatctgagg

SEQ ID NO: 26870 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgttcacggctcatatggacatcaggggtctaacccagggggatacagccacttatttttgtgcacggcaaaaattctacgccggaggccagggctggtattttgacctctgggggcgcggaaccctgattgttgtgtcgtcagctagcacaaagggtcctagtgtcttcccacacgatcttaga

SEQ ID NO: 26871 - RNA, 423 nt, synthetic construct
  misc_feature 1..423: note = derived and/or modified sequence opt3 from anti-HIV-1_HeavyChain
  source 1..423: mol_type = other RNA
caggtgtacatggagcaagccggcgctggggtcaagaaacccggagcaagcgttaccctgtcctgcaagacagccgacgaagatgtgttcgacgcggcttatatgcactgggtaagacaggcccctggtcagacttttgagtggctcggctggatgaaaccagtgacgggggcagtctcttacgccaggaagttccagggacgggtgtcattttatatgacccgcgaacttggcatggcttacatggatctgcgaaacttgcgtttcgacgatacagcagtttatttttgtgccagaaaaactgctggtgacgtgagtggggataataggggatacttctttgacttatggggccggggcagccgcgtcatcgtgtcctctgcctcgaccaaggggccgtcagtattcccccatgatctgaga

SEQ ID NO: 26872 - RNA, 426 nt, synthetic construct
  misc_feature 1..426: note = derived and/or modified sequence opt3 from anti-HIV-1_HeavyChain
  source 1..426: mol_type = other RNA
cagagccacctggagcaatccggctctgccatgaagaaacccggggcttcagtgagagtcagttgctggaccagcgaagacatcttcgatacaactgagctcatttactgggttaggcaggcacctggacagggtcttgaatggataggctgggtgaagatcgtatccgggacggtgaactttgcctctctggacttccggaatcgcatttcgttgtcacgagatcgtgacttaagcaccgcgtatatggatatcagaggactgacacaggacgatactgctacctacttttgtgccaggcaaaaattcgcaagtcggtattccggcgaccagggttcttactttgatctatgggggcgcggaacactcattgtcgtgagctccgcctcaaccaagggcccaagtgttttcccgactatctatgtg

SEQ ID NO: 26873 - RNA, 372 nt, synthetic construct
  misc_feature 1..372: note = derived and/or modified sequence opt3 from anti-HIV-1_HeavyChain
  source 1..372: mol_type = other RNA
caggtgcaactggtccagagcggcgccgaggttaagaaacccggggcttccgtgaaggtatcttgcaaagcatcaggaggtaccctcagtagctacgccatctcctgggtgagacaggcgcctggccaggggcttgaatggattggatgggtcaagacagtgactggcgctgttaacttcggttctgcctgttttaggcaccgggtgtcgctgacgcgcgaccgagatttgttcaccgcacatatggacatacgtgggttaacacaaggagatactgccacctatttttgcgctagacagaaattctacaagggcggccaggggtggtattttgacctgtggggaaggggtacactaatcgtcgtgtcaagc

SEQ ID NO: 26874 - RNA, 372 nt, synthetic construct
  misc_feature 1..372: note = derived and/or modified sequence opt3 from anti-HIV-1_HeavyChain
  source 1..372: mol_type = other RNA
cacgtgagactggtccagagcggcgccgaggttgaaaagcccggggcttccgtgaaagtatcttgcgagacctcaaactaccctttcaatatgtatggaatgacatgggtgaggcaagcaccaggtcagggcctcgaatggatcgggtgggtcaagattgtgagtggagccgttaactttggcagcccgaatttccggcagcgcgtgtcccttactcgagaccgtgatctgtttacggcgcatatggacataagaggtttgacccagggggatacagctacttacttctgtgccaggcaaaaatttgagcggggaggccagggctggatcttcgacttatgggggcgcggaaccctgattgcagtctcttcg

SEQ ID NO: 26875 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacgtgttcgagaggacagaacttatccattgggtacggcaggcacccggtcagggcctggagtggattgggtgggtgaaggccgtcagcggagcggtgaactacggctccttggattttcgccaccgagtttctttaactcgtgacagagatctgttcacggctcatatggacataaggggtctaacccaggatgacacagccacttatttttgtgcacggcaaaaattctacgccgggggacagggctggtattttgatctctggggccgcgggaccctgatcgtggtctcgtca

SEQ ID NO: 26876 - RNA, 375 nt, synthetic construct
  misc_feature 1..375: note = derived and/or modified sequence opt3 from anti-HIV-1_HeavyChain
  source 1..375: mol_type = other RNA
agacacacctgggagcagagcggctccggggtgaagaaacccggagcctctgtcagggtttcatgctggagtagcgaagacatcttcgagcggacagaactgattcattgggtgcgccaagctcctggtcagggcctcgagtggatagggtgggtaaagactgtgacgggagcagtcaactttggctcccttgatttccgacaccgtatctctctgaccagagacagggatttgtttacagcccatatggacattcggggtttaactcagggggataccgcgacatacttctgtgctcgccagaaatttgaaagaggaggccaaggctggtatttcgacctgtgggggaggggaaccctaatcgtggtttcgtca

SEQ ID NO: 26877 - RNA, 375 nt, synthetic construct
  misc_feature 1..375: note = derived and/or modified sequence opt3 from anti-HIV-1_HeavyChain
  source 1..375: mol_type = other RNA
agacacacctgggagcagagcggctccggggtgaagaggcccggagcctctgtccgggtttcatgctggacaagtgaagacatcttcgagactacggaactgattcattgggtgcgccaagctcctggtcagggcctcgagtggatagggtgggtaaaaaccgtgagcggagcagtcaactttggctcccttaatttccgacaccgtgtgtctctgacaagagatagggacttgtcgactgcccatatggatatccggggtttaacccaggacgatacagcgacctacttttgtgctcgccagaagttcgccagaggggaccaaggatggtttttcgatctgtggggcaggggcactctaattgttgtgtcaagc

SEQ ID NO: 26878 - RNA, 381 nt, synthetic construct
  misc_feature 1..381: note = derived and/or modified sequence opt3 from anti-HIV-1_HeavyChain
  source 1..381: mol_type = other RNA
caggtgttcatggagcaagccggcgctgggatgaagaaacccggagcaagcatgaccgtctcctgcaagacagccgacgaagatgtttttgacgcggcttacatgcactgggtgagacaggcccctggtcagactttcgagtggctgggctggatgaaaccagtaacgggggcagtgaactatgccaggcagtttcaaggacgggtctctttctaccgcacccgagaactcggcatcgcttatatggatcttcgtgacctgaagtttgatgacacagcagtgtacttctgtgccagaaaaactaagggtgatgtttcaggggacgataggggatttttctttgacttgtggggccggggcacccgcgtgattgtcagtagc

SEQ ID NO: 26879 - RNA, 384 nt, synthetic construct
  misc_feature 1..384: note = derived and/or modified sequence opt3 from anti-HIV-1_HeavyChain
  source 1..384: mol_type = other RNA
caggtgcacctggagcaaagcggctccggggtcaagaaacccggagcctctgttagagtgtcatgctggaccagtgaagacatcttcgagaggacagaactcattcattgggtacggcaggctcctggtcagggccttgagtggatagggtgggtgaagactgtcacgggagcagtgaactttggcagcctggatttccgccaccgaatctccttgacccgtgacagagatttatttacagcccatatggacattaggggtctgactcagggggataccgcgacatacttctgtgctcggcaaaaatttgaatctcgctataccggaggccagggctggtacttcgacctatgggggagaggaactcacatcgttgtgtcgtca

SEQ ID NO: 26880 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgtcgacggctcatatggacatcaggggtctaacccaggatgacacagccacttatttctgtgcacggcaaaaatttgcccgcggggatcagggatggttctttgacctctggggcagaggcaccctgattgttgtgtcaagcgctagtacaaaggggccttccgtcttcccaaccatctgcgtg

SEQ ID NO: 26881 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagttttatgcaggaggccagggctggtacttcgacctgtgggggcggggaacactaattgttgtgtcaagcgccagtaccaaaggtccatccgtctttccgactatctgcgtg

SEQ ID NO: 26882 - RNA, 417 nt, synthetic construct
  misc_feature 1..417: note = derived and/or modified sequence opt3 from anti-HIV-1_HeavyChain
  source 1..417: mol_type = other RNA
caggcccacctggagcaaagcggctccggggtgaagaaactcggagcttctgtcagagtttcatgctggaccagtgaagacgtgttcgagaggacagaacttatccattgggtacggcaggcacccggtcagggcctggagtggattgggtgggtgaaggccgtcagcggagcggtgaactacggctccttggattttcgccaccgagtttctttaactcgtgacagagatctgttcacggctcatatggacataaggggtctaacccaggatgacacagccacttatttttgtgcacggcaaaaattctacgccgggggacagggctggtattttgatctctggggccgcgggaccctgatcgtggtctcgtcagctagcacaaagggacctagtgtgttcccacacgaccttaga

SEQ ID NO: 26883 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagatcgtgagcggagccgtcaactttggctccccaaatttccgccagcgagtgtctctgactcgtgatagagacttgtttacggcgcacatggatattaggggtttaacccaaggggacacagctacttacttctgtgcccggcagaaatttgaacgcggaggccagggctggtatttcgatctgtgggggagaggaaccctaatcgttgtgtcgtca

SEQ ID NO: 26884 - RNA, 384 nt, synthetic construct
  misc_feature 1..384: note = derived and/or modified sequence opt3 from anti-HIV-1_HeavyChain
  source 1..384: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaagactgtgacgggagccgtcaactttggcagcttggatttccgccaccgaatctccttaacccgtgacagagatctgtttacagcgcatatggacattaggggtctaactcagggggataccgctacatacttctgtgcccggcaaaaatttgaatctcgctataccggaggccagggctggtacttcgacctctgggggagaggaactcacatcgtggtttcgtca

SEQ ID NO: 26885 - RNA, 426 nt, synthetic construct
  misc_feature 1..426: note = derived and/or modified sequence opt3 from anti-HIV-1_HeavyChain
  source 1..426: mol_type = other RNA
caggcccacctggagcaaagcggctccggggtgaagaaacccggagcttctgtcagagtttcatgctggagtagcgaagacatcttcgagaggaccgaactcattcattgggtgcggcaggcacctggtcagggccttgagtggatagggtgggtaaagacagtgactggagccgtcaactttggctccctggatttccgccaccgaatctctttgacgcgtgacagagatttatttaccgcgcatatggacattaggggtctgacacagggggatactgctacctacttctgtgcccggcaaaaatttgaatcgcgctatacaggaggccagggctggtacttcgacctatgggggagaggaacccacatcgtggtttcaagcgcaagtactaagggtccatccgtgtttccgacaatttgcgtc

SEQ ID NO: 26886 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggaacctctgtcagagtttcatgctggacaagtgaagacatcttcgagaggactgaactcattcattgggtgcggcaggctcctggtcagggccttgagtggatagggtgggtaaagacggtgaccggagcagtcaactttggcagcccaaatttccgccaccgagtgtccctgacacgtgatagagacttgtttactgcccatatggatatcaggggtttaacccagggggacacagcgacctacttctgtgctcggcaaaaatttgaacgcggaggccagggctggtatttcgatctgtgggggagaggaactctaattgttgtgtcttcg

SEQ ID NO: 26887 - RNA, 381 nt, synthetic construct
  misc_feature 1..381: note = derived and/or modified sequence opt3 from anti-HIV-1_HeavyChain
  source 1..381: mol_type = other RNA
caggtgcaactggtccagagcggcgccgaggttaagaaacccggggcttccgtgaaggtatcttgcaaagcatcaggatacacctatacaacttacggtgtgagttggctcagacaggtccctggccagaggccagaatggatggggtggatccggccgaagacgggagcccgcaaccaagcgcgacagttccagccccgtattagccttaccagagacagggctctgtccacagcctatttggatttaaattctctgacttcggcagactcaggcacctacttttgtgcccggcagacattcaaacctgatttttatttcgctgaccaaggttggagctttaacctatgggggcgcggagcacacttcatagtgagttcc

SEQ ID NO: 26888 - RNA, 384 nt, synthetic construct
  misc_feature 1..384: note = derived and/or modified sequence opt3 from anti-HIV-1_HeavyChain
  source 1..384: mol_type = other RNA
agagcccacctggagcagagcggctccggggtgaagaaactcggagcttctgtcagggtttcatgctggaccagtgaagacatcttcgagcggacagaacttattcattgggtgcgccaagcacccggtcagggcctggagtggatagggtgggtaaaggccgtgagcggagcggtcaactacggctccttggattttcgacaccgtgtgtctttaactagagacagggatctgttcacggctcatatggacatccggggtctaacccaggatgacacagccacttatttttgtgcacgccagaaattcgaatcgagatacaccgggggacaaggctggtattttgatctctggggcagggggacacacattaccgtttcaagc

SEQ ID NO: 26889 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagatcgtgagcggagccgtcaactttggctccccaaatttccgccagcgagtgtctctgactcgtgatagagacttgtttacggcgcacatggatattaggggtttaacccaaggggacacagctacttactattgtgcccggcagaaattcgaacgcggaggccagggctggatctttgatctgtgggggagaggaaccctaattgcagtttcgtca

SEQ ID NO: 26890 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgttcacggctcatatggacatcaggggtctaacccaggatgacacagccacttatttttgtgcacggcaaaaattcgcccgcggggatcagggatggtttttcgacctctggggccacggcaccctgattgttgtgtcgtca

SEQ ID NO: 26891 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtttacagcgcatatggatatcaggggtttaactcagggggacaccgctacatacttctgtgcccggcaaaaatttgaacgcggaggccagggctggtatttcgatctgtgggggcacggaaccctaattgttgtgtcttcg

SEQ ID NO: 26892 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagacggtgatttgtttaccgcgcacatggacatccgtgggttaacacaaggagatactgctacctacttctgtgccagacagaagttttatgcaggcggccaggggtggtacttcgacctgtggggaaggggtacactaattatcgtttcaagc

SEQ ID NO: 26893 - RNA, 372 nt, synthetic construct
  misc_feature 1..372: note = derived and/or modified sequence opt3 from anti-HIV-1_HeavyChain
  source 1..372: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggccaccagatctccgatcgggtgtctctgacgcgcgaccgagatttgttcaccgcgcatatggacattcgtggtttaacacaaggggatactgctacctacttttgtgccagacagaagttctatgcaggaggccagggctggtactttgacctgtgggggcacggaacactaatcgttgtgtcgtca

SEQ ID NO: 26894 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgagcggagccgtcaactttggctccccaaatttccgccaccgagtgtctctgacgcgtgatagagacttgtttaccgcgcatatggatatcaggggtttaacacagggggacactgctacctacttctgtgcccggcaaaaatttgaacgcggaggccagggctggtatttcgatctgtgggggcacggaacactaattgttgtgtcgtca

SEQ ID NO: 26895 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggcgctggggtgaagaaacccggagcatccgtcagagtttcttgctggacctcagaagacatcttcgagaggacagaactcattcattgggtgcggcaggcccctggtcagggccttgagtggatagggtgggtaaagactgtgagtggagcggtcaactttggcagcccaaatttccgccaccgagtgtccctgacgcgtgatagagacttgtttaccgctcatatggatatcaggggtttaacacagggggacactgccacctactattgtgcacggcaaaaattcgaacgcggaggccagggctggtactttgatctgtgggggagaggaacactaattgttgtgtcttcg

SEQ ID NO: 26896 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcgcggcctggagtggatagggtgggtaaaggccgtgagcggagcggtcaactacggctccttggattttcgacaccgtgtgtctttaactagagacagggatctgttcacggctcatatggacatccggggtctaacccaggatgacacagccacttattactgtgcacgccagaaatttgaaagagggggacaaggctggattttcgatctctggggcagggggaccctgatcgccgtttcgtca

SEQ ID NO: 26897 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctactattgtgccaggcagaagttctacgcaggaggccagggctggtattttgacctgtgggggcggggaacactaattgttgtgtcaagc

SEQ ID NO: 26898 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtttacagcgcatatggatatcaggggtttaactcagggggacaccgctacatacttctgtgcccggcaaaaattttataagggaggccagggctggtacttcgatctgtgggggcgcggaaccctaattgttgtgtcttcg

SEQ ID NO: 26899 - RNA, 372 nt, synthetic construct
  misc_feature 1..372: note = derived and/or modified sequence opt3 from anti-HIV-1_HeavyChain
  source 1..372: mol_type = other RNA
tacgtggagctgggcaccaacacagggcccgaagtcagaaagcctggagccagcgttaaaatctcctgcaagacttctggttatattttcacggacaattactttcactggctcaggcaggctccagcagtgggccttgagtggatggggtggataaactcacataatggatataccaaaagtgccaagaaattccaaggccggatcacaatgactcgcgataccgcggtagacacagcttacatggaactgattgatttgaccagcgacgatactgccacatattactgtgcacgacagaagttttatgccggtgggcagggatggtacttcgacttatggggctgcggcaccctgatcgtggtctcctct

SEQ ID NO: 26900 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagttttatgcaggaggccagggctggtacttcgacctgtgggggcggggaacactaatttgcgtttcaagc

SEQ ID NO: 26901 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagctccgatttccgccagcgagtgtctctgacccgtgacagagatttgtttacagcgcacatggacatcaggggtttaactcaaggggataccgctacatactattgtgcccggcagaaattctacgcaggaggccagggctggtattttgacctgtgggggcgcggaaccctaattgttgtgtcgtca

SEQ ID NO: 26902 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagccagtgactggagccgtcaactttggcagcccgaatttccgccaccgagtgtccctgacgcgtgatagagacttgtttaccgcgcatatggatatcaggggtttaacacagggggacactgctacctacttctgtgcccggcaaaaatttgaacgcggaggccagggctggtatttcgatctgtgggggagaggaacactaattgttgtgtcttcg

SEQ ID NO: 26903 - RNA, 375 nt, synthetic construct
  misc_feature 1..375: note = derived and/or modified sequence opt3 from anti-HIV-1_HeavyChain
  source 1..375: mol_type = other RNA
caggtgcaactggtccagagcggcgccgaggttaagaaacccggggcttccgtgagagtatcttgctggacctcagaagacatcttcgagaagagtgaactcattcactgggtgaggcaggcacctggacagggtcttgagtggataggctgggtcaaaacagtgactggggccgttaactttggaagctccgatttccggcaacgcgtgtctctgacgcgagaccgtgatttgtttaccgcgcatatggacatcagaggcttaacacagggtgatactgctacctactattgtgccaggcagaagttcgaacgcgggggacagggctggtactttgacctgtggggccgggggacactaattgtcgtgtcgtca

SEQ ID NO: 26904 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgtcgacggctcatatggacatcaggggtctaacccaggatgacacagccacttattcatgtgcacggcaaaaattcgcccgcggggatcagggatggtttttcgacctctggggcagaggcaccctgattgttgtgagcagt

SEQ ID NO: 26905 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggaacctctgtcagagtttcatgctggacaagtgaagacatcttcgagaggactgaactcattcattgggtgcggcaggctcctggtcagggccttgagtggatagggtgggtaaagacggtgaccggagcagtcaactttggcagcccaaatttccgccaccgagtgtccctgacacgtgatagagacttgtttactgcccatatggatatcaggggtttaacccagggggacacagcgacctactattgtgctcggcaaaaattcgaacgcggaggccagggctggtactttgatctgtgggggagaggaactctaattgttgtgtcttcg

SEQ ID NO: 26906 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggaaccgtcaactttggcagcctgaatttccgccagcgagtgtccttgacacgtgatagagacttatttactgcccacatggatatcaggggtctgacccaaggggacacagcgacctacttctgtgctcggcagaaatttgcccgcggagatcagggctggttctttgacctatggggccatgggactctcattgttgtgtcttcg

SEQ ID NO: 26907 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacccgtttacagcgcatatggatatcaggggtttgactcagggggacaccgctacatacttctgtgcccggcaaaaatttgaacgcggaggccagggctggtatttcgatttatgggggcacggaaccctgattgttgtgtcttcg

SEQ ID NO: 26908 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtttacagcgcatatggatatctgtggtttaactcagggggacaccgctacatacttctgcgccaggcaaaaatttgaacggggaggccagggctggtatttcgatctgtgggggcacggaaccctaattgttgtgtcttcg

SEQ ID NO: 26909 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccagcgagtgtctttaactcgtgacagagatctgttcacggctcacatggacatcaggggtctaacccaaggggatacagccacttattactgtgcacggcagaaattttatgccggaggccagggctggtacttcgacctctgggggcgcggaaccctgattgttgtgtcgtca

SEQ ID NO: 26910 - RNA, 372 nt, synthetic construct
  misc_feature 1..372: note = derived and/or modified sequence opt3 from anti-HIV-1_HeavyChain
  source 1..372: mol_type = other RNA
caggcccacctggagcaaagcggctccggggtgaagaaacccggagcttctgtcagagtttcatgctggaccagtgaagacatcttcaagagcgagctcattcattgggtgaggcaggcacctggtcagggccttgaatggatagggtgggtaaaaacagtgactggagccgtcaactttggctcctctgatttccggcagcgcgtgtcgctgacgcgagaccgtgatttgtttaccgcgcacatggacatcagaggtttaacacaaggggatactgctacctacttctgtgccaggcagaagttttatgcaggaggccagggctggtacttcgacctgtgggggcatggaacactaattgttgtgtcaagc

SEQ ID NO: 26911 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggaacctctgtcagagtttcatgctggacaagtgaagacatcttcgagaggactgaactcattcattgggtgcggcaggctcctggtcagggccttgagtggatagggtgggtaaagacggtgaccggagcagtcaactttggcagcccaaatttccgccaccgagtgtccctgacacgtgatagagacttgtttactgcccatatggatatcaggggtttaacccagggggacacagcgacctacttctgtgctcggcaaaaatttgcccgcggagatcagggctggttctttgacctgtggggccacgggactctaattgttgtgtcttcg

SEQ ID NO: 26912 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgttcacggctcatatggacatcaggggtctaacccaggatgacacagccacttattactgtgcacggcaaaaatttgcccgcggggatcagggatggttctttgacctctggggcagaggcaccctgattgttgtgtcgtca

SEQ ID NO: 26913 - RNA, 381 nt, synthetic construct
  misc_feature 1..381: note = derived and/or modified sequence opt3 from anti-HIV-1_HeavyChain
  source 1..381: mol_type = other RNA
caggtgcaactggtccagagcggcgccgaggttaagaaacccggggcttccgtgaaggtatcttgcaaagcatcaggatacaccttcacagactattacctccactgggtgagacaggcccctggtcagggccttgattgggtcgggtggatcaacccaaatagtggaggcactaactatgcgcaaaagtttcagggtagggtggctatgacgcgggacaccagcctgtcctctgtttacttggatttaaattcgctgacatcagccgacagcgggacttatttctgtgcacgccagacctttaaaccggatttctactttgccgaccagggatggagtttcaacctatggggccaaggctcccattttattgtgtctagc

SEQ ID NO: 26914 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgaaaagagcgagctcattcattgggtgaggcgggcacctggtcagggccttgagtggatagggtgggtaaaaacagtgactggagccgtcaactttggctcctctgatttccgccagcgagtgtcgctgacgcgtgacagagatttgtttaccgcgcacatggacatcaggggtttaacacagggggatactgctacctactattgtgcccggcaaaagttctacgcaggaggccagggctggtattttgacctgtgggggcgcggaacactaattgttgtgtcaagc

SEQ ID NO: 26915 - RNA, 372 nt, synthetic construct
  misc_feature 1..372: note = derived and/or modified sequence opt3 from anti-HIV-1_HeavyChain
  source 1..372: mol_type = other RNA
caggcccacctggagcaaagcggctccggggtgaagaaacccggagcttctgtcaccgtttcatgctggacaagtgaagacatcttcgaaaagagcgagctcattcattgggtgagacaggcacctggtcagggccttgagtggatagggtgggtaaaaactgtgacgggagccgtcaacctggtgtaccagatctccgatagggtttctttgacccgggaccgcggcttatttacagcgcacatggatattcgaggtctgactcaaggggacaccgctacatattactgtgcccgtcagaagttctatgcaggaggccagggctggtactttgatctatgggggagaggaaccctcatcgtggtctcgtca

SEQ ID NO: 26916 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagggtagcgaactcattcattgggtgaggcaggcacctggccaggggcttgagtggataggatgggtaaagacagtgactggcgccgtcaactttggttccgcgtacttccggcaccgcgtgtctctgacgcgagatcgtgacttgtttaccgctcatatggatatcagagggttaacacagggagacactgccacctatttctgtgcaaggcaaaaattttacaagggcggccaggggtggtatttcgatctgtggggacacggtacactaattgttgtgtcgtca

SEQ ID NO: 26917 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactacggcagcctgaattttcgctcccgaatctctttgacccgtgatagagacttattcacagcgcacatggatattaggggtctgactgaaggggacaccgctacatatttttgtgcccggcagaaattctacgcaggaggccaaggctggtattttgatctatgggggcatggaaccctcatcgtggtttcgtca

SEQ ID NO: 26918 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgagcggagccgtcaactttggctccccaaatttccgccaccgagtgtctctgacgcgtgatagagacttgtttaccgcgcatatggatatcaggggtttaacacagggggacatggctacttacttctgtgcccggcaaaaatttgaacgcggaggccagggctggtatttcgatctgtgggggcacggaaccctaattgttgtgtcgtca

SEQ ID NO: 26919 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaaggaacccggaacctctgtcagagtttcatgctggacaagtgaggacatcttcgaaaggactgagctcattcattgggtgcggcaggctcctggtcagggccttgaatggatagggtgggtaaaaacggtgaccggagcagtcaactttggcagcccaaatttccgccaccgagtgtccctgacacgtgatagagacttgtttactgcccatatggatatcaggggtttaacccagggggacacagcgacctacttctgtgctcggcaaaagtttgagcgcggaggccagggctggattttcgatctgtgggggagaggaactctaatcgccgtttcttcg

SEQ ID NO: 26920 - RNA, 375 nt, synthetic construct
  misc_feature 1..375: note = derived and/or modified sequence opt3 from anti-HIV-1_HeavyChain
  source 1..375: mol_type = other RNA
caggtgcaactggagcagagcggctccggggtcaagaaactcggagcctctgttagagtgtcatgctggaccagtgaagacatcttcggtaggacagagcttattcactgggtacggcaggctcccggccaggggctggaatggataggatgggtgaaggcagtcagcggcgccgtgaactacggttccttggattttcgccatcgagtttctttaactcgtgacagagatctgttcacggcgcacatggacatcagggggctaacccaagatgacacagctacttattactgtgcccggcagaaatttgcacgcggagatcagggctggttctttgacctctggggcagagggaccctgattgtggtctcgtca

SEQ ID NO: 26921 - RNA, 372 nt, synthetic construct
  misc_feature 1..372: note = derived and/or modified sequence opt3 from anti-HIV-1_HeavyChain
  source 1..372: mol_type = other RNA
caggcccacctggagcaaagcggctccggggtgaagaaacccggagcttctgtcagagtttcatgctggaccagtgacgatatcttcaagacagaactcattcattgggtgaggcaggcacctggtcagggccttgagtggatagggtgggtaaaaactgtgacgggagccgtcaactttggcagcccaaatttccggcagcgcgtgtccctgacccgagaccgtgatttgtttacagcgcacatggacatcagaggtttaactcaagatgacaccgctacatacttctgtgccaggcagaagtttgcacgcggggatcagggatggttctttgacctgtggggccggggcaccctaattgttgtgtcttcg

SEQ ID NO: 26922 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcgagaggacagaactcattcattgggtgcggcaggcacctggtcagggccttgagtggatagggtgggtaaagactgtgacgggagccgtcaactttggcagcccaaatttccgccaccgagtgtccctgacccgtgatagagacttgtttacagcgcatatggatatcaggggtttaactcagggggacaccgctacatactattgtgttcggcaaaaattcgaacgcggaggccagggctggtactttgatctgtgggggagaggaaccctaattgtggtctcttcg

SEQ ID NO: 26923 - RNA, 375 nt, synthetic construct
  misc_feature 1..375: note = derived and/or modified sequence opt3 from anti-HIV-1_HeavyChain
  source 1..375: mol_type = other RNA
caggtgcaactggtccagagcggcgccgaggttaagaaacccggggcttccgtgaaggtatcttgctggacctcagaagacatcttcgagaaaagtgaactcattcactgggtgagacaggcacctggacagggtcttgagtggataggctgggtcaagacagtgactggggccgttaactttggaagctccgatttcaggcaacgggtgtctctgacgcgcgaccgagatttgtttaccgcgcatatggacatccgtggcttaacacagggtgatactgctacctactattgtgccagacagaaattctacgcagggggacagggctggtattttgacctgtggggcagggggacactaattgtcgtgtcgtca

SEQ ID NO: 26924 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaactcggagcttctgtcagagtttcatgctggaccagtgaagacatcttcgagaggacagaacttattcattgggtgcggcaggcacccggtcagggcctggagtggatagggtgggtaaaggccgtgagcggagcggtcaactacggctccttggattttcgccaccgagtgtctttaactcgtgacagagatctgttcacggctcatatggacatcaggggtctaacccagggggatacagccacttatttttgtgcacggcaaaaattctacaagggaggccagggctggtattttgacctctgggggcgcggaaccctgattgttgtgtcgtca

SEQ ID NO: 26925 - RNA, 372 nt, synthetic construct
  misc_feature 1..372: note = derived and/or modified sequence opt3 from anti-HIV-1_HeavyChain
  source 1..372: mol_type = other RNA
caggcccacctggagcaaagcggctccggggtgaagaaacccggagcttctgtcagagtttcatgctggaccagtgaagacatcttcgaaaagagcgagctcattcattgggtgaggcaggcacctggtcagggccttgagtggatagggtgggtaaaaacagtgactggagccgtcaactttgcgcaccagatctccgatcgggtgtctctgacgcgcgaccgagatttgttcaccgctcatatggacattcgtggcttaacacaaggtgatactgccacctactattgtgcaagacagaagttttacgccgggggacagggctggtatttcgacctgtggggcagggggacactaatcgttgtgtcgtca

SEQ ID NO: 26926 - RNA, 375 nt, synthetic construct
  misc_feature 1..375: note = derived and/or modified sequence opt3 from anti-HIV-1_HeavyChain
  source 1..375: mol_type = other RNA
caggcccacctggagcaaagcggctccggggtgaagaaacccggagcttctgtcagagtttcatgctggaccagtgaagacatcttcggtaggacagagctcattcattgggtgcggcaggcacctggccaggggcttgaatggataggatgggtaaagactgtgagcggcgccgtcaactttggttccccaaatttccgccaccgagtgtctctgacgcgtgatagagacttgtttaccgcgcatatggatatcagggggttaacacagggagacactgctacctacttctgtgcccggcaaaaatttgagcgcggcggccaggggtggtatttcgatctgtggggaagaggtacactaatttgcgtttcgtca

SEQ ID NO: 26927 - RNA, 636 nt, synthetic construct
  misc_feature 1..636: note = derived and/or modified sequence opt3 from anti-HIV_5CIN_LightChain
  source 1..636: mol_type = other RNA
gagatcgtgctgacccagagccccggcacacaatccctctctcctggggaaagagccactctttcatgcagggctagtcagagcgtcggaaacaataagctggcatggtaccagcagcggccaggtcaagccccgcgcttgttaatttatggcgcgtcctctcgaccctcgggggttgctgaccgtttctcaggaagcggcagtggtacggattttaccctgacaatatccagactagagcctgaagacttcgccgtgtactattgtcagcagtacgggcagtctctcagcacttttggacaaggcaccaaagtagaggtgaagaggacagtcgcagccccatccgtgttcatctttcccccttcagatgaacagctgaaaagtggcaccgctagcgttgtgtgccttctgaacaatttctatccacgggaggcaaaggtccagtggaaagtggacaacgccttgcagtctggaaattcccaagagtcagtaactgaacaggatagcaaggacagtacatactctctctccagcaccctgacgctgtcgaaggctgattatgagaaacacaaggtttacgcctgtgaagtgactcatcaggggctctcttcccccgtcaccaaatcatttaaccgc

SEQ ID NO: 26928 - RNA, 672 nt, synthetic construct
  misc_feature 1..672: note = derived and/or modified sequence opt3 from anti-HIV_5CIN_HeavyChain
  source 1..672: mol_type = other RNA
gtgcagctggtccaaagcggcgccgaggttaagagacccgggtcctctgtgaccgtatcatgcaaagctagtggaggtagcttctccacatacgcactctcttgggtgaggcaggcccctggccgggggcttgaatggatgggaggcgtcatcccactgttgactattacgaactatgcgccgcgctttcagggtcgaataaccatcacagctgaccgttcgacttcaaccgcctacttagagctgaatagcctaagacccgaagatacagcagtgtattactgtgccagggaggggaccactggaagtggcggcaagcctattggggctttcgcacactggggacagggtacactcgttaccgtgtcctctgccagcacgaaaggcccatccgtctttcccctggctccttcaagtaagagcacttctgggggaaccgccgcgcttggctgcctggtgaaagactatttcccagaacccgtaacagtttcctggaactcaggtgcattgactagcggggtgcatacctttcctgccgtcctccaaagttctggactgtactccctgagctcggtggtgacagtcccatcttcctcactcggcacccagacgtatatctgtaatgttaaccacaagccgagtaatactaaggtggataaaaaggtagagccc

SEQ ID NO: 26929 - RNA, 678 nt, synthetic construct
  misc_feature 1..678: note = derived and/or modified sequence opt3 from anti-HIV_5CIL_HeavyChain
  source 1..678: mol_type = other RNA
gtgcagctggtccaaagcggcgccgaggttaagagacccgggtcctctgtgaccgtatcatgcaaagctagtggaggtagcttctccacatacgcactctcttgggtgaggcaggcccctggccgggggcttgaatggatgggaggcgtcatcccactgttgactattacgaactatgcgccgcgctttcagggtcgaataaccatcacagctgaccgttcgacttcaaccgcctacttagagctgaatagcctaagacccgaagatacagcagtgtattactgtgccagggaggggaccactggagacggcgatctcggcaagcctattggggctttcgcacactggggacagggtacactggttaccgtgagttccgcctctacgaaaggcccaagcgtctttccccttgctccttcctcaaagagtactagcgggggaaccgccgcgctgggctgcttggtgaaagactatttcccagaacccgtaacagtttcttggaactccggtgcactcacttcaggggtgcatacctttcctgccgtcctgcaaagcagtggactgtactctctctccagcgtggtgacagtcccatcgtcttccttaggcacccagacgtatatctgtaatgttaaccacaagccgtcaaatactaaggtggataaaaaggtagagccc

SEQ ID NO: 26930 - RNA, 678 nt, synthetic construct
  misc_feature 1..678: note = derived and/or modified sequence opt3 from anti-HIV_5CIP_A-Chain
  source 1..678: mol_type = other RNA
gtgcagctggtccaaagcggcgccgaggttaagagacccgggtcctctgtgaccgtatcatgcaaagctagtggaggtagcttctccacatacgcactctcttgggtgaggcaggcccctggccgggggcttgaatggatgggaggcgtcatcccactgttgactattacgaactatgcgccgcgctttcagggtcgaataaccatcacagctgaccgttcgacttcaaccgcctacttagagctgaatagcctaagacccgaagatacagcagtgtattactgtgccagggaggggaccactggatggggctggctcggcaagcctattggggctttcgcacactggggacagggtacactggttaccgtgagttccgcctctacgaaaggcccaagcgtctttccccttgctccttcctcaaagagtactagcgggggaaccgccgcgctgggctgcttggtgaaagactatttcccagaacccgtaacagtttcttggaactccggtgcactcacttcaggggtgcatacctttcctgccgtcctgcaaagcagtggactgtactctctctccagcgtggtgacagtcccatcgtcttccttaggcacccagacgtatatctgtaatgttaaccacaagccgtcaaatactaaggtggataaaaaggtagagccc

SEQ ID NO: 26931 - RNA, 681 nt, synthetic construct
  misc_feature 1..681: note = derived and/or modified sequence opt3 from anti-HIV_5CIP_HeavyChain
  source 1..681: mol_type = other RNA
gtgcagctggtccaaagcggcgccgaggttaagagacccgggtcctctgtgaccgtatcatgcaaagctagtggaggtagcttctccacatacgcactctcttgggtgaggcaggcccctggccgggggcttgaatggatgggaggcgtcatcccactgttgactattacgaactatgcgccgcgctttcagggtcgaataaccatcacagctgaccgttcgacttcaaccgcctacttagagctgaatagcctaagacccgaagatacagcagtgtattactgtgccagggaggggaccactggatggggctggctcggcaagcctattggggctttcgcacactggggacagggtacactggttaccgtgagttccgcctctacgaaaggcccaagcgtctttccccttgctccttcctcaaagagtactagcgggggaaccgccgcgctgggctgcttggtgaaagactatttcccagaacccgtaacagtttcttggaactccggtgcactcacttcaggggtgcatacctttcctgccgtcctgcaaagcagtggactgtactctctctccagcgtggtgacagtcccatcgtcttccttaggcacccagacgtatatctgtaatgttaaccacaagccgtcaaatactaaggtggataaaaaggtagagcccaaa

SEQ ID NO: 26932 - RNA, 630 nt, synthetic construct
  misc_feature 1..630: note = derived and/or modified sequence opt3 from anti-HIV_4JKP_LightChain
  source 1..630: mol_type = other RNA
gagatcgtgctgacccagagccccgccacactctccctttctcctggcgaaactgctattatatcatgcagaacgagtcaatacgggagcctggcatggtatcagcagaggccaggacaggccccgcggttggtcatctactccggttctacccgcgcggctggcattcccgaccgattctcggggtcacgttggggagccgattataacttaagcatcagtaatctggagtccggcgactttggtgtttactattgtcaacagtacgagttctttgggcagggaacaaaggtgcaggtagatattaaaagaactgtggcagccccttctgtcttcatctttccacccagcgacgaacaactaaagtccggcaccgcttcagtggtttgcctcctgaacaatttctatcctagggaagcaaaagtgcagtggaaggtcgataacgcccttcagagtggcaatagccaggagtctgtgacagagcaagactccaaagattcaacctacagcctgagttctactttgacactctccaaggctgactacgaaaagcacaaagtatatgcctgtgaggttacccatcaggggctgagctcgccagtgacgaagtcttttaaccggggagaatgc

SEQ ID NO: 26933 - RNA, 678 nt, synthetic construct
  misc_feature 1..678: note = derived and/or modified sequence opt3 from anti-HIV_3TNN_E-Chain
  source 1..678: mol_type = other RNA
gaggtgcagctggtcgaaagcggcgggggactcgttcaacccggtggctcccttagactgtcttgcgccgcttcagggttcacctttagtacatacgcaatgagctgggtgaggcaggcccctggaaagggcttggagtgggtatcctctatcaacaattcgggtcggaacactttctcagcggacagcgtgaaagggcgctttacgattagtcgagataattccaagaacaccttattcctggtcatgaatagcctacgtgctgaagacacagccgtgtattactgtgcaaaagatctcagactgggaggcggctctgactattgggggcagggaactcttgttaccgtgtcctcagccagtacaaagggtccaagcgtctttccgctggctccctcttccaaatcaaccagcggcgggactgcagccttgggatgcctcgtgaaggattacttccctgagccagtaacagttagttggaactctggcgctctgacctccggtgtgcacacgtttcccgccgtcctgcagagctcggggctctattctttatcctcagtggtgactgtccctagtagctccctgggaacccaaacatacatatgtaatgttaaccataagccatctaatactaaagtggacaagagggtagaacccaaaagctgcgataagacccac

SEQ ID NO: 26934 - RNA, 705 nt, synthetic construct
  misc_feature 1..705: note = derived and/or modified sequence opt3 from anti-HIV_3BQU_B-Chain
  source 1..705: mol_type = other RNA
agaatcaccctgaaggagagcgggccccctctcgtgaaaccaacacagactcttacgctgacctgctccttctctggcttttcattgagtgacttcggagtcggtgttggctggattaggcaaccgcccgggaaggccttagaatggctggctataatctacagcgatgacgataaacggtattccccttctctaaacacacgcctcactattaccaaggacacatcgaaaaatcaggtggtactggtgatgacccgagtctcaccagtggatactgcaacatacttttgtgcccaccgtagaggacccaccacgcttttcggcgttcctatcgcgaggggtccagtgaacgctatggacgtctgggggcagggaattactgtgaccatcagcagtacatccactaagggcccctctgtatttcctctggccccaagctccaagtcaaccgcaggcggggccgctgcattgggatgcctcgttaaagattatttcccggagcccgtgacagtcagttggaatagcggtgccctgacctctggcgtgcatacgtttcctgctgtgctgcagtcctcagggctctacagcttaagttctgtcgttactgtgccatccagctcgctgggaacacaaacctatacttgtaacgtaaatcacaagccctctaacacaaaagtggacaagcgggtcgaacctaaatcctgc

SEQ ID NO: 26935 - RNA, 642 nt, synthetic construct
  misc_feature 1..642: note = derived and/or modified sequence opt3 from anti-HIV_3BQU_A-Chain
  source 1..642: mol_type = other RNA
gccctgcagctcacccaaagcccctcctctctttcagctagtgtgggcgacagaatcacaattacttgcagggcaagccagggggtcacgtccgccctggcgtggtaccggcagaagcctggatctccaccgcagttgttaatatatgatgcttcgtcactggagagcggtgttcccagtcgcttctccggctctgggagcggaaccgaatttacactaactatctccaccctccgacctgaggacttcgccacatactattgtcaacagctgcacttttacccacataccttcggcggtgggactcgtgtggatgtaagaaggacagtggcagccccctcagtctttattttccctccaagtgacgaacagcttaaaagcggaaccgcttctgtggtttgcctgttgaacaatttttatccccgggaggcaaaggtgcagtggaaagtcgataacgccctccaatccggcaattcacaggaaagcgtgacggagcaggacagtaaggattctacttactccctgagctcgaccctgacactctctaaagctgactatgagaagcacaaggtatacgaatgtgaggttactcatcagggcttatcctcacctgtgaccaaaagtttcaaccgcggggaatgc

SEQ ID NO: 26936 - RNA, 387 nt, synthetic construct
  misc_feature 1..387: note = derived and/or modified sequence opt3 from anti-HIV_IgG_VR-Chain
  source 1..387: mol_type = other RNA
atggagacccccgcccagctcctgttccttctgttgttatggctgcctgacacaactggcgaaatcgtgctaacgcaaagcccagggaccctctccctgtctgctggagagagagcaacactttcatgcagggccagtcagagcgtctcctctcggtacctggcgtggtatcagcagaagccgggtcaagctccccgcttgctcatttacggcgcctcgtcacgagcaactgggatacctgatcgttttagcggaagtggctccggtaccgacttcacactgaccatctctagagttgaaccagaggattttgccgggtattactgtcagcagtatgacaacagcgtgtgcactttcggacagggcacaaaactggaaattaagagg

SEQ ID NO: 26937 - RNA, 348 nt, synthetic construct
  misc_feature 1..348: note = derived and/or modified sequence opt3 from anti-HIV_IgG_HeavyChain
  source 1..348: mol_type = other RNA
atgaagcacctgtggttctttctccttctggtggccgctcccagatgggtcttgagccaggttcaattacaggagtccggccctgggctggtgaaaccatctgaaaccctatcactcacatgcactgtaagtggaggtagcatctcctctcattactggtcgtggattaggcagtcaccgggcaaggggctgcagtggataggatatatctactatagcggcagtacgaactactccccctctcttaaaagccgggtgaccatttccgtcgagacatcaaagaatcaattcagtctgaaattgactagcatgaccgcagccgacacagcggtgtattactgtgctcgc

SEQ ID NO: 26938 - RNA, 714 nt, synthetic construct
  misc_feature 1..714: note = derived and/or modified sequence opt3 from anti-HIV_4P9M_HeavyChain
  source 1..714: mol_type = other RNA
cagatccacctggtgcaaagcggcaccgaggtcaagaaacccgggtcctctgttacagtgtcatgcaaggcctacggagtaaacactttcggtctctatgctgtgaattgggtcagacaggcacctggccagagtcttgaatacattgggcagatatggaggtggaaaagctccgcctctcatcactttcggggacgcgtgctgatctcggcggttgacttgacgggctcaagcccaccgattagttccttagagatcaagaacctgacctctgatgacacagctgtgtatttctgtactaccacaagcacctacgataaatggtccggtctacatcacgacggggtcatggccttttcaagttggggacaaggcactctcattagcgtgtctgcagcctccacaaagggcccctcagtattccctctggctccaagcagtaagtctacctccgggggaacggcagcccttggttgcctggttaaagattattttcccgaacctgtgactgtcagctggaactcgggcgctttgacctctggggtgcatacattcccagccgtgctccagtcctcaggactgtacagtctgagctccgtcgttactgtgccctctagctcactcggcacccagacatatatctgtaatgtaaatcacaagcctagtaacaccaaagtggacaagcgagtcgagccaaaatcctgcgataagacg

SEQ ID NO: 26939 - RNA, 645 nt, synthetic construct
  misc_feature 1..645: note = derived and/or modified sequence opt3 from anti-HIV_4P9M_LightChain
  source 1..645: mol_type = other RNA
gacatccagatgacccaaagcccctccacactgtctgcctcaattggcgatactgtgagaataagttgcagggctagccagtccatcacggggaactgggtcgcatggtaccagcagcggcctggaaaggccccacgcctccttatttatcgaggtgcggctctgttgggcggggttccgtctcgtttctcgggatcagccgcaggcaccgactttacattaactatcggtaatctgcaagccgaggatttcgggaccttttactgtcagcagtatgacacataccccggaaccttcggccagggcactaaagtggaagtaaagagaacagtggctgcacctagcgtctttattttcccacccagtgatgagcaactaaaatccgggaccgcctctgtggtttgcctcctgaacaatttttatcctagggaagctaaggtgcagtggaaagtcgacaacgcccttcagagcggaaattcccaggagtcagtgacggaacaagatagtaaggacagcacttactctctgtcctcaaccttgacactcagcaaggcggattatgagaaacacaaggtatacgcatgtgaggttactcatcagggtctgagttctccagtgaccaaatccttcaaccggggcgaatgc

SEQ ID NO: 26940 - RNA, 558 nt, synthetic construct
  misc_feature 1..558: note = derived and/or modified sequence opt3 from anti-HIV_4P9H_C-Chain
  source 1..558: mol_type = other RNA
aagaaagtggtcctgggcaagaaaggggacaccgttgaactcacatgcactgccagccagaagaaatccatccaattccactggaagaactctaatcagattaagatacttggaaaccagggttcatttctgacgaaaggccccagtaagttgaatgatagagctgacagcaggcggtccttatgggatcaggggaacttccctctgatcattaaaaatctaaccatcgaagactctgatacatacatttgtgaggtggaagaccaaaaggaggaagtacagctcctggtgtttggacttactgcaaactcggatacccatctgttgcagggccagtcactcacactgaccctggagagcccaccgggtagttccccctctgtccaatgccgcagccctcgagggaaaaatatccagggaggcaagactctctccgtgtcacagttagagctgcaggacagtggcacatggacctgtacggttcttcaaaaccagaagaaagtggagttcaagatagatatcgtcgtgttggcctttcagaaagcgattgacgggcgt

SEQ ID NO: 26941 - RNA, 462 nt, synthetic construct
  misc_feature 1..462: note = derived and/or modified sequence opt3 from anti-HIV_4YBL_A-Chain
  source 1..462: mol_type = other RNA
gtgcccgtctggaaggacgccgataccacactgttctgcgctagcgacgcaaaagcccacgagactgaatgtcataacgtttgggcgacgcacgcttgcgtgcctaccgatccaaatccgcaggagatccatctcgaaaacgtaacagagaattttaacatgtggaagaataacatggtggaacaaatgcaggaggacgtcatttccctttgggatcagtgtctgcagcccggcggggcccctaaaatatctttcgacccaatccccattcactactgcactcctgcaggatatgtgatcttgaagtgtaatgataaaaactttaatggtaccggcccatgcaagaacgtttcaagtgtgcaatgtacacatgggattaagcccgtcgtgagctccggaggcggtaatatcaaagacaactggagatctgagttatacaagtataaagtagttcagatagaa

SEQ ID NO: 26942 - RNA, 1056 nt, synthetic construct
  misc_feature 1..1056: note = derived and/or modified sequence opt3 from anti-HIV_4R4N_V-Chain
  source 1..1056: mol_type = other RNA
atctggaaggacgccaacaccacactgttctgcgctagcgatgcaaaagcctacgacactgaggtgcacaatgtctgggcgacgcatgcttgtgttcccaccgatccttccccacaggaactcaagatggagaacgtgacagaagagtttaatatgtggaaaaacaatatggtagaacaaatgcacactgacattatatctctttgggatcagtcactgaagccgtgcgtgcagttgaccggcgggagtgccttaacacaggcatgtcccaaagtcaccttcgagcctatcccaattcattattgcgcccccgctggatacgcaatcctgaagtgtaacgacaaggagtttaatggtactggcctatgcaaaaacgtgagcacagttcaatgtacccacgggattagacctgtggtctccacgcagctcctgcttaatggatctctggccgaaggcaaggtgatgatcaggtcggagaacataactaataacgttaaaaatatcattgtacagttgaacgaatcagtgaccatcaattgcacacggccaaacaacggtgggagcggaagtggcggcgatattcgccaggctcattgtaatgtctccgggtctcaatggaacaagactctccaccaggtggtggagcagctgcgaaaatattggaataacaataccatcatattcaacagctcctcaggaggtgacctggagattacaacccacagttttaattgcggcggggagttcttttactgtaacacgagcggactcttcaattctacttgggtcaacggcacagcctccatcgaaaatggtaccattactttaccctgccgtatcaagcagatcattaacatgtggcaaagagttgggcaggcgatatatgcacctccaatccagggagtgattaggtgcgtatcaaatatcacaggcctgatacttacccgggatggcgggggaaacagcaatgaaaacgagacgtttcgcccgggtggcggggacatgagagataactggaggagtgaattgtacaagtataaagtggtcaagattgag

SEQ ID NO: 26943 - RNA, 1065 nt, synthetic construct
  misc_feature 1..1065: note = derived and/or modified sequence opt3 from anti-HIV_4JKP_G-Chain
  source 1..1065: mol_type = other RNA
gtgtggaaggacgccgataccacactgttctgcgctagcgacgcaaaagcccacgagactgaatgtcataacgtctgggcgacgcacgcttgcgttcccaccgatcctaatccacaggagatccatctcgaaaacgtgacagagaattttaacatgtggaagaataacatggtagaacaaatgcaggaggacgtgatttccctttgggatcagtgtctgcagccgtgcgtcaaattgactggcgggtctgtgataaagcaagcctgtcccaaaatctcattcgaccctattccaatccactactgcacccccgcaggatatgttattttaaagtgtaatgataagaactttaatggtacaggcccttgcaaaaacgtgagtagcgtccagtgtacccatgggatcaagccagtggtatccactcagctgctactcaatggatctctggccgaggaagagataatcattagatcggaaaaccttacaaataacgctaaaaccatcattgttcacctgaataagtcagtggagatcaactgcacgaggcccagcaacggcggtagtgggtccggaggcgacatacggaaagcatactgtgagattaatggcactaagtggaacaaggtcttgaaacaggtgaccgaaaagctcaaagagcacttcaataacaagacaatcatttttcaacctccatctgggggagatctggaaatcactatgcatcacttcaattgccgcggtgagtttttctattgcaacaccacacagctgtttaataacacctgtatcggcaatgaaacgatgaaagggtgcaacggaactattacactcccgtgtaagataaaacagatcattaatatgtggcagggcaccggtcaagccatgtacgctccccctatcgacgggaagataaactgcgtgagcaatattactggaatcttactgacacgagatggcggcgccaacaatacctccaacgagacgttccgtccagggggaggtaacatcaaggacaattggagatcagagctttataaatacaaggtcgttcagattgaaggcagt

SEQ ID NO: 26944 - RNA, 723 nt, synthetic construct
  misc_feature 1..723: note = derived and/or modified sequence opt3 from anti-HIV_3BQU_D-Chain
  source 1..723: mol_type = other RNA
atgggctggagctggatcttcctgtttctcctttccgggaccgccggagtgcactctggtgtccagctgcaacagtcaggccccgagttggttaagcctggggctagtgtgaaaatgagctgcaaggcatccggatactctttcacagactattttatgcattgggtaaaacagtcgcacggcaagtcattagattggattggttacataaactgttatactggggccacgaattacagccagaaattcaagggaaaggcgacctttacagtggacaccagttccaacactgcttatatgcaattcaattctctgacaagcgaagattccgccgtctactattgcgcaagaacctcaatcggctacggcagtagcccaccgtttccctactgggggcagggaactctagtgacagtttctgccgctaaaaccacgcctccatccgtgtatcccctcgcacctggttcagccgctcagactaacagcatggtcaccctgggctgtcttgtgaaggggtacttcccagagcccgtaacagttacttggaatagtggatctctgtccagcggcgtgcatacctttcctgccgtcttgcagtcggacctctatacactgtcttcctcagtgaccgtgccaagtagcccgaggccctccgaaacggtcacttgcaacgttgcgcaccctgcatctagcacaaaagtggataagaaaattgtaccacgg

SEQ ID NO: 26945 - RNA, 699 nt, synthetic construct
  misc_feature 1..699: note = derived and/or modified sequence opt3 from anti-HIV_3BQU_C-Chain
  source 1..699: mol_type = other RNA
atgaccatgttcagcctggccctccttctgtccttgttactgctatgcgtgtctgactcaggcgctgagacaactgtcacgcagagtcccgcaagcctctccatgtctatcggggaaaaggttaccattagatgtataacatcgactgatatcgacgatgacatgaactggtaccaacagaaacctggagagccaccgaggctgcttatttcagatggtaataccctgcggcccggcgtgcctagccgctttagttcctctgggtatggaacagacttcgtatttaccatcgaaaacatgttgagcgaggatgtggccgactactattgcctccagtccgataatctgccatacactttcggcggtgggacaaacctggaaattaagcgagcggacgctgcccccaccgtctcaatctttcctccaagtagcgagcagctcacgtctggaggcgcatccgtggtttgtttcttaaataacttttatcccaaagatataaatgtgaagtggaaaatcgacggctcagagcgtcaaaacggggtcctgaatagctggactgatcaggacagtaaggactctacctactccatgagctcgacacttactttgaccaaggatgaatatgagagacacaactcttacacatgcgaagccacccataaaacgtccacttcacctattgtgaagagtttcaatagg

SEQ ID NO: 26946 - RNA, 333 nt, synthetic construct
  misc_feature 1..333: note = derived and/or modified sequence opt3 from anti-HIV_Ig_LightChain
  source 1..333: mol_type = other RNA
gacgtggtcctgacccagagccccgcctccctcgctgtttctcttggccaaagagcaacaatctcatgcaaggccagtcagagcgtggattacgacggggattcctatatgaactggtaccagcagaaacctggacaaccaccgaagctgttgattcacgcggcttctaatttagtatcgggtatgcccgccaggttctcaggcagcgggagtggaactgactttacgctgaacatacatcctgtggaggaagaggatgcagccacctattactgtcagcagtccatcgaagacccacccacattcggcggtgggactaaactagagattaag

SEQ ID NO: 26947 - RNA, 342 nt, synthetic construct
  misc_feature 1..342: note = derived and/or modified sequence opt3 from anti-HIV_Ig_HeavyChain
  source 1..342: mol_type = other RNA
gacgtgcagctgcaacagagcggccccgggctcgtcaagccttcccagtctctttcacacacatgcaccgttactggatacagtatcacgagcgattatgcctggaactggattagacagttcccaggtaataaactggagtggatgggctacatatccttttctgggtcgacctcatataacccgagcttgaagagtaggatctccattacacgggacacttctaaaaatttattctttctgcaactaaacagcgtgaccacagaagataccgctacttactattgtgcacgcggactccccgactactggggccagggtacaaccctgacggtatcctca

SEQ ID NO: 26948 - RNA, 1083 nt, synthetic construct
  misc_feature 1..1083: note = derived and/or modified sequence opt3 from anti-HIV_4P9H_G-Chain
  source 1..1083: mol_type = other RNA
gtgtggaaggacgccgataccacactgttctgcgctagcgacgcaaaagcccacgagactgaatgtcataacgtctgggcgacgcacgcttgcgttcccaccgatcctaatccacaggagatccatctcgaacaagtgacagagaactttaatatgtggaagaacaatatggtagaacagatgcaggaggacgtgatttccctttgggatcagtgtctgcaaccgtgcgtcaaattgactggcgggtctgtgataaagcaggcctgtcccaaaatctcattcgaccctattccaatccactactgcacccccgcaggatatgttattttaaagtgtaacgataagaattttaacggtacaggcccttgcaaaaatgtgagtagcgtccagtgtacccatgggatcaagccagtggtatccactcagctgctactcaacggatctctggccgaggaagagataatcattagatcggaaaatcttacaaacaatgctaaaaccatcattgttcatctgcaaaagtcagtggagatcaactgcacgaggcccagcaatggcggtagtgggtccggaggcgacatacggaaagcatactgtgagattcagggcactaagtggaacaaggtcttgaaacaggtgaccgaaaagctcaaagagcacttcaacaataagacaatcatttttcagcctccatctgggggagatctggaaatcactatgcaccacttcaactgccgcggtgagtttttctattgcaataccacacaactgtttcagaacacctgtatcggcaatgaaacgatgaaagggtgcaacggaactattacactcccgtgtaagataaaacagatcattaatatgtggcaaggcaccggtcaggccatgtacgctccccctatcgacgggaagataaactgcgtgagccagattactggaatcttactgacacgagatggcggcgccaataacacctccaatgagacgttccgtccagggggaggtaacatcaaggacaattggagatcagagctttataaatacaaggtcgttcagattgaaggcagtcatcaccaccatcaccat

SEQ ID NO: 26949 - RNA, 147 nt, synthetic construct
  misc_feature 1..147: note = derived and/or modified sequence opt3 from anti-HIV_Chain
  source 1..147: mol_type = other RNA
caggtgcaactggtccagagcggcgggcagatgaagaaacccggagagtccatgagaatctcttgcagggcctcaggttacgagttcattgactgtaccctcaactggatacggcttgctcctggcaagcgcccagaatggatgggg

SEQ ID NO: 26950 - RNA, 180 nt, synthetic construct
  misc_feature 1..180: note = derived and/or modified sequence opt3 from anti-HIV_Chain
  source 1..180: mol_type = other RNA
ccctgctgtttcgcctacatcgctagacctctgccaagggcacacattaaggagtatttttacaccagcggcaaatgctccaacccggccgtggtcttcgttacacggaagaatcgccaggtgtgtgcgaaccccgagaaaaagtgggtacgagaatatataaattctctcgaaatgtca

SEQ ID NO: 26951 - RNA, 249 nt, synthetic construct
  misc_feature 1..249: note = derived and/or modified sequence opt3 from anti-HIV_Chain
  source 1..249: mol_type = other RNA
ctggagtggatgggcagaatcattcccgccatagacgatgtgacctacgctcagacattcagggggcgggtcacttttagcgcagacaagttcacgaccacagcctatatggatctcactggacttcgctccgaagacaccgcgacatacttttgcgctcgagatcctcaagttaaccgtagaggtaattgtttcgaccactggggccaggggaccctggtgactgtatcttcagccagtacaaaagga

SEQ ID NO: 26952 - RNA, 270 nt, synthetic construct
  misc_feature 1..270: note = derived and/or modified sequence opt3 from anti-HIV_Chain
  source 1..270: mol_type = other RNA
gacgtggtcatgacccagagccccctgtccctccctgttacacttggccaaccagcctctatctcatgcagaagtagccagtccctggtgtactctcacggggatacttatttgaagtgtttccagcagaggccgggacaatcgccccggcgccctatttacaaagtatcaaaccgagacagcggtgtgccagatcgttttagtggctccgggtctggaacggacttcaccttaaagataagcagagtcgaggctgaagatgtgggcgtt

SEQ ID NO: 26953 - RNA, 294 nt, synthetic construct
  misc_feature 1..294: note = derived and/or modified sequence opt3 from anti-HIV_Chain
  source 1..294: mol_type = other RNA
agctccttcgccatctcttgggtgagacaggctcccggccaagggctggagtggatgggaggtattatacctatctttgaagcaacctcatacgcccagaagttccaggacaggctcacaattactacggatgagagtaccacaactgcgtatatggaccttagctccctgcggtctgaagataccgctgtctactattgcgcccgcgcacagggcgacatcttgacagaggggtactttgattattggggacaaggcaccttagttactgtgtcgtcagccagcacaaaaggt

SEQ ID NO: 26954 - RNA, 297 nt, synthetic construct
  misc_feature 1..297: note = derived and/or modified sequence opt3 from anti-HIV_Chain
  source 1..297: mol_type = other RNA
aacaccttcacaagccactacgtgcattgggtcagacaggcccccggccaagggctggagtggatgggaatgatcaatcctggtggcactacgaggtatgctccaaagtttcaggaccgggttaccctcacacgcgatacttccacccgaacagtgtacatggaacttcgttctctgagatcagaggacaccgcagtatattactgcgccaggccgcagtataacttggggcgggaacccttaaatgtgtggggacagggcactatggtcacagtgagtagcgcgtccaccaaaggt

SEQ ID NO: 26955 - RNA, 297 nt, synthetic construct
  misc_feature 1..297: note = derived and/or modified sequence opt3 from anti-HIV_Chain
  source 1..297: mol_type = other RNA
atcaggagcttctactggcactggattagacagtcccccggcaaggggctggagtggctcggatctgtgtttgacaacggtcttaccacacataatccttcactgaaaagtcggttgactataagcgaagatccatcccgcaaccaaatctctttaaagctgcgatcgatgacggccgctgacaccgcagtctattactgcgcccgtggcgattatgacattctaacatcaagctaccagttcgattattgggggcagggaactctcgttgcggtgagttccgcttctaccaaaggc

SEQ ID NO: 26956 - RNA, 300 nt, synthetic construct
  misc_feature 1..300: note = derived and/or modified sequence opt3 from anti-HIV_Chain
  source 1..300: mol_type = other RNA
cagagcgccctgacccaacccgctttcgtgtccggctctcctgggcagtcaatcacactcagttgcactcttggaacggaggacgtcagctggtaccagcagagaccaaactccgcaccgaggctgattatatttgatgttaagaaacggccctctgacgtgtcggatcgcttctcaggtcacaatagcgacaccgccgcgtttttgacaatcagtgaattacgacctgaggatgaagctgactatttctgtacttcctggccataccgttttgatagaggcaccaaggtagacgtggcc

SEQ ID NO: 26957 - RNA, 300 nt, synthetic construct
  misc_feature 1..300: note = derived and/or modified sequence opt3 from anti-HIV_Chain
  source 1..300: mol_type = other RNA
cagagcgccctgacccaacccgctttcgtgtccggctctcctgggcagtcaatcacactcagttgcactcttggaacggaggacgtcagctggtaccagcagagaccaaactccgcaccgaggctgattatatttgatgttaagaaacggccctctgacgtgtcggatcgcttctcaggtcacaatagcgacaccgccgcgtttttgacaatcagtgaattacgacctgaggatgaagctgagtatttctgtacttcctggccataccgttttggcagagggaccaaggtagacgtggcc

SEQ ID NO: 26958 - RNA, 300 nt, synthetic construct
  misc_feature 1..300: note = derived and/or modified sequence opt3 from anti-HIV_Chain
  source 1..300: mol_type = other RNA
cagagcgccctgacccaccccgctttcgtgtccggctctcctgggcaatcaatcacactcagttgcactcttggaacggaggacgtcagctggtaccagcagagaccaaactccgcaccgaggctgattatatttgatgttcggaagcgcccctctgaagtgtcggaccgattctcaggtcataaaagcgataccgccgcgtttttgacaatcagtgacttacgtcctgaggatgaagctgagtatttctgtacttcctggccatacagatttgacaggggcacccggctggatgtagcc

SEQ ID NO: 26959 - RNA, 300 nt, synthetic construct
  misc_feature 1..300: note = derived and/or modified sequence opt3 from anti-HIV_Chain
  source 1..300: mol_type = other RNA
cagagcgtgctgacccaacccgccttcgtctccggctctcctgggcagtcaatcacaattagttgcactgttggaacgaccgacgtgagctggtaccagcagagaccaaactccgctccgaggctcataatctttgatgtaaagaaacggccctctggtgtgtcggaccgcttctcaggcagcagttccgataatgcagcctttcttacaattgcggggctgcgacctgaggacgaagctgagtattactgtacttcttggccatatcgtttcggaagaggcaccaaggtcgatgtgggt

SEQ ID NO: 26960 - RNA, 300 nt, synthetic construct
  misc_feature 1..300: note = derived and/or modified sequence opt3 from anti-HIV_Chain
  source 1..300: mol_type = other RNA
cagagcgtgctgacccaacccgccttcgtctccgcttctcctggccagtcaatcacactcagttgcaaccttgggactgactacgttagctggtatcagcagagaccatcctctgcaccgaggctgattatatttgatgtgaagaatcggccctcgggagtatcagaccgcttcagcggttacaacagtgatacggccgcgtttttgaccatctccggcttacaacctgaggacgaagctgagtattactgtacatcttggccatataatttcgggcccggaactaaagtggatgtcacc

SEQ ID NO: 26961 - RNA, 300 nt, synthetic construct
  misc_feature 1..300: note = derived and/or modified sequence opt3 from anti-HIV_Chain
  source 1..300: mol_type = other RNA
cagagcgtgctgacccaacccgcctccgtctctggctcacctgggcagagtatcaacattagctgcgctggaagatccgacagggtttcttggtaccagcagcggccaaatggtgtgccgaagctccttctgttcgatgtatatcgccgaccctcgggcgtgtcagaccgttttagcgggagtcactccgatgacacagcattcttgactatatctggattacaaacggatgacgaggccgattactattgtaccagccatccttacgcgtttggcccaggtacaaaagtcaacgtgctg

SEQ ID NO: 26962 - RNA, 300 nt, synthetic construct
  misc_feature 1..300: note = derived and/or modified sequence opt3 from anti-HIV_Chain
  source 1..300: mol_type = other RNA
cagagcgtgctgacccaacccgccttcgtctccggctctcctgggcagtcaatcacactcagttgcactcttggaacggaggacgttagctggtaccagcagagaccaaactccgctccgaggctgattatatttgatgtgaagaaacggccctctgacgtatcggatcgcttctcaggtcacaatagcgacaccgcagcctttttgacaatcagtgaattacgacctgaggatgaagcggagtatttctgtacttcctggccataccgttttggcagagggaccaaggtggacgtcgct

SEQ ID NO: 26963 - RNA, 306 nt, synthetic construct
  misc_feature 1..306: note = derived and/or modified sequence opt3 from anti-HIV_Chain
  source 1..306: mol_type = other RNA
cagagcgccctgacccaacccgcttccgtgtctggctcacctgggcagagtatcacaattagctgcactgcagactccgattacgtctcttggtatcagcagagaccaaactcggccccgaagctcatacttttcgacgttaattcaaggcccagcggagtgagtgatcggtactccggttctcgcagcggcaacacggcgtccctgaccatctcagggttgcaacgagaggacgaagctgattatttttgtacaccttggccatacgacttccgtcccggaactagagtatttgtgttaggccag

SEQ ID NO: 26964 - RNA, 306 nt, synthetic construct
  misc_feature 1..306: note = derived and/or modified sequence opt3 from anti-HIV_Chain
  source 1..306: mol_type = other RNA
cagagcgccctgacccaacccgctttcgtgtccggctctcctgggcagtcaatcacactcagttgcagccttggaactgcagacgtctcctggtaccagcagagaccaaactctgccccgaggctgattatatttgatgttaagaaacggccctcggacgtgtcagatcgcttcagcggtcacaatagtgacacggcggcttttgtaaccatctccgagttgcgacctgaagatgaggccgaatatttctgtacatcttggccataccgttttggccccgggactaaggtggacgtcgcaagacaa

SEQ ID NO: 26965 - RNA, 306 nt, synthetic construct
  misc_feature 1..306: note = derived and/or modified sequence opt3 from anti-HIV_Chain
  source 1..306: mol_type = other RNA
cagagcgtgctgacccaacccgcctccgtctctggctcacctgggcagacaatcagtattagctgctccggaactttcggttctgactcggtttcatggtaccagcagtttccaaacagcgctccgacgctcataatcttcgatgtgcacagaaggcccagtggcatttccacccggttttctgggagcacatccggagacactgcatcacttaccatcagtacactgcatcgcgaggatgaagccttctattactgtaccagccacccttatgactttggcggtgggacttacgtaattgtgttg

SEQ ID NO: 26966 - RNA, 306 nt, synthetic construct
  misc_feature 1..306: note = derived and/or modified sequence opt3 from anti-HIV_Chain
  source 1..306: mol_type = other RNA
cagagcgtgctgacccaacccgcctccgtctctggctcacctgggcagacaatcagtattagctgctccggaactttcggttctgactcggtttcatggtaccagcagtatccaaacagcgctccgacgctcataatctttgatgtgcacagaaggcccagtggcatttccacccggttctctgggagcacatccggagacactgcatcacttaccatcagtacactgcatcgcgaggatgaagcctactattactgtaccagccacccttatgactttggcggtgggacttacgtaattgtgttg

SEQ ID NO: 26967 - RNA, 306 nt, synthetic construct
  misc_feature 1..306: note = derived and/or modified sequence opt3 from anti-HIV_Chain
  source 1..306: mol_type = other RNA
cagagcgccctgacccaacccgcttccgtgtctggctcacctgggcagagtatcaacattagctgcgcaggaagatccgacagggtctcttggtaccagcagcggccaaatggtgttccgaagctccttatgttcgatgtgtatcgccgaccctcgggcgtatcagaccgttttagcgggagtcactccggagatacagccttcctgactatatctggcttgcaaacggaggacgaagcggattactattgtaccagccatccttacgcttttggtgccgggacaaaagtgaacgtcttaagacag

SEQ ID NO: 26968 - RNA, 306 nt, synthetic construct
  misc_feature 1..306: note = derived and/or modified sequence opt3 from anti-HIV_Chain
  source 1..306: mol_type = other RNA
gacatccagatgacccaaagcccctcctctctgtcagccagtgtgggcgatagagtcagcattcactgccaggctgggcagggaataggttcctctctcaactggtaccagcaaaagcctggcagggcaccacggcttctggttcatggggcctcgaatttgcagcgcggagtgccgtcacgattcagcggcagtggttttcacacaactttcacgttaaccatctcctctctgcagcccgacgatgtagcgacatattggtgtgctgccctagagtttttcgggcctggaactaaagtggaaatt

SEQ ID NO: 26969 - RNA, 309 nt, synthetic construct
  misc_feature 1..309: note = derived and/or modified sequence opt3 from anti-HIV_Chain
  source 1..309: mol_type = other RNA
gacatccagatgacccaaagcccctcctctctgtcagccagtgtgggcgatacagtcactattacgtgccaggctaacgggtacctcaattggtatcagcagagaaggggaaaggcacctaaacttctgatatacgacggtagcaagttggaacggggcgttccatcccgcttctctgggcgacgttggggacaagaatataacttaaccatcaataacctgcagccggaggatattgccacatacttttgtcaggtgtatgagttcgtagtgcccggcactagactagacctcaaaaggaccgtcgcg

SEQ ID NO: 26970 - RNA, 309 nt, synthetic construct
  misc_feature 1..309: note = derived and/or modified sequence opt3 from anti-HIV_Chain
  source 1..309: mol_type = other RNA
gacatccagatgacccaaagcccctcctctctgtcagccagagtgggcgatacagtcactattacgtgccaggctaacgggtacctcaattggtatcagcagaggcggggaaaggcacctaaacttctgatatacgacggtagtaagttggaacgcggcgttccagcccgattcagcgggcgtagatggggacaagaatataacttaaccatcaataacctgcagccggaggatgtggcgacatacttttgtcaggtatatgagttcattgtgcccggcactaggctagacctcaaacggaccgtcgct

SEQ ID NO: 26971 - RNA, 309 nt, synthetic construct
  misc_feature 1..309: note = derived and/or modified sequence opt3 from anti-HIV_Chain
  source 1..309: mol_type = other RNA
gacatccagatgacccaaagcccctcctctctgtcagccagagtgggcgatacagtcactattacgtgccaggctaacgggtacctcaattggtatcagcagaggcggggaaaggcacctaaacttctgatatacgacggtagtaagttggaacgcggcgttccaagccgattctccgggcgtagatggggacaagaatataacttaaccatcaataacctgcagccggaggatattgccacatacttttgtcaggtgtatgagttcgcggtacccggcactaggctagacctcaaacggaccgtggct

SEQ ID NO: 26972 - RNA, 309 nt, synthetic construct
  misc_feature 1..309: note = derived and/or modified sequence opt3 from anti-HIV_Chain
  source 1..309: mol_type = other RNA
gacatccagatgacccaaagcccctcctctctgtcagccagtgtgggcgatacagtcactattacgtgccaggctaacgggtacctcaattggtatcagcagagaaggggaaaggcacctaaacttctgatatacgacggtagcaagttggaacggggcgttccatcccgcttctctgggcgacgttggggacaagaatataacttaaccatcaataacctgcaggccgaggatattgcgacatacttttgtcaggtgtatgagttcgctgtaccgggcactagactagacctcaaaaggaccgtggcc

SEQ ID NO: 26973 - RNA, 309 nt, synthetic construct
  misc_feature 1..309: note = derived and/or modified sequence opt3 from anti-HIV_Chain
  source 1..309: mol_type = other RNA
gacatccagatgacccaaagcccctcctctctgtcagccagtgtgggcgatacagtcactattacgtgccaggctaacgggtacctcaattggtatcagcagagaaggggaaaggcacctaaacttctgatatacgacggtagcaagttggaacggggcgttccatcccgcttctctgggcgacgttggggacaagaatataacttaaccatcaataacctgcagccggaggatattgccacatacttttgtcaggtgtatgagttcatcgtacccggcactagactagacctcaaaaggaccgtggcg

SEQ ID NO: 26974 - RNA, 309 nt, synthetic construct
  misc_feature 1..309: note = derived and/or modified sequence opt3 from anti-HIV_Chain
  source 1..309: mol_type = other RNA
gacatccagatgacccaaagcccctcctctctgtcagccagagtgggcgatacagtcactattacgtgccaggctaacgggtacctcaattggtatcagcagaggcggggaaaggcacctaaacttctgatatacgacggtagtaagttggaaaccggcgttccaagccgcttcacagggcgacgttggggacaagaatataacttaactatcaataacctgcagccggaggatattgccacctacttttgtcaggtgtatgagttcatcgtacccggcacaagactagacctcaaaaggaccgtggcg

SEQ ID NO: 26975 - RNA, 312 nt, synthetic construct
  misc_feature 1..312: note = derived and/or modified sequence opt3 from anti-HIV_Chain
  source 1..312: mol_type = other RNA
gacatccagatgacccaaagcccctcctctctgtcagccagtgtgggcgataaggtcacaattacttgccagacgagcgctgggtacctcaactggtatcagcagagaaggggacgggcacctaaacttctgatgtacgacggttcccgcttggttaccggcgtgccatctcgattctcggggcgtagatggggaacacaatataatttaactataggctcactgcagccggaggatgtagccacctactattgtcaggtgtacgaatttttcggtcccgggacaaggctagacctcaagcggaccgtcgcg

SEQ ID NO: 26976 - RNA, 312 nt, synthetic construct
  misc_feature 1..312: note = derived and/or modified sequence opt3 from anti-HIV_Chain
  source 1..312: mol_type = other RNA
gacatccagatgacccaaagcccctcctctctgtcagccagtgtgggcgataaggtcacaattacttgccagacgagcgctgggtacctcaactggtatcagcagagaaggggacgggcacctaaacttctgatgtacgacggttcccgcttggttaccggcgtgccatctcgattctcggggcgtagatggggaacacaatataatttaactataggctcactgcagccggaggatatcgccacctactattgtcaggtatacgaatttttcggtcccgggacaaggctagacctcaagagcaccgtggcg

SEQ ID NO: 26977 - RNA, 312 nt, synthetic construct
  misc_feature 1..312: note = derived and/or modified sequence opt3 from anti-HIV_Chain
  source 1..312: mol_type = other RNA
gacatccagatgacccaaagcccctcctctctgtcagccagagtgggcgatacagtcactattacgtgccaggctaacgggtacctcaattggtatcagcagaggcggggaaaggcacctaaacttctgatatacgacggtagtaagttggaacgcggcgttccagcccgattcagcgggcgtagatggggacaagaatataacttaaccatcaataacctgcagccggaggatgtggcgacatacttttgtcaggtatatgagttcattgtgcccggcactaggctagacctcaaacggaccgtcgctgcc

SEQ ID NO: 26978 - RNA, 312 nt, synthetic construct
  misc_feature 1..312: note = derived and/or modified sequence opt3 from anti-HIV_Chain
  source 1..312: mol_type = other RNA
tgcaccgtgagcggcgggtccatcatttcttactattggaactggataagacagtcacccggaaagggtctggaatggctcggctacatcttcgacgggggaagggccaattataaccctagtcttcggagccgcctgacaatgtccgtcgatacttctaaaaatcaaatttcgttgaaggttaaatcagtgacggctgcagacagcgccatctactattgtgcgcgattagatggcgaggcttttcgttactatttcgacagttggggtcaggggaccctggtaacagtgtcctctgccagcactaaggga

SEQ ID NO: 26979 - RNA, 312 nt, synthetic construct
  misc_feature 1..312: note = derived and/or modified sequence opt3 from anti-HIV_Chain
  source 1..312: mol_type = other RNA
gtgagcggcgggagattctccaactacggactgtcttgggtcaggcaggcccccggtcaaggcctcgagtggatggggcggatcgttcctgctattaatcgcgcaaagtatgcccagaaatttcagggacgagtgatacttaccgcggacaagatcacagatactgcttacatggaactgcgttcattgagaagtgaggacacggccattttctattgcgcaagggatccacagatcgaaattcggggcaacgcctttgacatctggggtcaagggaccgtagtgacagtcagctccgcttctactaaagga

SEQ ID NO: 26980 - RNA, 315 nt, synthetic construct
  misc_feature 1..315: note = derived and/or modified sequence opt3 from anti-HIV_Chain
  source 1..315: mol_type = other RNA
agcgacatctccgtggcccccggcgagaccgctagaatttcttgcggggaaaagtcactgggaagtagggcagtccagtggtaccaacaccgggccggtcaggcgcctagcctcataatctataacaatcaggatcgcccatccggcattccggagcgattctctgggtcgcccgactcaccttttggaacaactgctacgcttaccatcacaagcgttgaagccggcgatgaggcagactactattgtcatatttgggatagtcgtgtgccaactaaatgggtattcggtgggggaaccacactgaccgtgttg

SEQ ID NO: 26981 - RNA, 315 nt, synthetic construct
  misc_feature 1..315: note = derived and/or modified sequence opt3 from anti-HIV_Chain
  source 1..315: mol_type = other RNA
agctccatgtctgtgtcacccggcgagaccgccaagatcagttgcgggaaagaaagcattggatccagagctgtccagtggtaccaacagaagtctggtcagcctccatcgctgataatctataacaatcaggacaggccgtcaggcgttcccgagcggttcagcgcaacacctgattttggggccggaactacggcgaccctcacaattactaacgtggaagctgacgatgaggccgactactattgtcacatctacgatgcacgcggcggtaccaattgggtattcgaccgaggggccacacttaccgtgctg

SEQ ID NO: 26982 - RNA, 315 nt, synthetic construct
  misc_feature 1..315: note = derived and/or modified sequence opt3 from anti-HIV_Chain
  source 1..315: mol_type = other RNA
agcttcgtgtccgtcgcccccggccagaccgctagaatcacatgcggggaggaatctctgggatcaaggagtgttatttggtaccaacagcggcctggtcaggcaccaagcctcataatctataacaataacgaccgcccgtccggcattcccgagcgattttctgggtcgcctggatcaactttcggcacgaccgccacacttactatcaccagcgtggaagcgggtgatgaggctgactactattgtcacatttgggatagtcgtagaccaacaaattgggtatttggggaaggaaccactctgacagtgttg

SEQ ID NO: 26983 - RNA, 315 nt, synthetic construct
  misc_feature 1..315: note = derived and/or modified sequence opt3 from anti-HIV_Chain
  source 1..315: mol_type = other RNA
agcttcgtgtccgtcgcccccggccagaccgctagaatcacatgcggggaggaatctctgggatcaaggagtgttatttggtaccaacagcggcctggtcaggcaccaagcctcataatgtataacaatcacgaccgcccgtccggcatccccgagcgattttctgggtcgcctggatcaactttcggcacgaccgccacacttactattaccagcgtggaagcgggtgatgaggctgactactattgtcatatctgggatagtcgtagaccaacaaactgggtatttggggaaggaaccactctgacagtgttg

SEQ ID NO: 26984 - RNA, 315 nt, synthetic construct
  misc_feature 1..315: note = derived and/or modified sequence opt3 from anti-HIV_Chain
  source 1..315: mol_type = other RNA
gacatccagatgacccaaagcccctcctctctgtcagccagtgtgggcgataaggtcacaattacttgccagacgagcgctgggtacctcaactggtatcagcagagaaggggacgggcacctaaacttctgatgtacgacggttcccgcttggttaccggcgtgccatctcgattctcggggcgtagatggggaacacaatataatttaactataggctcactgcagccggaggatatcgccacctactattgtcaggtatacgaatttttcggtcccgggacaaggctagacctcaagagcaccgtggcggct

SEQ ID NO: 26985 - RNA, 315 nt, synthetic construct
  misc_feature 1..315: note = derived and/or modified sequence opt3 from anti-HIV_Chain
  source 1..315: mol_type = other RNA
gacatccagatgacccaaagcccctcctctctgtcagccagtgtgggcgatagagtcagcattaactgccaggctgggcagggactcggttcctctcttaattggtaccagcaaaagcctggcagggcaccaaaactgttggttcacggggcctcgaacttacagcggggagtgccgtcacgcttcagcggcagtggttttcatacaactttcacgctgaccatatcctctctacagcccgacgatgtagcgacatatttttgtgctgccttccagtggtttgggcctggaactaaggtggagatcaaacgaacc

SEQ ID NO: 26986 - RNA, 318 nt, synthetic construct
  misc_feature 1..318: note = derived and/or modified sequence opt3 from anti-HIV_Chain
  source 1..318: mol_type = other RNA
tgcaccgtgagcggcgggtccatctcttcagccggatactattggacatggattagacagcaccccggtaagggcctggagttcatagggtacatctattacattggaactacgtattacaaccctagtctcaaaagcaggcttaccatctccattgacacatctaagaatcaattttcgctgaaattgtcaagcgtcactgctgcagataccgccatctattactgtgcgcgggactacacagctcgcggccgacatttctttgattattggggtcagggggccttagttaccgtgagttccgcatctactaaggga

SEQ ID NO: 26987 - RNA, 321 nt, synthetic construct
  misc_feature 1..321: note = derived and/or modified sequence opt3 from anti-HIV_Chain
  source 1..321: mol_type = other RNA
agctccctgcccctctctcttgcccctggcgctaccgcaaagatcccatgcggggagaaatcaagaggaagtagggccgtgcagtggtaccaacagaagccgggtcaggcgcccacactgattatatataacaatcaggaccggcctgctggcgtcagcgaacgctactccgggaacccagatgttgccatcggagtgactgcaacgttgaccatttctcgagtagaggccggcgacgaagctgagtattactgtcactattgggattcgcgttcacccatcagctgggtgttcggtgggtggacacaattaactgtcctg

SEQ ID NO: 26988 - RNA, 321 nt, synthetic construct
  misc_feature 1..321: note = derived and/or modified sequence opt3 from anti-HIV_Chain
  source 1..321: mol_type = other RNA
agctccctgcccctctctgtggcccctggcgctaccgcaaagatcgcctgcggggagaaatcattcgcgagtagagctgtccagtggtaccaacagaagccaggacaggccccggttcttattatatataacaatcaggacaggcccgccggtgtgagcgaacggttttccggcacacctgatgtagggttcggatctactgcaacgctgaccatctcgcgcgtggaggctggcgacgaagcagattactattgtcacaaatgggactcacgaagcccattgagttgggtctttggtgggggaacacaattaactgtgctg

SEQ ID NO: 26989 - RNA, 321 nt, synthetic construct
  misc_feature 1..321: note = derived and/or modified sequence opt3 from anti-HIV_Chain
  source 1..321: mol_type = other RNA
gacatccagatgacccaaagcccctcctctctgtcagccagtattggcgatagagtgacaataacttgcagggctagccaggacatcgcaaactacctcaattggtatcagaagaagtccgggacgcctccaaaacttctgattttcgccgcgaccaacttgcaccggggagtctctccgcgctttacaggttcgggccatgggactcacttctcattaaccatcacaaatgttcagcatgaggattttggaaactacttctgtcaacagagctttgctaccgtgggcagtttcggtcaggggacttgggtagacattcga

SEQ ID NO: 26990 - RNA, 321 nt, synthetic construct
  misc_feature 1..321: note = derived and/or modified sequence opt3 from anti-HIV_Chain
  source 1..321: mol_type = other RNA
gacatccagatgacccaaagcccctcctctctgtcagccagtattggcgatagagtgacaataacttgcagggctagccaggacatcgcaaactacctcaattggtatcagaagaagtccgggacgcctccaaaacttctgattttcgccgcgaccaacttgcaccggggagtctctccgcgctttacaggttcgggccatgggactcacttctcattaaccatcacaaatgttcagcatgaggattttggacactacttctgtcaacagagctttgctaccgtgggcagtttcggtcaggggacttgggtagacattcga

SEQ ID NO: 26991 - RNA, 321 nt, synthetic construct
  misc_feature 1..321: note = derived and/or modified sequence opt3 from anti-HIV_Chain
  source 1..321: mol_type = other RNA
gacatccagatgacccaaagcccctcctctctgtcagccagtgtgggcgatagagtcacaattacttgcagggctagccaggacatagcaaactacctcaattggtatcagaagaagtccgggacgcctccaaaacttctgatcttcgccgcgaccaacttgcaccggggagtttctccgcgcttttcgggttcaggcagcgggacacatttcagtttaactattaccaatgtgcagtacgaggattttgctaactatttctgtcaacactcctttggaacaatcggcaccttcggtcaggggacttgggtagacattcga

SEQ ID NO: 26992 - RNA, 321 nt, synthetic construct
  misc_feature 1..321: note = derived and/or modified sequence opt3 from anti-HIV_Chain
  source 1..321: mol_type = other RNA
gacatccagatgacccaaagcccctcctctctgtcagccagtattggcgatagagtgacaataacttgcagggctagccaggacatcgcaaactacctcaattggtatcagaagaagtccgggacgcctccaaaacttctgattttcggagccaccaacttgcaccatggtgtctctccgcggttttcgggctcagggcacggaacacatttcagcttaactatcaccaatgttcagcacgaggattttgcgaactacttctgtcaacagagttttcagacagtgggctccttcggtcaggggacctgggtagacattcgc

SEQ ID NO: 26993 - RNA, 321 nt, synthetic construct
  misc_feature 1..321: note = derived and/or modified sequence opt3 from anti-HIV_Chain
  source 1..321: mol_type = other RNA
gaaatcgtgctgacccagagccccgccacactctccctttctcctggcgaaactgctattatatcatgcagaacgagtcaaagcgggtccctggcatggtaccagcagaggccaggacaggccccgcggttggtcatctattctggttcgacccgcgcggctggcattcccgaccgattctcagggagccgttggggagccgattacaacttaagtatctccaatctggagtctggcgactttggtgtttattactgtcaacagtatgagttctttgggcagggaacaaaggtgcaggtagatattaaaagaactgtggca

SEQ ID NO: 26994 - RNA, 321 nt, synthetic construct
  misc_feature 1..321: note = derived and/or modified sequence opt3 from anti-HIV_Chain
  source 1..321: mol_type = other RNA
gacatccagatgacccaaagcccctcctctctgtcagccagtattggcgatagagtgaacataacatgccaggctagcagggacactgggtccgcactcaattggtaccagcagaaggtcggacggcctccacgccttctgatctctgccgtttcgaacttgggtgcgggcgtgccgtcacgattcagcgggcgtagaagtggaacgcaatccaccttaacaattaatactctgcagcccgaagatatcgctacctatttttgtcagcactacgagttctttggccctggtacaaaagtagacattaagaggaccgtggcc

SEQ ID NO: 26995 - RNA, 321 nt, synthetic construct
  misc_feature 1..321: note = derived and/or modified sequence opt3 from anti-HIV_Chain
  source 1..321: mol_type = other RNA
gacatccagatgacccaaagcccctcctctctgtcagccagtgtgggcgatagagtcacaattacttgccaggctgggcagggaataggtagctccctccagtggtaccaacagaagcctggcaaagcaccaaaacttctggttcacggggcctctaacttgcataggggagtgccgtcgcggttctcaggcagcggttttcacacgaccttcagtttaacaatctccgggctgcagcgcgacgattttgcgacttatttctgtgctgtactagagtttttcggacccggcaccaaggtggaaattaagcgaacagtcgcc

SEQ ID NO: 26996 - RNA, 324 nt, synthetic construct
  misc_feature 1..324: note = derived and/or modified sequence opt3 from anti-HIV_Chain
  source 1..324: mol_type = other RNA
agctacgtgagacccctgtccgtcgccctcggcgagaccgcttctatctcatgcgggaggcaggcacttggaagtcgggccgttcaatggtatcagcaccgccctggtcaggcgccaattctgttgatatacaacaatcaggaccgaccgagcggcatccccgaacgtttctccgggacacctgatattaactttggaactagagctacgttaaccatctctggcgtggaggccggtgacgaagcagattattactgtcatatgtgggactcgaggtcagggttcagctggagttttggaggcgccacacggctgactgtacta

SEQ ID NO: 26997 - RNA, 324 nt, synthetic construct
  misc_feature 1..324: note = derived and/or modified sequence opt3 from anti-HIV_LightChain
  source 1..324: mol_type = other RNA
gacatcctgatgacccagagcccctccctcctttctgcctcagtgggcgatagagtcacaattacttgcaaggctagtcaagacgttagcacggcagtggcctggtaccagcagaaacctgggaaggcgccaaaactgttgatatattgggcttccaccaggcacacaggagtaccgtctcggttcactggttcgggctcagggaccgattttacattaaccatcagccgcctgcaggccgaggacttcgcactatactattgtcaacagcattacactacaccctggacctttggaggcggtacgaaggtggaaattaaacga

SEQ ID NO: 26998 - RNA, 324 nt, synthetic construct
  misc_feature 1..324: note = derived and/or modified sequence opt3 from anti-HIV_LightChain
  source 1..324: mol_type = other RNA
gacatcgtgatgacccagagcccctccctgctctctgcctcagtcggcgatagagttacaattacttgcaaggctagtcaagacgtgagcacggcagtagcctggtaccagcagaaacctgggaaggcgccaaaacttctgatatattgggcttccaccaggcacacaggagtgccgtctcggttctcgggttcaggcagcgggactgattttaccttgacaatcagttccttacagcccgaggacttcgccctgtactattgtcaacagcattacaccactccttggacatttggaggcggtaccaaggtcgaaattaaacgc

SEQ ID NO: 26999 - RNA, 324 nt, synthetic construct
  misc_feature 1..324: note = derived and/or modified sequence opt3 from anti-HIV_Chain
  source 1..324: mol_type = other RNA
gacatccagatgacccaaagcccctcctctctgtcagccagtgtgggcgatacagtcactattaactgccagacgaataaggggtacctcaactggtatcagcagagaaggggacgggctcctaaacttctgatgtacgacggtagcaagttggttaccggcgtgccatcccgcttctctgggcgacgttggggaacacaatataatttaactataggctcgctgcagccggaggatatcgcaacctactattgtcaggtatacgaatttttcggtcccgggacaagactagacctcaaaaggaccgtggccgcgccttcagat

SEQ ID NO: 27000 - RNA, 333 nt, synthetic construct
  misc_feature 1..333: note = derived and/or modified sequence opt3 from anti-HIV_Chain
  source 1..333: mol_type = other RNA
ctgagcgcctacgtgggcgacagagtcaccatcacatgcagggcttcccagaacattaatacttatctcaactggtaccaacagcggcccgggaaggcacctaaacttctgatatatgccgcgtctacgttgcagtcaggagttccaagtcgcttcagcggttccggctctgggaccgattttacattaactatctcgaatctggagaccgaagacttcgctgtgtactattgtcagcaaacatactcaagcgtaacctttggacagggcactaagctagagacacgacgtaccgtggccgcaccgagtgtcttcatttttcccccttccgat

SEQ ID NO: 27001 - RNA, 333 nt, synthetic construct
  misc_feature 1..333: note = derived and/or modified sequence opt3 from anti-HIV_Chain
  source 1..333: mol_type = other RNA
gagatcgtgctgacccagagccccgccacactctccctttctcctggcgaaagagctactctgtcatgcagggcaagtcaaggggtcaacttcgttgtgtggtaccagcagaagcggggacaggccccacgcttgttaatttatggtaatagcgaccgagtaccgggcgtgcccgatcgtttttccgcgagagggtctggaacggagttctcgctggtcatatcaagcgtggaacctgacgattttgctctatactattgtcaagagtacagttccaccccatataacttcggccccggtacaagggttgaccggaaacgcactgtggccgca

SEQ ID NO: 27002 - RNA, 336 nt, synthetic construct
  misc_feature 1..336: note = derived and/or modified sequence opt3 from anti-HIV_HeavyChain
  source 1..336: mol_type = other RNA
gaggtgaagctggaagagagcggcgggggactcgtccagcccggtggctccagaaaactttcttgcgccgcttcagggttcacctttagtagcttcggaatgcactgggttaggcaagcacctgaaaagggcctggagtgggtggcctacatctcctctggttcgtcaacattgcattatgcggacactgtaaaagggcggtttacgattagccgcgataacccaaagaataccttattcctgcagatgaaactaccgagtctctgttacggactgcttggctcccgaaacctgtctcaccgtttgctcagccagaatgacacacccatatgcctg

SEQ ID NO: 27003 - RNA, 336 nt, synthetic construct
  misc_feature 1..336: note = derived and/or modified sequence opt3 from anti-HIV_Chain
  source 1..336: mol_type = other RNA
gagatcgtgctgacccagagccccgccacactctccctttctcctggcgaaagagctactctgtcatgcagggcaagtcaaggggtcaacttcgttgtgtggtaccagcagaagcggggacaggccccacgcttgttaatttatggtccgagcgaccgagcgcccggcgtacctgatcgtttttccgctagagggtctggaacggagttctcgctggtgatatcaagcgtcgaaccagacgattttgccctatactattgtcaagagtacagttccaccccctataatttcggcacaggtactagggtggaccggaaacgcaccgttgcagcccct

SEQ ID NO: 27004 - RNA, 336 nt, synthetic construct
  misc_feature 1..336: note = derived and/or modified sequence opt3 from anti-HIV_Chain
  source 1..336: mol_type = other RNA
cagaccctgagcctcacatgctccgtgtctggcgggtcaatcagtagcgccggatactattggggttggattagacaacaccccggcaaggggcttgagtggataggacatatctactattccggcaacactaattacaacccttctctgaaatcgaggttgtcaatgagcgtcgaaacgagtaagaatcagttctccttaaacctggcttctgttaccgcagccgacacagcggtgtatttttgtgctcgggattacagcgccgcaggtcgccacctattcgactcctgggggcagggcattctcgtaactgtgtcaagtgccagcaccaaagga

SEQ ID NO: 27005 - RNA, 336 nt, synthetic construct
  misc_feature 1..336: note = derived and/or modified sequence opt3 from anti-HIV_LightChain
  source 1..336: mol_type = other RNA
gacatcgtgatgacccagcaaacacccctgactctcagcattacgataggccagcctgcctccatctcttgcaagtcaagtcagagccttctggattccgacgggaaaacctacttgaactggttactgcagagaccaggacaatctccgaagaggctaatttattggatgtcgaaactcgattcaggtgtccccgaccggttcacaggcagcgggagtggaactgattttaccctgaagatctcccgcgttgaggctgaagaccttggcgtgtactattgttggcagggtacacacttcccttggacctttgggggaggcactaaactggagttg

SEQ ID NO: 27006 - RNA, 339 nt, synthetic construct
  misc_feature 1..339: note = derived and/or modified sequence opt3 from anti-HIV_LightChain
  source 1..339: mol_type = other RNA
gacatcgtgattacccagagcacaaagttcatgtccacttctgtcggcgatagagtttcaataacgtgcaaagccagtcaagacgtgagcaccgctgtagcatggtaccagcagaagcccgggcagtcccctaaactgctcatctattgggcctctacaaggcacactggagtgccagatcggtttaccggttcgggctcagggacagactacacccttactattagccgcgtccaagcggaggatctggctttgtattactgtcagcagcattatacaaccccgtggacgttcggaggcggtactaagttagaaatcaaacgaaccgtggccgcaccc

SEQ ID NO: 27007 - RNA, 339 nt, synthetic construct
  misc_feature 1..339: note = derived and/or modified sequence opt3 from anti-HIV_Chain
  source 1..339: mol_type = other RNA
gacatccagatgacccaaagcccctcctctctgtcagccagagtgggcgatacagtcactttcacgtgccaggctaacgggtacctcaattggtatcagcagaggcggggaaaggcacctaaacttctgatttacgacggtagtaagttggagcgcggcgttccaagccgattttccgggcgtagatggggacaagaatataacttaaccataaataacctgcagccggaggatatcgccacatacttctgtcaggtgtatgaatttgcggtacccggcactaggctagacctcaaacggaccgtggctgccccttctgtcttcatttttccatcggat

SEQ ID NO: 27008 - RNA, 339 nt, synthetic construct
  misc_feature 1..339: note = derived and/or modified sequence opt3 from anti-HIV_Chain
  source 1..339: mol_type = other RNA
cagagcgtgctgacccaacccgcctccgtctctggctcacctgggcagagtatcacaattagctgcactggaacgaactccgacgttggttactcttatgtgtcgtggttccagcagcacccaggcaaggtaccgaaactccttatatacgatgtgtcaagaaggagcagtggggtctccaatcggttttctggaagccgctccggcaacaccgcttcactgacaatcagtggtttgcgagcagaggacgaagccgattattactgtgggagcttcactacctctttaacactggtgtttggaggcggcaccaagctagcggttctcgtgtccccctca

SEQ ID NO: 27009 - RNA, 339 nt, synthetic construct
  misc_feature 1..339: note = derived and/or modified sequence opt3 from anti-HIV_Chain
  source 1..339: mol_type = other RNA
agcctgtccgcctctgtgggcgacagagtcaccatcacatgcagggcttcagagagtattagcttctacctcaactggtatcagcaaaagcccgggaaagcacctgaacttctgatatttgccacttccacgttgcactctggagttccatcgcggttctcaggtagcggcagtgggaccgattttacattaactatctcctctctgcagctagaggacttcgcgacctactattgtcagcagagctcctcaacaccgtttaccttcggaggcggtactaaggtggaaattaaacgcacagtagctgcccccagtgtgtttatcttccctccaagcgat

SEQ ID NO: 27010 - RNA, 342 nt, synthetic construct
  misc_feature 1..342: note = derived and/or modified sequence opt3 from anti-HIV_Chain
  source 1..342: mol_type = other RNA
gacatccagatgacccaaagcccctcctctctgtcagccagtgtgggcgatacagtcactattacgtgccaggctaacgggtacctcaattggtatcagcagagaaggggaaaggcacctaaacttctgatatacgacggtagcaagttggaacggggcgttccatcccgcttctctgggcgacgttggggacaagaatataacttaaccatcaataacctgcagccggaggatattgccacatacttttgtcaggtgtatgagttcatcgtacccggcactagactagacctcaaaaggaccgtggcggctccttcggtctttattttcccaccctcagat

SEQ ID NO: 27011 - RNA, 342 nt, synthetic construct
  misc_feature 1..342: note = derived and/or modified sequence opt3 from anti-HIV_Chain
  source 1..342: mol_type = other RNA
gacatccagatgacccaaagcccctcctctctgtcagccagagtgggcgatacagtcactattacgtgccaggctaacgggtacctcaattggtatcagcagaggcggggaaaggcacctaaacttctgatatacgacggtagtaagttggaacgcggcgttccaagccgattctccgggcgtagatggggacaagaatataacttaaccatcaataacctgcagccggaggatattgccacatacttttgtcaggtgtatgagttcgcggtacccggcactaggctagacctcaaacggaccgtggctgccccttctgtctttatcttcccaccctcggat

SEQ ID NO: 27012 - RNA, 342 nt, synthetic construct
  misc_feature 1..342: note = derived and/or modified sequence opt3 from anti-HIV_Chain
  source 1..342: mol_type = other RNA
gacatccagatgacccaaagcccctcctctctgtcagccagagtgggcgatacagtcactattacgtgccaggctaacgggtacctcaattggtatcagcagaggcggggaaaggcacctaaacttctgatatacgacggtagtaagttggaacgcggcgttccaagccgattctccgggcgtagatggggacaagaatataacttaaccatcaataacctgcagccggaggatattgccacatacttttgtcaggtgtatgagttcgtagtgcccggcactaggctagacctcaaacggaccgtcgcggctccttctgtgtttatcttcccaccctcggat

SEQ ID NO: 27013 - RNA, 342 nt, synthetic construct
  misc_feature 1..342: note = derived and/or modified sequence opt3 from anti-HIV_Chain
  source 1..342: mol_type = other RNA
gacatccagatgacccaaagcccctcctctctgtcagccagagtgggcgatacagtcactttcacgtgccaggctaacgggtacctcaattggtatcagcagaggcggggaaaggcacctaaacttctgatttacgacggtagtaagttggagcgcggcgttccaagccgattttccgggcgtagatggggacaagaatataacttaaccataaataacctgcagccggaggatatcgccacatacttctgtcaggtgtatgaatttgcggtacccggcactaggctagacctcaaacggaccgtggctgccccttctgtcttcatttttccaccctcggat

SEQ ID NO: 27014 - RNA, 342 nt, synthetic construct
  misc_feature 1..342: note = derived and/or modified sequence opt3 from anti-HIV_Chain
  source 1..342: mol_type = other RNA
gacatccagatgacccaaagcccctcctctctgtcagccagtgtgggcgatacagtcactattacgtgccaggctaacgggtacctcaattggtatcagcagagaaggggaaaggcacctaaacttctgatgtacgacggtagcaccttggaacggggcgttccagcccgcttctccgggcgacgttggggacaagaatataacttaacaataaataacctgcagccggaggatgtggcgacttacttttgtcaggtatatgagttcatcgtgcccggcaccagactagacctcaagaggacagtcgctgccccttctgtgtttattttcccaccctcggat

SEQ ID NO: 27015 - RNA, 342 nt, synthetic construct
  misc_feature 1..342: note = derived and/or modified sequence opt3 from anti-HIV_Chain
  source 1..342: mol_type = other RNA
gacatccagatgacccaaagcccctcctctctgtcagccagtgtgggcgatacagtcactattacgtgccaggctaacgggtacctcaattggtatcagcagagaaggggaaaggcacctaaacttctgatatacgacggtagcaagttggaacggggcgttccatcccgcttctctgggcgacgttggggacaagaatataacttaaccatcaataacctgcaggccgaggatattgcgacatacttttgtcaggtgtatgagttcgctgtaccgggcactagactagacctcaaaaggaccgtggccgcaccctcggtctttatcttccctccatcagat

SEQ ID NO: 27016 - RNA, 342 nt, synthetic construct
  misc_feature 1..342: note = derived and/or modified sequence opt3 from anti-HIV_Chain
  source 1..342: mol_type = other RNA
gacatccagatgacccaaagcccctcctctctgtcagccagtgtgggcgatacagtcactttcacgtgccaggctaacgggtacctcaattggtatcagcagagaaggggaaaggcacctaaacttctgatttacgacggtagccggttggagcgcggcgttccatcccgattttctgggcgtagatggggacaagaatataacttaaccataaataacctgcagccggaggatatcgccacatacttctgtcaggtgtatgaatttgcggtacccggcactaggctagacctcaagcggaccgtggctgccccttcggtcttcatttttccaccctcagat

SEQ ID NO: 27017 - RNA, 342 nt, synthetic construct
  misc_feature 1..342: note = derived and/or modified sequence opt3 from anti-HIV_Chain
  source 1..342: mol_type = other RNA
gacatccagatgacccacagcccctcctctctgtcagccagtgtgggcgatacagtcactattacgtgccaagctaacgggtacctcaattggtatcagcagagaaggggaaaggcacctaaacttctgatatacgacggtagcaagttggaaaccggcgttccatcccggttcacagggcgccgatggggacaggaatataacttaactatcaataacctgcaaccggaggatattgccacctacttttgtcaggtgtatgagttcatcgtacccggcacacgtctagacctcaaaagaaccgtggcggctccttctgtctttattttcccaccctcggat

SEQ ID NO: 27018 - RNA, 342 nt, synthetic construct
  misc_feature 1..342: note = derived and/or modified sequence opt3 from anti-HIV_Chain
  source 1..342: mol_type = other RNA
gacatccagatgacccaaagcccctcctctctgtcagccagagtgggcgatacagtcactattacgtgccaggctaacgggtacctcaattggtatcagcagaggcggggaaaggcacctaaacttctgatatacgacggtagtaagttggaaaccggcgttccaagccgcttcacagggcgacgttggggacaagaatataacttaactatcaataacctgcagccggaggatattgccacctacttttgtcaggtgtatgagttcatcgtacccggcacaagactagacctcaaaaggaccgtggcggctccttccgtctttattttcccaccctctgat

SEQ ID NO: 27019 - RNA, 342 nt, synthetic construct
  misc_feature 1..342: note = derived and/or modified sequence opt3 from anti-HIV_Chain
  source 1..342: mol_type = other RNA
gacatccagatgacccaaagcccctcctctctgtcagccagagtgggcgatacagtcactttcacgtgccaggctaacgggtacctcaattggtatcagcagaggcggggaaaggcacctaaacttctgatttacgacggtagtaagttggagcgcggcgttccaagccgattttccgggcgtggatggggccaagaatataacttaaccataaataacctgcagccggaggatatcgccacatacttctgtcaggtgtatgaatttgcggtacccggtactagactagacctcaaaaggaccgtggctgccccttctgtcttcatttttccaccctcggat

SEQ ID NO: 27020 - RNA, 342 nt, synthetic construct
  misc_feature 1..342: note = derived and/or modified sequence opt3 from anti-HIV_Chain
  source 1..342: mol_type = other RNA
gacatccagatgacccaaagcccctcctctctgtcagccagtgtgggcgatacagtcactattacgtgccaggctaacgggtacctcaattggtatcagcagagaaggggaaaggcacctaaacttctgatatacgacggtagcaagttggaacggggcgttccatcccgcttctctgggcgacgttggggacaagaatataacttaaccatcaataacctgcagccggaggatattgccacatacttttgtcaggtgtatgagttcgtagtgcccggcactagactagacctcaaaaggaccgtcgcggctccttcggtgtttatcttcccaccctcagat

SEQ ID NO: 27021 - RNA, 342 nt, synthetic construct
  misc_feature 1..342: note = derived and/or modified sequence opt3 from anti-HIV_Chain
  source 1..342: mol_type = other RNA
agccagtccgtggtcacccaagagccctctctgacagtttcacctggcgggactgtgacgcttacctgcggaccaagtacaggtgccgtaactagcggcttctacccgcactggtttcagcagaagcccgggcaggctcctagagcactcatctattccacctctaacaaatactcgtggacaccagccaggttctcaggaagcctgttgggcggtaaggcggtgttaaccctgagtgacgtccaacccgatgacgaagctgagtattactgtctactcctgctttattacgggggaccttggatttttggcggcgggactaaactgacagtgttggtttcc

SEQ ID NO: 27022 - RNA, 345 nt, synthetic construct
  misc_feature 1..345: note = derived and/or modified sequence opt3 from anti-HIV_Chain
  source 1..345: mol_type = other RNA
gacatccagatgacccaaagcccctcctctctgtcagccagtgtgggcgataaggtcacaattacttgccagacgagcgctgggtacctcaactggtatcagcagagaaggggacgggcacctaaacttctgatgtacgacggttcccgcttggttaccggcgtgccatctcgattctcggggcgtagatggggaacacaatataatttaactataggctcactgcagccggaggatgtagccacctactattgtcaggtgtacgaatttttcggtcccgggacaaggctagacctcaagcggaccgtcgcggctcctagcgtgtttatcttcccacccagtgat

SEQ ID NO: 27023 - RNA, 345 nt, synthetic construct
  misc_feature 1..345: note = derived and/or modified sequence opt3 from anti-HIV_Chain
  source 1..345: mol_type = other RNA
gacatccagatgacccaaagcccctcctctctgtcagccagtgtgggcgatacagtcactattacgtgccagaccacaaaggggtacctcaactggtatcagcagagaaggggacgggctcctaaacttctgatgttcgacggtagcaagttggttactggcgtgccatcccgcttttctgggcgacgttggggaacccaatacaatttaacaataggctcgctgcagccggaagatctagcaacctattactgtcaggtatatgagttctttggtcccgggactagactcgacctgaaaaggacagtggccgcgccttcagtcttcatctttccacccagcgat

SEQ ID NO: 27024 - RNA, 345 nt, synthetic construct
  misc_feature 1..345: note = derived and/or modified sequence opt3 from anti-HIV_Chain
  source 1..345: mol_type = other RNA
gacatccagatgacccaaagcccctcctctctgtcagccagtgtgggcgatacagtcactattacgtgccagaccaacaaggggtacctcaattggtatcagcagagaaggggacgggctcctaaacttctgatgtgtgacggtagcaagttggttacaggcgtgccatcccgcttctctgggcgacgttggggaactcaatacaacttaaccataggctcgctgcagccggaggatatcgcaacatattactgccaggtatatgaatttttcggtcccgggaccagactagacctcaaaaggactgtggccgcgccttcagtctttattttcccacccagcgat

SEQ ID NO: 27025 - RNA, 345 nt, synthetic construct
  misc_feature 1..345: note = derived and/or modified sequence opt3 from anti-HIV_Chain
  source 1..345: mol_type = other RNA
gacatccagatgacccaaagcccctcctctctgtcagccagagtgggcgataaggtcacaattacttgccagacgagtgctgggtacctcaactggtatcagcagaggcggggacgcgcacctaaacttctgatgtacgacggtagccgattggttaccggcgtgccatcccgtttctctgggagaaggtggggaacacaatataatttaactataggctcgctgcagccggaggatatcgccacctactattgtcaggtatacgaatttttcggtcccgggacacggctagacctcaagcgcaccgtggcggctccttcagtctttattttcccacccagcgat

SEQ ID NO: 27026 - RNA, 345 nt, synthetic construct
  misc_feature 1..345: note = derived and/or modified sequence opt3 from anti-HIV_Chain
  source 1..345: mol_type = other RNA
gacatccagatgacccaaagcccctcctctctgtcagccagtgtgggcgatacagtcactattacgtgccagaccaacaaggggtacctcaattggtatcagcagaaaagaggaagggctcctaaacttctgatgtacgacggtagcaagttggttacaggcgtgccatcccggttatctgggcgccgatggggaactcaatataacctgaccataggctcgctacagccggaagatatcgcaacatactattgtcaggtatacgagttctttggtcccgggacccgtctcgacctgaagagaactgtggccgcgccttcagtcttcatttttccacccagcgat

SEQ ID NO: 27027 - RNA, 345 nt, synthetic construct
  misc_feature 1..345: note = derived and/or modified sequence opt3 from anti-HIV_Chain
  source 1..345: mol_type = other RNA
gacatccagatgacccaaagcccctcctctctgtcagccagtgtgggcgatacagtcactattacgtgccagaccaacaaggggtacctcaattggtatcagcagagaaggggacgggctcctaaacttctgatgtacgacggtagcaagttggttacaggcgtgccatcccgcttatctgggcgacgttggggaactcaatataacctgaccataggctcgctacagccggaagatatcgcaacatactattgtcaggtatacgagttctttggtcccgggaccagactcgacctgaaaaggactgtggccgcgccttcagtcttcatttttccacccagcgat

SEQ ID NO: 27028 - RNA, 345 nt, synthetic construct
  misc_feature 1..345: note = derived and/or modified sequence opt3 from anti-HIV_Chain
  source 1..345: mol_type = other RNA
gacatccagatgacccaaagcccctcctctctgtcagccagtgtgggcgatacagtcactattacgtgccacaccaacaaggggtacctcaattggtatcagcagagaaggggacgggctcctaaacttctgatgttcgacggtagcaagttggttacaggcgtgccatcccgcttttctgggcgacgttggggaactcagtacaacttaaccataggctcgctgcaaccggaggatatcgcaacatattactgtcaggtatatgaagtgttcggtcccgggaccagactagacctcaaaaggactgtcgccgcgccttcagtgtttattttcccacccagcgat

SEQ ID NO: 27029 - RNA, 345 nt, synthetic construct
  misc_feature 1..345: note = derived and/or modified sequence opt3 from anti-HIV_Chain
  source 1..345: mol_type = other RNA
gacatccagatgacccaaagcccctcctctctgtcagccagtgtgggcgatacagtcactattaactgccagacgaataaggggtacctcaactggtatcagcagagaaggggacgggctcctaaacttctgatgtacgacggtagcaagttggttaccggcgtgccatcccgcttctctgggcgacgttggggaacacaatataatttaactataggctcgctgcagccggaggatatcgcaacctactattgtcaggtatacgaatttttcggtcccgggacaagactagacctcaaaaggaccgtggccgcgccttcagtctttattttcccacccagcgat

SEQ ID NO: 27030 - RNA, 345 nt, synthetic construct
  misc_feature 1..345: note = derived and/or modified sequence opt3 from anti-HIV_Chain
  source 1..345: mol_type = other RNA
gacatccagatgacccaaagcccctcctctctgtcagccagagtgggcgataaggtcacaattacttaccagacgagtgctgggtatctcaactggtaccagcagaggcggggacgcgcacctaaacttctgatgtatgacggtagccgattggttaccggcgccccatcccgtttctctgggagaaggtggggaacacaatacaatttaactataggctcgctgcagccggaggatatcgcgacctattactgccaggtgtatgaatttttcggtcccgggacacggctagacctcaagcgcaccgtagctgccccttcagtgtttattttcccacccagcgat

SEQ ID NO: 27031 - RNA, 345 nt, synthetic construct
  misc_feature 1..345: note = derived and/or modified sequence opt3 from anti-HIV_Chain
  source 1..345: mol_type = other RNA
gacatccagatgacccaaagcccctcctctctgtcagccagtgtgggcgatacagtcactattacgtgccagaccaacaaggggtacctcaattggtatcagcagagaaggggacgggctcctaaacttctgatgtacgacggtagcaagttggttacaggcgtgccatcccgcttctctgggcgacgttggggaactcaatataacttaaccataggctcgctgcagccggaggatatcgcaacatactattgtcaggtatacgaatttttcggtcccgggaccagactagacctcaaaaggactgtggccgcgccttcagtctttattttcccacccagcgat

SEQ ID NO: 27032 - RNA, 345 nt, synthetic construct
  misc_feature 1..345: note = derived and/or modified sequence opt3 from anti-HIV_Chain
  source 1..345: mol_type = other RNA
gtgaccctgagcctctcccccggcgagagagccacactttcttgcagggcttcacagactatcagtaacaattacctggcatggtatcaacagaagcctgggcaggccccacggttgttaatttacggagcgagctccggtgctacgggcctgccggaccgcttctctgggtcgggatcaggcaccgattttacactaactataagccgactcgaacccgaggacttcgccgtctattactgtcaccagtatgcactgagtccttggacctttggtcgtgggacaaaagttgaaatcaagagaaccgtggccgctccatccgtattcatttttcccccttctgat

SEQ ID NO: 27033 - RNA, 345 nt, synthetic construct
  misc_feature 1..345: note = derived and/or modified sequence opt3 from anti-HIV_Chain
  source 1..345: mol_type = other RNA
accctgagcgcctccgtgggcgacagagtcacaatcacttgcagggcttctcagtcaattaacaattacctcaactggtatcaacagaagcccgggaaagcacctaaacttctgatatacgccgcgagtagcttgcagtccggagttccatctcggttctcgggttcaggcagcgggacggattttaccttaacaatcagttccctgcagccggaggacttcgtgacttattactgtcaacagacctattctaatccccgcatgtttggacagggcacaaaggtagaaattaagcgaaccgtggctgcccctagcgtcttcatctttccaccctccgatgagcag

SEQ ID NO: 27034 - RNA, 345 nt, synthetic construct
  misc_feature 1..345: note = derived and/or modified sequence opt3 from anti-HIV_Chain
  source 1..345: mol_type = other RNA
cagagcgccctgacccaagctccctccgcatctggcacacctgggcagagagtgactatctcatgcagtggaggtggcagcaacattgggggaaatctcgtctcctggtaccagcacttcccaggcgccgcgccgaaacttctgatatataggaacgaccagcggccctctggtgttcctgatcgcttttcggcttcaaagagcgggacgagtgcctccttggcaatctctggattacgaagcgacgatgaggccacctacttctgtgctgcatatgactccacactgtcactacgtctctttggcggcgggactaccctggccgtgcttagtcaaccaaaggct

SEQ ID NO: 27035 - RNA, 345 nt, synthetic construct
  misc_feature 1..345: note = derived and/or modified sequence opt3 from anti-HIV_Chain
  source 1..345: mol_type = other RNA
aagcccagccagaccctgtccctcacatgcactgtgtctggcgggtcaatcagtagcgccggatactattggacgtggattagacaccatcctggtaaaggccttgagttcatagggtacatctatcacattggaaccccatactataacccgtccctgaagtctaggttgacaatctcgattgacactagcaaaaatcaattttcattaaagctgagttccgtcaccgctgcagatacagccatctactattgtgcgcgggactacaccgctcgcggccgacatttctttgattactggggtcagggggccctagttactgtgtctagcgcatccacaaaagga

SEQ ID NO: 27036 - RNA, 345 nt, synthetic construct
  misc_feature 1..345: note = derived and/or modified sequence opt3 from anti-HIV_Chain
  source 1..345: mol_type = other RNA
cccagcgagaccctgtccctcacatgcagagtgtctggcgcctcaatcagtaacttctactggacttggattaggcagcctgctgggaagggacttgaatggataggtcggctgtatagctccgacaaaacgaattacaacccatctttgaatggccgcgtcaccatgtcgttagatacatcaaagaaccaatttagcctgcgactaaccagtatgactgacgcagatacagccatctattactgtgcgcgtgagaaagggcagtgggttaccctcccgccctattacttcgactcctggggacagggcattctggtgactgtatctagcgcttccacaaagggt

SEQ ID NO: 27037 - RNA, 348 nt, synthetic construct
  misc_feature 1..348: note = derived and/or modified sequence opt3 from anti-HIV_Chain
  source 1..348: mol_type = other RNA
ggccccgccaccctgagcgtgtcccctggggagagagctacactctcttgcagggcatcacagagtcttcggaacaatctggcctggtaccaacagaagactggacagagcccacgcttgttaatctatgcggtctccacgcgagctaccggtattccgccccgtttctctggcgggggatcgggcacagaatttactctgaccatagactcactacagagcgaggatttcgccgtttacttttgtcaacagtatgacagtcctcagtggacattcggtcaggggaccaaagtggaaatcaagagaactgtagcagccccatccgtgtttattttccctccctctgat

SEQ ID NO: 27038 - RNA, 348 nt, synthetic construct
  misc_feature 1..348: note = derived and/or modified sequence opt3 from anti-HIV_Chain
  source 1..348: mol_type = other RNA
gcccccgtgaccctgagcgcttccgtcggcgacacagttactatcacgtgcagagcatctcagcctattgccaccttcctcaactggtaccaacacaagccagggcaggcgccgaaacttctgatatatgctgcctcaacatttcagaggggagcacccagtcggtacagcggttccggctctgggactgatttcaccttgacaatcaattcgttacagcctgaggacctggccacctattactgtcaacagacttttacagatccagtgaccttcggacagggcacgcgcctagaaattaagcgaactgtagctgcaccctcagtgtttatcttccctccaagcgac

SEQ ID NO: 27039 - RNA, 351 nt, synthetic construct
  misc_feature 1..351: note = derived and/or modified sequence opt3 from anti-HIV_LightChain
  source 1..351: mol_type = other RNA
gacatccagatgacccaaagcccctccacactgtctgcctcaattggcgatactgtgagaataagttgcagggctagccagtccatcaccgggggatggctcgcatggtaccaccagcggcctggtaaggccccacgccttctgatttatcgaggctctcgtttgttagggggagtcccgtcgagattctcaggcagcgcggctggtacggactttacactgactatcgccaacctacaggcagaggatttcgggaccttttactgtcaacagtatgacacataccccggaaccttcggccagggcactaaagttgaagtgaagaggacagtagccgctcctagtgtgttt

SEQ ID NO: 27040 - RNA, 351 nt, synthetic construct
  misc_feature 1..351: note = derived and/or modified sequence opt3 from anti-HIV_LightChain
  source 1..351: mol_type = other RNA
gacatccagatgacccaaagcccctccacactgtctgcctcaattggcgatactgtgagaataagttgcagggctagccagtccatcacggggaactgggtcgcatggtaccagcagcggcctggaaaggccccacgcctccttatttatcgaggtgcggctctgttgggcggggttccgtctcgtttctcgggatcagccgcaggcaccgactttacattaactatcggtaatctgcaaaccgaggatttcgggacattttactgtcagcagtatgacacctaccccggaactttcggccagggcacaaaagtggaagtaaagagaaccgtggccgctcctagcgtcttt

SEQ ID NO: 27041 - RNA, 351 nt, synthetic construct
  misc_feature 1..351: note = derived and/or modified sequence opt3 from anti-HIV_LightChain
  source 1..351: mol_type = other RNA
gacatccagatgacccaaagcccctccacactgtctgcctcaattggcgatactgtgagaataagttgcagggctagccagtccatcacggggaactgggtcgcatggtaccagcagcggcctggaaaggccccacgcctccttatttatcgaggtgcggctctgttgggcggggttccgtctcgtttcagaggatcggccgcaggcaccgactttacattaactatcggtaatctgcaagccgaggatttcgggaccttttactgtcagcagtatgacacataccccggaaccttcggccagggcactaaagtggaagtaaagaggacagtggctgcaccttcagtcttt

SEQ ID NO: 27042 - RNA, 351 nt, synthetic construct
  misc_feature 1..351: note = derived and/or modified sequence opt3 from anti-HIV_LightChain
  source 1..351: mol_type = other RNA
gacatccagatgacccaaagcccctccacactgtctgcctcagtgggcgatactgtcagaattagttgcagggctagccagtccataaccgggggatggctcgcatggtaccaccagcggcctggtaaggccccacgccttctgatctatcgaggctctcgtttgttagggggagttccgtcgagattctcaggcagcgcggctggtacggactttacactgactattgccaacctacaggcagaggatttcgggaccttttactgtcaacagtatgacacataccccggaaccttcggccagggcactaaagtggaagtaaagaggacagtggccgctcctagtgtcttt

SEQ ID NO: 27043 - RNA, 351 nt, synthetic construct
  misc_feature 1..351: note = derived and/or modified sequence opt3 from anti-HIV_LightChain
  source 1..351: mol_type = other RNA
gacatccagatgacccaaagcccctccacactgtctgcctcaattggcgatactgtgagaataagttgcagggctagccagtccatcacggggaactgggtcgcatggtaccagcagcggcctggaaaggccccacgcctccttatttatcgaggtgcggctctgttgggcggggttccgtctcgtttctcgggatcagccgcaggcaccgactttacattaactatcggtaatctgcaagccgaggatttcgggaccttttactgtcagcagtatgacacataccccggaaccttcggccagggcactaaagtggaagtaaagagaacagtggctgcacctagcgtcttt

SEQ ID NO: 27044 - RNA, 351 nt, synthetic construct
  misc_feature 1..351: note = derived and/or modified sequence opt3 from anti-HIV_LightChain
  source 1..351: mol_type = other RNA
gacatccagatgacccaaagcccctccacactgtctgcctcaattggcgatactgtgagaataagttgcagggctagccagtccatcaccgggggatgggtcgcatggtaccaccagcggcctggtaaggccccacgcctccttatttatcgaggctctcgtctgttagggggagttccgtcgagattctcaggcagcgcggctggtacggactttacattgactatcgggaacctgcaggccgaggatttcggaaccttttactgtcaacagtatgacacataccccggcaccttcggccaggggactaaagtggaagtaaagaggacagtggcagcccctagtgtcttt

SEQ ID NO: 27045 - RNA, 351 nt, synthetic construct
  misc_feature 1..351: note = derived and/or modified sequence opt3 from anti-HIV_LightChain
  source 1..351: mol_type = other RNA
gacatccagatgacccaaagcccctccacactgtctgcctcagtgggcgatactgtcagaattagttgcagggctagccagtccataaccgggggatggctcgcatggtaccaccagcggcctggtaaggccccacgccttctgatctatcgaggctctcgtttgttagggggagttccgtcgagattctcaggcagcgcggctggtacggggtttacactgactattgccaacctacaggcagaggacttcggaaccttttactgtcaacagtatgatacataccccggcaccttcggccaggggactaaagtggaagtaaagaggacagtggccgctcctagtgtcttt

SEQ ID NO: 27046 - RNA, 351 nt, synthetic construct
  misc_feature 1..351: note = derived and/or modified sequence opt3 from anti-HIV_LightChain
  source 1..351: mol_type = other RNA
gacatccagatgacccaaagcccctccacactgtctgcctcagtgggcgggactgtcagaattagttgcagggctagccagtccataacgggaggttggctcgcatggtaccaccagcggcctggcaaggccccacgccttctgatctatcgagggtctcgtttgttaggaggcgttccgtcgagattctcaggtagcgcggctgggaccgattttacactgactattgccaacctacaggcagaggacttcggaaccttttactgtcaacagtatgatacataccccggcaccttcggccaggggactaaagtggaagtaaagaggacagtggccgctcctagtgtcttt

SEQ ID NO: 27047 - RNA, 351 nt, synthetic construct
  misc_feature 1..351: note = derived and/or modified sequence opt3 from anti-HIV_LightChain
  source 1..351: mol_type = other RNA
gacatccagatgacccaaagcccctccacactgtctgcctcaattggcgatactgtgagaataagttgcagggctagccagtccatcacggggaactgggtcgcatggtaccaccagcggcctggaaaggccccacgcctccttatttatcgaggtgcggctctgttgggcggggttccgtctcgtttctcgggatcagccgcaggcaccgactttacattaactatcggtaatctgcaggccgaggatttcgggaccttttactgtcaacagtatgacacataccccggaaccttcggccagggcactaaagtggaagtaaagagaacagtggctgcacctagcgtcttt

SEQ ID NO: 27048 - RNA, 351 nt, synthetic construct
  misc_feature 1..351: note = derived and/or modified sequence opt3 from anti-HIV_LightChain
  source 1..351: mol_type = other RNA
gacatccagatgacccaaagcccctccacactgtctgcctcaattggcgatactgtgatgataagttgcagagctagccagtccatcaccgggggatggctcgcatggtaccaccagaggcctggtaaggccccacggcttctgatttatcgcggctctaaattgttagggggagtcccgtcgcgattctcaggcagcgcggctggtacggggtttacactgactatcggaaacctacaggccgaggacttcggcaccttttactgtcaacagtatgatacataccccggcaccttcgggcagggaactaaggttgaagtgaaacgtacagtagcagcccctagtgtgttt

SEQ ID NO: 27049 - RNA, 351 nt, synthetic construct
  misc_feature 1..351: note = derived and/or modified sequence opt3 from anti-HIV_LightChain
  source 1..351: mol_type = other RNA
gacatccagatgacccaaagcccctccacactgtctgcctcagtgggcgatactgtcagaattagttgcagggctagccagtccataaccgggggatggctcgcatggtaccaccagcggcctggtaaggccccacgccttctgatctatcgaggctctcgtttgttagggggagttccgtcgagattctcaggcagcgcggctggtgccgactttacgctgacaattgcaaacctacaggccgaggatttcgggactttttactgtcaacagtatgacacctaccccggaacattcggccagggcaccaaagtggaagtaaagaggactgtggctgcacctagtgtcttt

SEQ ID NO: 27050 - RNA, 351 nt, synthetic construct
  misc_feature 1..351: note = derived and/or modified sequence opt3 from anti-HIV_LightChain
  source 1..351: mol_type = other RNA
gacatccagatgacccaaagcccctccacactgtctgcctcaattggcgatactgtgagaataagttgcagggctagccagtccatcaccgggggatggctcgcatggtaccaccagcggcctggtaaggccccacgccttctgatttatcgaggctctcgtttggtcgggggagttccgtcgagattctcaggcagcgcggctggtacggactttacattaactatcgggaacctgcaggccgaggatttcggaaccttttactgtcaacagtatgacacataccccggcaccttcggccaggggactaaagtggaagtaaagaggacagtggcagcccctagtgtcttt

SEQ ID NO: 27051 - RNA, 351 nt, synthetic construct
  misc_feature 1..351: note = derived and/or modified sequence opt3 from anti-HIV_LightChain
  source 1..351: mol_type = other RNA
gacatccagatgacccaaagcccctccacactgtctgcctcaattggcgatactgtgagaataagttgcagggctagccagtccatcaccgggggatggctcgcatggtaccaccagcggcctggtaaggccccacgccttctgatttatcgaggctctcgtttgttagggggagtcccgtcgaaattctcaggcagcgcggctggtacggactttacactgactatcgccaacctacaggcagaggatttcgggaccttttactgtcaacagtatgacacataccccggaaccttcggccagggcactaaggttgaagtgaaaagaacagtagccgctcctagtgtgttt

SEQ ID NO: 27052 - RNA, 351 nt, synthetic construct
  misc_feature 1..351: note = derived and/or modified sequence opt3 from anti-HIV_LightChain
  source 1..351: mol_type = other RNA
gacatccagatgacccaaagcccctccacactgtctgcctcaactggcgatacggtgagaattagttgcagggctagccagtccataaccgggaactgggtcgcatggtaccagcagcggcctggaaaggccccacgcctccttatctatcgaggtgcggctctgttgggcggggttccgtctcgtttcagaggatcggccgcaggcacagactttactttaaccattggtaatctgcaagccgaggatttcgggacattttactgtcagcagtatgacacctaccccggaactttcggccagggcacaaaagtggaagtaaagaggaccgtggctgcaccttcagtcttt

SEQ ID NO: 27053 - RNA, 351 nt, synthetic construct
  misc_feature 1..351: note = derived and/or modified sequence opt3 from anti-HIV_LightChain
  source 1..351: mol_type = other RNA
gacatccagatgacccaaagcccctccacactgtctgcctcaattggcgatactgtgagaataagttgcagggctagccagtccatcacggggaactggctcgcatggtaccaccagcggcctggaaaggccccacgccttctgatttatcgaggttctcgtttgttaggcggggtcccgtcgagattctcaggaagcgcggctggcaccgactttacactgactatcgccaatctacaggcagaggatttcggtaccttttactgtcaacagtatgacacataccccgggaccttcggacagggcactaaagttgaagtgaagaggacagtagccgctcctagtgtgttt

SEQ ID NO: 27054 - RNA, 351 nt, synthetic construct
  misc_feature 1..351: note = derived and/or modified sequence opt3 from anti-HIV_Chain
  source 1..351: mol_type = other RNA
atcattctgttcctcgtggccaccgctacaggcagctgggcacagtccgcccttactcaacccagatctgtctcagggagtctgggacagagcgttacgatatcctgcaccggttcttcgtcagacgtgggcaggtacaactatgtaagctggtaccagcaccatcctgggaaggcgccaaaattgatgatcagtgatgtgaataagcggccgtccggagtccccgaccgcttttctggcagcaaatccggtaacacagcttcattaactattagtgggctgcaggccgaggatgaaaccgactattactgttgcagctatgcaggatcttacatctgggtgttcggcggc

SEQ ID NO: 27055 - RNA, 351 nt, synthetic construct
  misc_feature 1..351: note = derived and/or modified sequence opt3 from anti-HIV_Chain
  source 1..351: mol_type = other RNA
cccgtgaccctgagcgcctccgtcggcgacagagttacaatcacttgcagggcttctgaggatatttcaaagtacctcaactggtatcagcacaaacctgggaaggcaccaaaacttctgatatacacggccagtagcttggaaaccggagtgccgtcccggttctctggttcgggctcagggacagactttagcttaactatcagttccctgcaacccgatgacttcgcgacctattactgtcagcagtcttatacaagctccgtaacctttggacagggcactcgcgtggaggtcaagcgaacagtggctgccccttcagttttcatttttccacccagtgatgaacaa

SEQ ID NO: 27056 - RNA, 351 nt, synthetic construct
  misc_feature 1..351: note = derived and/or modified sequence opt3 from anti-HIV_Chain
  source 1..351: mol_type = other RNA
gtggaggaacccggcagctccgtcaaggtttcttgcaaagcctcagggggaagtagcaccgcttacggttattcctgggtgagacaggcacctggccaagggttcgagtggatgggaaggatcattccattttacggcataatcacatatgccccgaagttccagggtcgggtaactattacggcggaccgctctacctcgacagtgtacatggaactgactcgactcacctttgctgatacagcccttttcttttgtgcacgtgactatggggatcccagaaacggatactatttcgactcatgggatcagggcctgtggttgaccgtcagcagtgcctccactaaaggc

SEQ ID NO: 27057 - RNA, 351 nt, synthetic construct
  misc_feature 1..351: note = derived and/or modified sequence opt3 from anti-HIV_Chain
  source 1..351: mol_type = other RNA
caggtgagactggagcaaagcggcgccgctgtcaggacccccggggcatccgttacactctcttgccaggcctcaggatacaagttcgtgaactatatcattcactgggtacggcagcgccctggtcttgcgtttgaatgggtgggcatgatagacccataccgagggcgtccgtggagtgctcatagcttcgagggaagactgtccttgtctagggatgtctcgatggaaatcttatatatgactctgacgtcactacggagcgacgataccgccacatacttttgtgcacgcgccgaggctgaaagtcagtcccactctagacccattatcagcacttccggcgcaagg

SEQ ID NO: 27058 - RNA, 351 nt, synthetic construct
  misc_feature 1..351: note = derived and/or modified sequence opt3 from anti-HIV_Chain
  source 1..351: mol_type = other RNA
gtgcacctggaggtccagctccaacagagcggccccgaacttaagaaacctggggagaccgttaagatctcctgcaaagcctctgtgtacacattcactgaatatccaattcattgggtaaagcaggctccgggaaaaggttttaagtggatgggctggataaacacgtactcaggggagcccacctatgcagacgatttcaagggaagatttgccttcagtctggaaacaagcgcgtccactgcttacttgcagatcaattctctgaaaaacgaggacaccgccacatatttttgtgcatcgttaggcagggattactggggtcaagggcagggaaccactctaacagtg

SEQ ID NO: 27059 - RNA, 354 nt, synthetic construct
  misc_feature 1..354: note = derived and/or modified sequence opt3 from anti-HIV_Chain
  source 1..354: mol_type = other RNA
ctgagcgtgtccctcggcgagagagccaccatcaactgcaagtcttcacagagtattctttacagctccgacaaaaagaattatctggcttggtaccaacagaaaatagggcagccccctaagttgttactgtattgggcatctacaagggaatcgggaatcccagatcggttctcaggtagcggcagtgggtccgactttactctaacgatttctagcctccagccggaggatgtcgccgtttactattgtcaacagtactatatctcccccttcacctttggacctggcacaaaagtggacctgaagcgcactgtagcggctccatcagtgttcatttttccccctagtgat

SEQ ID NO: 27060 - RNA, 354 nt, synthetic construct
  misc_feature 1..354: note = derived and/or modified sequence opt3 from anti-HIV_Chain
  source 1..354: mol_type = other RNA
cagagcgtgctgacccaacccccttccgcctctggcgctccagggcagagagtcacaatctcatgcagtggaggtccgagcaacgttggcgggaattacgtgtattggtacaggcagttccccggaactgcacctaagctccttattctgcgggacgatcagcgcccatccggcgtacccgaccgattttctgcctcgaaatcaggtaacagcgcgagtttggctatatccgggttacgtcctgatgacgaggccttctatttttgtgcaacgtacgattctgacggaagcatcagactgttcggcggcgggaccgccctaacagtgctctcccaaccaaaggctgcaccctca

SEQ ID NO: 27061 - RNA, 354 nt, synthetic construct
  misc_feature 1..354: note = derived and/or modified sequence opt3 from anti-HIV_Chain
  source 1..354: mol_type = other RNA
aaggcccccgctaccctgagcctctcccctggcgagagagcaacactttcttgcagggcctcacagagtgtggggagcgacctggcgtggtaccaacagaaaccaggacaggctccgcggttgttaatctatgatgcctccaaccgcgcaactgccattcccgctcgattctctggttcgggctcagggacggacttcaccctgagcataagttccctagaacctgaggatttcgcagtctacttttgtcagcaacgttatgacaagatcacattcggacagggcactagactcgaaattcagaggaccgttgccgctccatctgtgtttatctttccccctagcgatgagcag

SEQ ID NO: 27062 - RNA, 354 nt, synthetic construct
  misc_feature 1..354: note = derived and/or modified sequence opt3 from anti-HIV_Chain
  source 1..354: mol_type = other RNA
caggtgcaactggtccagagcggcgccgaggctaagagacccggggactccgttaaagtgtcttgcaaggcatcaggatacaccttcacagaatattacatccactgggtaaggcagactcctggtcagggctttgagtggatggggattataacgccaggagccggcaacaccacatatgcgcaaaaattccagggtcggatcactgtgacccgcgatacaagtgctgccaccgtctacatggaactcagcaatcttacttccgaggacacagcagtgtatttttgttctcgaggggtttcgttctggggacagggcaccctggtgacggtctcaagcgccagtactaagggc

SEQ ID NO: 27063 - RNA, 354 nt, synthetic construct
  misc_feature 1..354: note = derived and/or modified sequence opt3 from anti-HIV_HeavyChain
  source 1..354: mol_type = other RNA
gaggtgaagctgcagcaaagcggcgccgaactcgtcagacccggggcttccgttaaaatgtcttgcaaggcatcaggatacaggttcaccagttataacatgcactgggtgaaacagacacctcggcagggtcttgagtggatcggcgccatttacccagggaatggagacactagctataaccagaagtttaaaggcaaggcgacgctgaccgtagataagtcctcttcgacagcttacatgcaattgagtagcttaacttcagaagactccgccgtgtatttctgtgcacgcggtcgactgtctctagggtttgattactggggacagggcagcaccctcacagtctcctca

SEQ ID NO: 27064 - RNA, 357 nt, synthetic construct
  misc_feature 1..357: note = derived and/or modified sequence opt3 from anti-HIV_Chain
  source 1..357: mol_type = other RNA
caggtgcaactggtccagagcggcaccgccgttaagagacccggggcttccgtgagggtatcttgccaggcatcaggatacacattcatcgaccactttatttattggtggcggcaggcccctggtcaaggcctcgagtggcttgggtggataaacccactgacgagtcagccgagctacccctcccgcttccagggacgattgactttaacccgtgatacatttgacgaaatgctgtatatggatctaagaggcctcaggtctgacgatactggtatctacttctgtgcgcggcgccattcggactattgcgattttgacatttgggggtcaggaacccagatcattgtgagcagt

SEQ ID NO: 27065 - RNA, 357 nt, synthetic construct
  misc_feature 1..357: note = derived and/or modified sequence opt3 from anti-HIV_Chain
  source 1..357: mol_type = other RNA
caggtgcaactggtccagagcggcaccgccgttaagagacccggggcttccgtgagggtatcttgccaggcatcaggatacacattcactgactattttatctactggtggcggcaggcccctggtcaaggcctcgagtggcttgggtggattaacccactgacgagtcagccgagctatccctcccgcttccagggacgattgaccttaacacgtgatacttttgacgaaatgctgtacatggatctaagaggcctcaggtctgacgataccggtatatatttctgtgcgcggcgccactcggactactgcgattttgacatctgggggtcaggaacacagattatcgtgagcagt

SEQ ID NO: 27066 - RNA, 357 nt, synthetic construct
  misc_feature 1..357: note = derived and/or modified sequence opt3 from anti-HIV_Chain
  source 1..357: mol_type = other RNA
cagagcgtgctgacccaacccagatccgtctctggctcacctgggcagagtgttacaatcagctgcactggaacgtcctctgacgtgggtggctacaactatgtatcgtggtaccagcagcacccagggaaggccccgaaaaccatgattttcgatgtgacaaagaggccctcaggagtccctgaccggtttagcggcagtaaatccggtaatactgcttctctcaccataagcgggcttcaagcagaggatgaagccgactattactgttcctcatatgcgggacgcaacacattctacgtgtttggcaccggcactacagttaccgtgcaggtcagtccaagccagccccctcca

SEQ ID NO: 27067 - RNA, 357 nt, synthetic construct
  misc_feature 1..357: note = derived and/or modified sequence opt3 from anti-HIV_Chain
  source 1..357: mol_type = other RNA
gagatcgtgctgacccagagccccggcacactctccctttctcctggggaaagagccactctgtcatgcagggctagtcaaagcgtctcctctaactacttggcatggtatcagcagaagccaggacaggccccgcggttactgatttacggtgcgtcgtcacgcgctacgggcatacccgaccgattcagcgggagtggatccggcaccgattttacactatctatcagccgtctcgagcctgaagacttcgccgtttattactgtcaacagtatggtacttcctcatgcacctttgggcagggaacaaaactggagattaagagaaccgtggcagccccaagtgtattcatcttt

SEQ ID NO: 27068 - RNA, 357 nt, synthetic construct
  misc_feature 1..357: note = derived and/or modified sequence opt3 from anti-HIV_Chain
  source 1..357: mol_type = other RNA
ctgagcgcctccgtgggcgacagagtcaccatcacatgcagggcttctcagtcaattgatcggtacctcaactggtatcaacagaagcccgggaaagcacctaaacttctgatatacgccgcgagtagcttgcacactgacgttccatcccgcttctctggatcgggtgctggcacgtattttaccttaacaatcacttcactgcagccggaggatttcgccacctactattgtcagcaaagccatagtccctcctttgggcaggaatcttacagcattacattcggacagggcacccgactagagatcaagcgtactgtggcagccccttccgtatttattttcccaccctcagac

SEQ ID NO: 27069 - RNA, 357 nt, synthetic construct
  misc_feature 1..357: note = derived and/or modified sequence opt3 from anti-HIV_Chain
  source 1..357: mol_type = other RNA
aacttcatgctgacccaggcccccagcgcttccggcgcacctgggcaaagagtgacaatctcttgctcaggaggtccaagtaatgtcggcgggaactacgtttattggtacaggcagtatccgggaactgcccccaagctccttattctgcgggacgatcagcgccctagcggcgtgccagaccgattttccgcgtctaaatcgggtaattcagctagcttggccataagtgagttacgtcccgatgacgaagcattctacttttgtgccacgtatgattccgacgggtctatcagactgttcggaggcggcaccgctctaacagtactcagccagcctaaggcagccccatccgtg

SEQ ID NO: 27070 - RNA, 360 nt, synthetic construct
  misc_feature 1..360: note = derived and/or modified sequence opt3 from anti-HIV_Chain
  source 1..360: mol_type = other RNA
gacatccagatgacccaaagcccctcctctctgtcagccagtattggcgatagagtgaacataacatgccaggctagcagggacactgggtccgcactcaattggtaccagcagaaggtcggacggcctccacgccttctgatctctgccgtttcgaacttgggtgcgggcgtgccgtcacgattcagcgggcgtagaagtggaacgcaatccaccttaacaattaatactctgcagcccgaggatatcgctacctatttttgtcagcactacgagttctttggccctggtacaaaagtagacattaagaggaccgtggccgcaccatctgtcttcatctttccccctagcgatgaacag

SEQ ID NO: 27071 - RNA, 360 nt, synthetic construct
  misc_feature 1..360: note = derived and/or modified sequence opt3 from anti-HIV_Chain
  source 1..360: mol_type = other RNA
cagagcgtgctgacccaacccgcctccgtctctggctcacctgggcagagtatcacaattagctgcactggaacgtccaacgacgttggtggccagaatttcgtgtcttggtaccagcaacacccagggaccgctccgcagctccttatatatgatgtaacaaacagacccgcaggagtgtcgtcaaggtttagcggcagtaagtccggtaatactgcctctctgaccatcagcgggttgcggacagaggacgaagcggattactattgtgcttccttcaccattttaaacggagtcgactacgtgtttggcactggcacaaaagttaccgtgctgctatcacctagtcagccatatctc

SEQ ID NO: 27072 - RNA, 360 nt, synthetic construct
  misc_feature 1..360: note = derived and/or modified sequence opt3 from anti-HIV_Chain
  source 1..360: mol_type = other RNA
aacttcatgctgacccagcccgccagcgtgtccggctctcctgggcaatcaatcacactcagttgcactggaacgaccagcgacgtcagagattccaattttgtttcttggtaccaacaggtgccaggtaaggctccgaaacttattatatatgacgtatcggcaaggccctcaggcgtgagcttccggtttagtgggtccaagtctggaaacacagccagcctgactatctccggcttgcaggcggaagatgaggctttatactattgttcaagtttcacccctacaaataccctggtctttggtgggggaactaaactaacagtgctcggccagccaaaggccgcacccagcgttacc

SEQ ID NO: 27073 - RNA, 360 nt, synthetic construct
  misc_feature 1..360: note = derived and/or modified sequence opt3 from anti-HIV_Chain
  source 1..360: mol_type = other RNA
cagagcgccctgacccaaccccctgctgcatccggcgccccagggcagagagtgacaatctcttgctcaggaggtggcagtaacgtcgggggaaatctcgttagctggtaccagcagttcccgggcgcggctcccaaacttattctgcacagggacggtcaacggccttccggggtgccagatcgcttttctgcctcgaagtcaggaactagcgcaagtttgacgatatccggcttacgatctgacgatgaggccacctatttctgtgctgcatacgacagcgccgtatccctgcccgtgtttggcgggggaacaaagctaactgtcctctcacagcctaaagctgccccactggtgacc

SEQ ID NO: 27074 - RNA, 360 nt, synthetic construct
  misc_feature 1..360: note = derived and/or modified sequence opt3 from anti-HIV_Chain
  source 1..360: mol_type = other RNA
cagctggtgctcacccaaccccctagcgtctccggcacaccagggcagaacgttactatctcttgctcaggaggtggcagtcacgtagggggaaatcttgtgagctggtaccagcatttcccgggcgccgctcccaagctgttgattcacagagacaaccagaggccttccggtgtgccagatcggttttctgcattaaaatcgggaaattcagccagcctggcgataagtgggctacgctccgacgatgaggctttctatttttgtgccgtctacgactctagcctctccctgggccttttcggcgggggaacgaagctgaccgtgttgtcacaacccaaagcagcccctagtgttaca

SEQ ID NO: 27075 - RNA, 360 nt, synthetic construct
  misc_feature 1..360: note = derived and/or modified sequence opt3 from anti-HIV_Chain
  source 1..360: mol_type = other RNA
gacatccagatgacccaaagcccctcctctctgtcagccagtgtgggcgatagagtcagcattcactgccaggctgggcagggaataggttcctctctcaagtggtaccagcaaaaatcgggcagggcacctcggcttctggttcatggggcctcaaacttgcagcgcggagtgccaagccgattcagtggctccggttttcacacaactttcacgttaaccatctctagcctgcagccggacgatgtagcgacatattggtgtgctgtgctagagtttttcgggcccggaactaaggtcgaaattaaacgtaccgtggccgcaccttccgtttttatcttcccaccctcagacgagcag

SEQ ID NO: 27076 - RNA, 360 nt, synthetic construct
  misc_feature 1..360: note = derived and/or modified sequence opt3 from anti-HIV_Chain
  source 1..360: mol_type = other RNA
gacatccagatgacccaaagcccctcctctctgtcagccagtgtgggcgatagagtcacaattacttgccaggctagccaggggataggatcctctctccagtggtaccaacagaagcctggtagggcaccaaaacttctggttcacggcgcctcgaacttgcatcgcggggtgccgtcacggttcagcggaagtggctttcacacgtccttcaccttaacaatctctagcctgcagcccgacgatgtagcgacttatttttgtgctgtgctagagttctttggtcctgggaccaaggtcgaaattaaacgaacagtggccgcaccatccgttttcatctttcccccttcagacgagcag

SEQ ID NO: 27077 - RNA, 360 nt, synthetic construct
  misc_feature 1..360: note = derived and/or modified sequence opt3 from anti-HIV_Chain
  source 1..360: mol_type = other RNA
gacatccagatgacccaaagcccctcctctctgtcagccagtgtgggcgatagagtcagcattaactgccaggctgggcagggaataggttcctctctcaattggtaccagcaaaagaggggcaaagcacctaaacttctggttcacggggcctcgacattgcagcggggagtgccatcacgcttcagcggcagtggttttcatactacgttcaccttaacaatctcctctctgcagccggacgatgtagcgacttatttttgtgagagcttccagtggtttgggcccggaaccaaggtggaaattaagcgaacagtcgctgccccttccgtgttcatctttccaccctcagacgagcaa

SEQ ID NO: 27078 - RNA, 360 nt, synthetic construct
  misc_feature 1..360: note = derived and/or modified sequence opt3 from anti-HIV_Chain
  source 1..360: mol_type = other RNA
tacatccagatgacccaaagcccctcctctctgtcagccagtattggcgacagagtgacaataacttgccaggctgggcagggaatcggtagctccctcaactggtatcagcaaaagcctggcaaagcaccaaaacttctggtccacggggcctctaatttgcagaggggagtttcgtcacggttcagcggcagtggttttcatacgaccttcacattaactatttcctctctgcgcccggaggatgtggggacctacttttgtgaagtatatgagttcatcggacccggcacaaaggtggacattaagcgaaccgtcgcggctcctagcgtgtttatcttcccaccctccgatgaacag

SEQ ID NO: 27079 - RNA, 360 nt, synthetic construct
  misc_feature 1..360: note = derived and/or modified sequence opt3 from anti-HIV_Chain
  source 1..360: mol_type = other RNA
gacatccagatgacccaaagcccctcctctctgcctgcctcagtgggcgatacagtcactattacgtgccaggctgggcagggaataggtagtagcctccagtggtaccaacagagaccaggcagggcaccgaaccttctggtttatgacgcctccaatttgcagcgcggggtgccctctcggttcaccggaacaggctttcacactaccttcacattaaccatccgaggtctgcgtcctgaggattttgggacttacttctgtgcgtcgctagaatttttcggaccaggcacaaaggtagacattaaaagaaccgtggctgccccctcagtctttatcttccctccaagcgatgagcag

SEQ ID NO: 27080 - RNA, 360 nt, synthetic construct
  misc_feature 1..360: note = derived and/or modified sequence opt3 from anti-HIV_Chain
  source 1..360: mol_type = other RNA
gacatccagatgacccaaagcccctcctctctgtcagccagtgtgggcgatagagtcacaattacttgccaggctagccaggggataggatcctctctccagtggtaccaacagaagcctggtagggcaccaaaccttctggttcacggcgcctcgaatttgcatcgcggggtgccgtcacggttcagcggaagtggctttcacacgaccttctccttaacaatctctggtctgcagcgagacgattttgcgacttatttctgtgctgtactagagtttttcgggcccggaaccaaagtggacattaagcgtacagtcgccgcacctagcgtgtttatcttcccaccctccgatgaacag

SEQ ID NO: 27081 - RNA, 360 nt, synthetic construct
  misc_feature 1..360: note = derived and/or modified sequence opt3 from anti-HIV_Chain
  source 1..360: mol_type = other RNA
gacatccagatgacccaaagcccctcctctctgtcagtgagtgtcggcgatagagttagcattacatgcagggccactcaggggataggaaactccctcaattggtaccagcagaagcctggtaaagctccaaaggtgcttatctatggcacgaccaaactgcacgggggagtaccgtctcggttctcgggcggtgggtcaggaagcacaggcactttgaccattgacagtttacaacccgaggatatcgcaacatacttctgtcagctgttcgaatttttcggccctgggaccaaggtggagattaaacgcactgtcgccgcgccatccgtgtttatctttcccccttctgacgaacag

SEQ ID NO: 27082 - RNA, 360 nt, synthetic construct
  misc_feature 1..360: note = derived and/or modified sequence opt3 from anti-HIV_Chain
  source 1..360: mol_type = other RNA
gacatccagatgacccaaagcccctcctctctgtcagccagtgtgggcgatagagtcacaattacttgccaggctgggcagggaataggtagctccctcaactggtaccagcaaaagcctggcagggcaccaaaacttctggtttatggggcctctaatttgcagcggggagtgccgtcgcgcttctcaggcagcggttttcacacgaccttcacattaactatcagttccctgcagcccgaggactttgcgacctacttctgttctgtatatgaatttctagggcctggaacaaaggtggagattaaacgaaccgtcgctgccccaagcgtgttcatctttcccccttccgatgaacag

SEQ ID NO: 27083 - RNA, 360 nt, synthetic construct
  misc_feature 1..360: note = derived and/or modified sequence opt3 from anti-HIV_Chain
  source 1..360: mol_type = other RNA
cccatgttccagcctggccaaagcgggggagtggtcgttcagtccggtgagtctctgcacctctcatgcgaagccagtggctttaagttcgctagccagatgatgcattgggtgagacacgtaccagggaggggacttgagtgggtggcactgatctcctgggacggctctggtaaattgtttgccgattcggtccgggggcgcttcaccattcatcgatggaacgaccgtaattcattatacctggatgtgaagaacgttagaccggaagacgcggctatatattactgtacaaggaatggatttgatgtgtggggccagggcatcctagtcactgtgagcagtgcctccacgaaaggg

SEQ ID NO: 27084 - RNA, 363 nt, synthetic construct
  misc_feature 1..363: note = derived and/or modified sequence opt3 from anti-HIV_HeavyChain
  source 1..363: mol_type = other RNA
gaggtgaagctggtcgaaagcggcgggggactcgttcagcccggtggctcccttagactgtcttgcgccgcttcagggttcacctttagtagcttcggaatgcactgggtgaggcaagcacctgagaaaggcttggaatgggtagcctacatctcctctggttcgtcaacattacattatgcggacactgtgaaggggcggtttacgattagccgcgataacagtaaaaattccctgtacctacagatgaacctcctgcgagctgaggacaccgccgtctattactgtgcacgtggatctagaaatcttagccacaggctgttgtcctattggggccagggcacactcgtgactgtttcaagt

SEQ ID NO: 27085 - RNA, 363 nt, synthetic construct
  misc_feature 1..363: note = derived and/or modified sequence opt3 from anti-HIV_HeavyChain
  source 1..363: mol_type = other RNA
gaggtgcagctggtcgaaagcggcgggggactcgttcaacccggtggctcccttagactgtcttgcgccgcttcagggttcacctttagtagcttcggaatgcactgggtgaggcaggcacctggcaagggtttggagtgggtatcctacatctcttcggggtcaagcacattacattatgccgacactgtgaagggacggtttacgattagtcgcgataactccaaaaattctctgtacctacagatgaacagcctccgagcggaagacaccgctgtctattactgtgcccgtggctccagaaatctgtcacacaggcttctgagttattggggccaggggacattggtgactgttagctct

SEQ ID NO: 27086 - RNA, 363 nt, synthetic construct
  misc_feature 1..363: note = derived and/or modified sequence opt3 from anti-HIV_Chain
  source 1..363: mol_type = other RNA
gacatccagatgacccaaagcccctcctctctgtcagccagtgtgggcgatagagtcacaattacttgccaggctagccaggggatatccaactctctcaattggtaccagcaaaagcctggaaaagcaccaaggcttctgatctatggtacgtcgaccttgcagcggggcgttccgtcacgcttcagcgggagtggatccggcacacgatttactgtgaccattaactctttacagcccgaggacatcgccacatacttctgtcagcacaatgaatttttcggtcgtgggaccaaggtagatattaaaagaactgtggcggctcctagcgtctttatcttcccaccctccgacgagcaactg

SEQ ID NO: 27087 - RNA, 363 nt, synthetic construct
  misc_feature 1..363: note = derived and/or modified sequence opt3 from anti-HIV_Chain
  source 1..363: mol_type = other RNA
gacatccagatgacccaaagcccctcctctgtgtcagccagtgtcggcgatagagttacaattacttgccaggctagcagggacacggataactccctgacctggtaccagcagaagcctgggcggccaccgaaactccttatatatcacgtggtaaatctgggacccggtgtgccttctcgcttctcgggctcagcaagcagtgccacacaatccactttgatcatttctgactttcagccagatgacgtcgcgacctacttctgtcagaactatgagtttttcgggcccggaacaaaggtggaaatcaaacgaaccgttgctgcccctagcgtgtttattttcccaccctccgatgagcag

SEQ ID NO: 27088 - RNA, 363 nt, synthetic construct
  misc_feature 1..363: note = derived and/or modified sequence opt3 from anti-HIV_Chain
  source 1..363: mol_type = other RNA
gagatcgtgctgacccagagccccggcacactctccctttctcctggggaaagagccactctgtcatgcagggctagtcaaagcgtctcctctaacaatttggcatggtaccagcagaagccaggacaggccccgcggttactgatgtcgggtgcgtcaagccgcgctacgggcattcccgaccgattcagtgggtccggatctggcaccgattttacactaactataagccgtctcgagcctgaagacttcgccgtttatcactgtcaacagtacggttcctcaccacccacctttgggcagggaacaaaagtggagatcaagagaaccgtagcagcccctagtgtgttcatttttccaccc

SEQ ID NO: 27089 - RNA, 363 nt, synthetic construct
  misc_feature 1..363: note = derived and/or modified sequence opt3 from anti-HIV_Chain
  source 1..363: mol_type = other RNA
gacatccagatgacccaaagcccctcctctctgtcagcctacgtgggcgatagagtcacaattacttgcagggctagtcagaacataaatacgtatctcaactggtaccagcagcggcctgggaaggcaccaaaacttctgatctatgccgcgagcaccttgcaatccggagttccgtctcgcttctcgggttcaggcagcgggacagactttactttaaccattagtaatctggagacagaagatttcgctgtgtactattgtcagcagacctaccgatccgtaacttttggacagggcacaaagctagagatcaaacgtaccgtggccgcaccctctgtcttcatttttcctccaagcgac

SEQ ID NO: 27090 - RNA, 363 nt, synthetic construct
  misc_feature 1..363: note = derived and/or modified sequence opt3 from anti-HIV_Chain
  source 1..363: mol_type = other RNA
gacatccagatgacccaaagcccctcctctctgtcagccagtgtgggcgatagagtcacaattacttgccaggctgggcagggaataggtagctccctccagtggtaccaacagaagcctggcaaagcaccaaaacttctggttcacggggcctctaacttgcataggggagtgccgtcgcggttctcaggcagcggttttcacacgaccttcagtttaacaatctccgggctgcagcgcgacgattttgcgacttatttctgtgctgtagtggagtttttcggacccggcaccaaggtcgacattaagcgaacagtggccgcaccttctgtttttatcttcccacccagcgatgaacagcta

SEQ ID NO: 27091 - RNA, 363 nt, synthetic construct
  misc_feature 1..363: note = derived and/or modified sequence opt3 from anti-HIV_Chain
  source 1..363: mol_type = other RNA
caggtgcaactggtcgagagcggcgccgaactcagaaagcccggggagtcccttgaaatctcttgcaaggcttcaggatacagtttcagctcccactggattggttgggcaaggcagatgcctggcaaagggctggagtggatgggaataatctatccaggcgactctaacaccatttactcgccgtcatttcagggtcaggttacaatcagcgccgataaaagtattaatactgcgtatttgcaatggtcctctttaaaggctagcgacacggccatgtacttctgtgcatccaactatcatgattacttttattgggggcagggaaccctggtgacagtatcaagtgccagcactaaaggc

SEQ ID NO: 27092 - RNA, 363 nt, synthetic construct
  misc_feature 1..363: note = derived and/or modified sequence opt3 from anti-HIV_Chain
  source 1..363: mol_type = other RNA
ttcgtgcagctggtcgagagcggcgggggagttgtgcaacccggtacctccctcagactttcttgcacaacttcaggctttatcttcagtgactacgggatgcactgggtaaggcaggccgctggaaagggcctggaatgggtggcagtcatttggcatgatggtagcaaccggttttatgccgactccgtgaaagggcgcttcacgatatctcgagataattcgaagaacgcggtttacttggagatgaataacttacgtgtggaagacaccgctctgtattactgtgccagaacatcaatggatatcgactattggggacagggcactcctgtcaccgtgagcagtgcatccacaaaaggc

SEQ ID NO: 27093 - RNA, 363 nt, synthetic construct
  misc_feature 1..363: note = derived and/or modified sequence opt3 from anti-HIV_Chain
  source 1..363: mol_type = other RNA
gagcccatgttccagcctggccaaagcgggggagtggtcgttcagtccggtgaatctctgcacctctcatgcgaggccagtggctttaagttcgctagccagatgatgcattgggtgagacacgtaccagggaggggacttgaatgggtggcactgatctcctgggacggctctggtaaattgtttgccgattcggtccgggggcgcttcaccattcatcgatggaacgaccgtaattcattatacctggatgtgaagaacgttagaccggaggacgcggctatatattactgtacaaggaatggatttgatgtgtggggccagggcatcctagtcactgtgagcagtgcctccacgaaaggg

SEQ ID NO: 27094 - RNA, 366 nt, synthetic construct
  misc_feature 1..366: note = derived and/or modified sequence opt3 from anti-HIV_Chain
  source 1..366: mol_type = other RNA
agccagcacctggtgcaatccggcacccaggtcaagaaacccggggcctctgttagaatctcatgccaggctagtggatacagcttcacagactatgtgctccattggtggaggcaggcacctggtcaaggccttgagtggatggggtggattaagccagtatacggagcccggaactatgcgcgccgatttcagggccgtataaatttcgatagagacatctacagggaaattgcttttatggatctgtccggtttgcggtctgacgatactgccttatatttctgtgcacgcgacgggtcgggagatgacacgtcatggcacctggatccgtggggccagggcaccctagtgatcgtcagcgcc

SEQ ID NO: 27095 - RNA, 366 nt, synthetic construct
  misc_feature 1..366: note = derived and/or modified sequence opt3 from anti-HIV_Chain
  source 1..366: mol_type = other RNA
gacatccagatgacccaaagcccctcctctctgtcagccagtgtgggcgatagagtcacaattacttgcagggctagccagtccatatctcggtacctcaactggtatcagcagaagcctgggaaagcaccaaaacttctgatctacgccgcgtcgtcattgcaaggaggtgttccgagccgcttcagtggctccgggtctggaacggacttcaccttaacaattagctccctgcagcccgaggatttcgctacttattactgtcagcagtcaagtagcaagccttttaccttcggcggtgggacaaaggtggaaatcaaacgaaccgtagccgcaccatctgtgtttatttttcccccttccgac

SEQ ID NO: 27096 - RNA, 366 nt, synthetic construct
  misc_feature 1..366: note = derived and/or modified sequence opt3 from anti-HIV_Chain
  source 1..366: mol_type = other RNA
gagatcgtgctgacccagagccccggcacactctccctttctcctggggaaagagccactctgtcatgcagggctagtcaaagcatttcctctaactacttggcatggtatcagcagaagccaggacaggccccgcggttactgatatacggtgcgtcgacgcgcgctaccggcatccccgaccgattctcagggagcggaagtggcacagatttcactctatccatttctcgtctcgagcctgaagacatcgccgtctattactgtcaccaatatggtagctcccagagattcgggcagggaaccaaagttgagattaagaggacagtggcagccccatcagtatttatctttccccctagtgat

SEQ ID NO: 27097 - RNA, 366 nt, synthetic construct
  misc_feature 1..366: note = derived and/or modified sequence opt3 from anti-HIV_Chain
  source 1..366: mol_type = other RNA
gagatcgtgatgacccagagccccgccacactgtccgtctctcctggcgacagagctactctctcatgcagggcaagtcaaagcgtttccacgaaccttgcctggtaccagcagaagccagggcaggcgccgcggctgttgatttatggagcttctacccgcgccacaggtatacccgcaactttctcgggctcagggtttgccaccgagttcacattaaccatcagcagtctgcaatccgaagattttgctgtgtactattgtcagcagtacaataactggcctccagcattcggacagggcactaaagtagaaattaagcgaacagtggccgctccctctgtctttatcttccctccaagcgac

SEQ ID NO: 27098 - RNA, 366 nt, synthetic construct
  misc_feature 1..366: note = derived and/or modified sequence opt3 from anti-HIV_Chain
  source 1..366: mol_type = other RNA
gacatccagatgacccaaagccccgcctccctgtctgcttcagtgggcgatagagtcacaattacttgcagggcaagtcaggggataagccactacctcgcctggtatcagcagaagcctggaaaagttccacggcttctgatctacgcggcttcccgcttgcaatctggtgtgacgtcgcgattctcaggcagcgggagtggaaccgagtttacattaactatttcctctctgctaccggaagacgccgcagtatatttctgtcagaagtacgataccgaccccatgacatttggccagggtacccgtctcgagatcaaaagaactgtggccgctcctagcgtcttcatttttccaccctccgat

SEQ ID NO: 27099 - RNA, 366 nt, synthetic construct
  misc_feature 1..366: note = derived and/or modified sequence opt3 from anti-HIV_Chain
  source 1..366: mol_type = other RNA
cagagcgccctgacccaacccccttccgcttctggcgcaccagggcagagagtgacaatctcatgcagtggaggtccgagcaacgtcggcgggaattacgtttattggtacaggcagttccccggaactgcccctaacctccttattctgcgggacgatcagcgcccatccggcgtgcccgaccgattttctgcgtcgaagtcaggtaatagcgctagtttggccatatccgggttacgtcctgatgacgaggcattctatttttgtgccacgtacgattctgacggaagcatcagactgttcggcggcgggaccacactaactgtactctcccaaccaaaagctgcaccctcagtgaccctgttt

SEQ ID NO: 27100 - RNA, 366 nt, synthetic construct
  misc_feature 1..366: note = derived and/or modified sequence opt3 from anti-HIV_Chain
  source 1..366: mol_type = other RNA
gacatccagatgacccaaagcccctcctctctgtcagccagtgtgggcgatagagtcacaattaactgccaggctgggcagggaataggtagctccctcaattggtaccagaagaaacctggcagggcaccaaaacttctggttcacggggcctctaacttgcaacggggagtgccgtcgcgcttctcaggcagcggttttcatactacgttcaccttaacaatcagttccctgcagcccgacgatgtagcgacttatttttgtgctgtgttccagtggtttgggcctggaaccaaggtcgacattaagcgaacagtggccgcaccatctgttttcatctttccccctagcgatgagcagctaaaa

SEQ ID NO: 27101 - RNA, 366 nt, synthetic construct
  misc_feature 1..366: note = derived and/or modified sequence opt3 from anti-HIV_Chain
  source 1..366: mol_type = other RNA
gacatccagatgacccaaagcccctcctctctgtcagccagtgtgggcgatagagtcacaattacttgccaggctagccaggggataggatcctctctccagtggtaccaacagaagcctggtagggcaccaaaccttctggttcacggcgcctcgaaattgcatcgcggggtgccgtcacggttcagcggaagtggctttcacacgaccttctccttaacaatctctggtctgcagcgagacgattttgcgacttatttctgtgctgtactagagtttttcgggcccggaaccaaggtggaaattaaacgtacagtcgccgcacctagcgtgtttatcttcccaccctccgacgagcagctcaag

SEQ ID NO: 27102 - RNA, 366 nt, synthetic construct
  misc_feature 1..366: note = derived and/or modified sequence opt3 from anti-HIV_Chain
  source 1..366: mol_type = other RNA
caggtgcacctggtccaaagcggcgccgaggttaagaaacccggggcttccgtgaaggtatcttgcaaagtgtcaggatacaccctcagtgaacttagcatccattgggtcagacagggtcctggcagggggctggagtggatggcaaacttcgacccagaagatggagagacaatttatgccccgcagtttcagggccgggtgactttgacggaagacacctccacagatactgcgtacatgcaattaacctctctgcgctcggaggacacagctgtttattactgtgccaccgatcgatatactgacacaggtcgttgggggcccggaaccctagtgacggtctcaagcgcaagtactaagggc

SEQ ID NO: 27103 - RNA, 366 nt, synthetic construct
  misc_feature 1..366: note = derived and/or modified sequence opt3 from anti-HIV_Chain
  source 1..366: mol_type = other RNA
caggtgcaactggtcgagagcggcgggggactcatccagcccggtggctcccttagactgtcttgcgaagcctcagggttcgctgttggagacattaactacatgagttgggtgaggcaggcacctggcaagggtttggagtgggtaagcgtgttatattccgggggatcttcgcagtacgccgattcagtcaaaggccggtttaccataagccgcgacaatagtcgaaacacactgtatctacaaatggataatctccgtgcggaagacactgctgtgtactattgtgccagaggcctgagggtttacttcgatctttgggggcagggaatcctggtgacggtctcctctgcaagcaccaagggt

SEQ ID NO: 27104 - RNA, 366 nt, synthetic construct
  misc_feature 1..366: note = derived and/or modified sequence opt3 from anti-HIV_Chain
  source 1..366: mol_type = other RNA
caggtgcaaatggtcgccagcggcgggggactggttaagcccggtggctccctcagactttcttgcgaggcttcagggttcacctttagtgactactatatgagctgggtgaggcaggcacctggaaaaggcctggaatggatctcctacattacatctggtgggaacgccttgtattacgcggattcggtaaagggacggttcactatatcacgcgacaatgctaaaaacagcttatatctgcagatgaatagtctacgagccgaggatacggcagtgtactattgtgcccgtgacctcctgcacgctcatgattttggcagacagggcacccttgtcacagtgtcctctgcaagcactaagggg

SEQ ID NO: 27105 - RNA, 366 nt, synthetic construct
  misc_feature 1..366: note = derived and/or modified sequence opt3 from anti-HIV_Chain
  source 1..366: mol_type = other RNA
cagctgcaactcgtggagagcggcgggggagtcgttcagcccggtagatcccttaggctgtcttgcgccgcttcaggcttcacctttagtacatacactatgcactgggtgcggcaggcacctgggaagggattggaatgggtagccgtgatcagctatgacggcacgaataaatactatgcggattccgtcaagggtcgcttcaccatttctcgagacaattcgaaaaacacattatacctgcagatgaactcactacgtggggaggatactgctgtgtattactgtgccagaagcccaagttattactttgactactggggacaaggcaccctcgttacagtgtccgcagcctctaccaagggc

SEQ ID NO: 27106 - RNA, 369 nt, synthetic construct
  misc_feature 1..369: note = derived and/or modified sequence opt3 from anti-HIV_Chain
  source 1..369: mol_type = other RNA
caggtgcacctgagccaatccggcgccgctgtcaccaagcccggggcatctgttagagtgtcatgcgaggccagtggatacaaaatcagcgaccatttcattcactggtggaggcaggcgcctggtcagggcctccagtgggtagggtggataaacccaaagacaggacaaccgaataacccccggcagtttcagggccgcgtgtcccttactcgacaggcttcttgggatttcgacacgtattcgttttacatggatctgaaagccgtccgttcagacgataccgcaatctatttctgtgccagacaaaggagcgacttttgggatttcgacgtgtggggtagtgggacacaggttactgtgtcctct

SEQ ID NO: 27107 - RNA, 369 nt, synthetic construct
  misc_feature 1..369: note = derived and/or modified sequence opt3 from anti-HIV_Chain
  source 1..369: mol_type = other RNA
caggtgcaactgctccagagcggcgccgtcgttaccaagcccggggcttccgtgagagtatcttgcgaggcatcaggatacaaaatcagggactatttcattcactggtggcggcaggcccctggtcagggccttcaatgggtggggtggataaacccacagacaggacagccgaatatcccccgcccttttcagggccgagtcactctgacgcgtcatgcgagttgggatttcgacacctttagcttctacatggatttgaaggctttaagatccgacgatacagccatttatttttgtgcaaggcggcgctctgactactgcgatttcgacgtgtggggttcggggactcacgttaccgtgtcaagc

SEQ ID NO: 27108 - RNA, 369 nt, synthetic construct
  misc_feature 1..369: note = derived and/or modified sequence opt3 from anti-HIV_Chain
  source 1..369: mol_type = other RNA
caggtgcaactgctccagagcggcgccgctgtcaccaagcccggggcatccgttagagtgtcttgcgaggcctcaggatacaacatcagggactatttcattcactggtggcggcaggcgcctggtcagggccttcaatgggtagggtggataaatccaaaaacaggacagccgaacaatccccgccagtttcagggccgagtgagtctgactcgtcatgctagctgggatttcgacacgttttccttctacatggatttgaagggtttaagatctgacgataccgccatctatttttgtgcaaggcaacggtcggactactgggatttcgacgtctgggggtcaggaacacaggtgactgttagcagt

SEQ ID NO: 27109 - RNA, 369 nt, synthetic construct
  misc_feature 1..369: note = derived and/or modified sequence opt3 from anti-HIV_Chain
  source 1..369: mol_type = other RNA
caggtgcaactgctccagagcggcgccgctgtcaccaagcccggggcatccgttagagtgtcttgcgaggcctcaggatacaacatcagggactatttcattcactggtggcggcaggcgcctggtcagggccttcaatgggtagggtggataaatccaaaaacaggacagccgaacaatccccgcctgtttcagggccgagtgagtttgactcgtcatgctagctgggatttcgacacgttttccttctacatggatttaaaggccgtcagatctgacgataccgcagtgtatttttgtgccaggcagcggtcggactactgggatttcgacgtttggggttcagggacacaagtgactgtcagcagt

SEQ ID NO: 27110 - RNA, 369 nt, synthetic construct
  misc_feature 1..369: note = derived and/or modified sequence opt3 from anti-HIV_Chain
  source 1..369: mol_type = other RNA
caggtgagactgctccaaagcggcgccgctgtcaccaagcccggggcatccgttagggtgtcttgcgaggcctcaggatacgaaatccgggactatttcattcactggtggcgccaggcgcctggtcagggccttcagtgggtagggtggataaacccaaaaacaggacaaccgaataacccccgacagtttcagggccgtgtgagtctgactagacaggctagctgggatttcgactcctactctttttatatggatttgaaggccttaaggtcggacgatacgggtgtctacttctgtgcacggcaacgctcagactattgggattttgacgtgtgggggagcggaacccaggttacagtgagttcc

SEQ ID NO: 27111 - RNA, 369 nt, synthetic construct
  misc_feature 1..369: note = derived and/or modified sequence opt3 from anti-HIV_Chain
  source 1..369: mol_type = other RNA
caggtgcaactgctccagagcggcgccgctgtcaccaagcccggggcatccgttagagtgtcttgcgaggcctcaggatacaacatcagggactatttcattcactggtggcggcaggcgcctggtcagggccttcaatgggtagggtggataaatccaaaaacaggacagccgaacaatccccgccagtttcagggccgagtgagtctgactcgtcatgctagctgggatttcgacacgttttccttctacatggatttgaaggccttaagatctgacgataccgcagtctatttttgtgccaggcaacggtcggactactgggatttcgacgtgtggggttcagggacacaggttactgtgagcagt

SEQ ID NO: 27112 - RNA, 369 nt, synthetic construct
  misc_feature 1..369: note = derived and/or modified sequence opt3 from anti-HIV_Chain
  source 1..369: mol_type = other RNA
gaggtgcagctggtcgaaagcggcgggggactcatccaaagaggtggctcccttaggctgtcttgcgttgcctcagggttccccgtgagtgacaaccacatgagctgggtacggcaggctcctggaaagggcttggagtgggtgtccattatatactctgatggtgggacctattacgcagactcggtcaaaggacgctttacaatctcacgagataatagcaagaacactgtgtatttacagatgaatagtctgcgtgccacggacaccgcggtttactattgtgctagagatccaggcttccattacggcctagacgtgtgggggcagggaacaactgtcaccgtgtcctctgccagcacaaaaggt

SEQ ID NO: 27113 - RNA, 369 nt, synthetic construct
  misc_feature 1..369: note = derived and/or modified sequence opt3 from anti-HIV_Chain
  source 1..369: mol_type = other RNA
caggtgcaactgcaggagagcggccccgggctccttagacctctggaaaccttgtccttaacatgctctgtctcaggaggtagtatcaggggctacttctggagctgggttcggcagccagccgggcgcggactggagtggattggccgaatatattcctctggtactacgcgttttaacccgtcgctaaagtcaagagtgaggctcagcatcgacaccgctaaaagtgaagtatccctgaatattacatctgtgactgcagccgatagcgcgtcctacttctgtgctgggacctcacccgtccacggaggccttgacctgtggggcttggggctccgggtgacagttagtagcgcctctaccaaggga

SEQ ID NO: 27114 - RNA, 369 nt, synthetic construct
  misc_feature 1..369: note = derived and/or modified sequence opt3 from anti-HIV_Chain
  source 1..369: mol_type = other RNA
gagatcgtgctgacccagagccccggcacactctccctttctcctggggaaagagccactctgtcatgcagggctagtcaaagcgtctcctctaacttggcatggtacgcccagaagccaggacaggcgccgcggttaattatatatggtgcttcgtcacgcgccagcgcaatccccgaccgattccgtggcagtgggtccggaacggattttaccctgacaatttctagactagagcctgaagacttcgccgtttactattgtcagcaatacgatgacgctccaatcacttttggccacggtaccaggctcgagattaaacggacagtggcagcccccagcgtattcatctttcctccatccgatgaa

SEQ ID NO: 27115 - RNA, 369 nt, synthetic construct
  misc_feature 1..369: note = derived and/or modified sequence opt3 from anti-HIV_Chain
  source 1..369: mol_type = other RNA
gagatcgtgctgacccagagccccggcacactctccctttctcctggggacagagccgctctgtcatgcagggcaagtgaaactttgagcggaaactccttagcctggtaccaacagaagcggggtcagccaccgcgcctgctaattttcgcggcttcttcgcgagccacgggcatacccgagcgtttttcagggggaggcagcggtaccgatttcacactcactatcaccagactggaacctgaggactttgcagtctatttctgtcagcaatacgttgatgccccaattacatttgggcagggaaccaggcttgaaatcaaacggactgtggctgcacccagtgtattcatttttcctccatccgac

SEQ ID NO: 27116 - RNA, 369 nt, synthetic construct
  misc_feature 1..369: note = derived and/or modified sequence opt3 from anti-HIV_Chain
  source 1..369: mol_type = other RNA
gacatccagatgacccaaagcccctcctctctgtcagccagtgtgggcgatagagtcacaattacttgcagggctagccaggacataacgacctacctcgcatggcttcagcagaagcctgggaaagccccaaagtccctgatctattctgcgtcgacagttcaatcaggagtgccgagccggttcagtggttccggctctgggactgagtttaccttgacaattagcggattacagcccgaagatttcgctacctactattgtcagcagtacaactattaccctatcacttttggcctgggtacacgcctagagattaaacgaaccgtagccgcaccatccgtgttcatctttcccccttcagacgaa

SEQ ID NO: 27117 - RNA, 369 nt, synthetic construct
  misc_feature 1..369: note = derived and/or modified sequence opt3 from anti-HIV_Chain
  source 1..369: mol_type = other RNA
gacatccagatgacccaaagcccctcctctctgtcagccagtattggcgatagagtgacaataacttgcagggctaaccagcacatccggagcttcctcaattggtaccagcagacgcctgggaaggcaccaaaacttctgatttatgccgcgtccaccttgcaacgcggagtcccgtctcgattttcgggttcaggcagcgggacagacttcactttaaccatcacaagtctggagcgtgaagatctagctacctactattgtcagcagacttacacatcccccattacctttggacagggcacgagactcgagatcaagaggactgttgccgcaccttctgtgttcatatttccacccagcgacgaa

SEQ ID NO: 27118 - RNA, 369 nt, synthetic construct
  misc_feature 1..369: note = derived and/or modified sequence opt3 from anti-HIV_Chain
  source 1..369: mol_type = other RNA
agcgagatcgtgctgacccagtcccccgccacactctctctttcacctggcgaaagtgctactctgagctgcagagcatcccaatctttgtcgagctcattagcctggtaccagcagaagccagggcaggcgccgaggctgctaatttatgacacgagtgatcgggctaccggaatacccgcccgcttctccggtcgaggctctgggacagactttactctcaccatcagctccctggagcctgaagatttcgcagtctactattgtcaacagcgttcaaactgggccattacatttggacagggcaccagacttgagatcaaaaggactgttgctgcaccaagtgtgttcatttttccccctagcgac

SEQ ID NO: 27119 - RNA, 369 nt, synthetic construct
  misc_feature 1..369: note = derived and/or modified sequence opt3 from anti-HIV_Chain
  source 1..369: mol_type = other RNA
caggtgctgagcgtctccggcacccccgggcaaagagttatcatttcttgctcaggaacaagtagcaacgtgggtggcaatctcgtatcctggtaccagcaccttcctggggccgctccaaggctgttgatacatcgggacgatcagcgcccgtctggagtgcccgaccgattctcgggctcaaagagcggtaacagtgcatccttagtcatctctgggctgcgtagcgatgacgaggccgattatttttgtgcggcttacgactccactttctcactacctgtgtttggaggcggcacgagactcaccgttctgagtcagccaaaagccgcacccagcgtgacactttatgccccttcttccgaagag

SEQ ID NO: 27120 - RNA, 369 nt, synthetic construct
  misc_feature 1..369: note = derived and/or modified sequence opt3 from anti-HIV_Chain
  source 1..369: mol_type = other RNA
gacatccagatgacccaaagcccctcctctctgtcagccagtgtgggcgatagagtcacaattacttgccaggctgggcagggaataggtagctccctccagtggtaccaacagaagcctggcaaagcaccaaaacttctggttcacggggcctctaacttgcataggggagtgccgtcgcggttctcaggcagcggttttcacacgaccttcagtttaacaatctccgggctgcagcgcgacgattttgcgacttatttctgtgctgtactagagtttttcggacccggcaccaaggtggaaattaagcgaacagtcgccgcaccttctgtgtttatcttcccacccagcgacgagcagctcaaatcc

SEQ ID NO: 27121 - RNA, 369 nt, synthetic construct
  misc_feature 1..369: note = derived and/or modified sequence opt3 from anti-HIV_Chain
  source 1..369: mol_type = other RNA
gagatcgtgctgacccagagccccgccacactctccctttctcctggcgaaagagctactctgtcatgcagggcaagtcaagggttgaacttcgtcgtttggtaccagcagaagcggggacaggccccacgcttactgattcacgcgccgagcgaccgagctcccggtgtgcctgatcgtttctccgccagaggctctgggacggacttctcgctagtaatatcaagcgtggagccagatgactttgcaatctattactgtcaagaatatagttccaccccctacaatttcggacctggcacaagggtcgatcggaaacgcactgtggccgctccatctgtttttatttttccccctagcgacgagcag

SEQ ID NO: 27122 - RNA, 369 nt, synthetic construct
  misc_feature 1..369: note = derived and/or modified sequence opt3 from anti-HIV_Chain
  source 1..369: mol_type = other RNA
gagatcgtgctgacccagagccccacaactctctccctttctcctggcgaaagagccacgctgtcatgcagggctagtcaaggggtcaacttggttgtgtggtaccagcagaagcggggacaggcaccacgcttactgatttatggtccgagcgaccgagcccccggcgtacctgatcgtttctccgcgagagggtctggaaccgagttttcgctagtgatatcaagcgtcgaaccagacgatttcgctctctactattgtcaagagtacagttccacaccctataattttggcactggtaccagggtggaccggaaacgcacagttgccgcaccttctgtgttcatctttccacccagcgatgaacag

SEQ ID NO: 27123 - RNA, 369 nt, synthetic construct
  misc_feature 1..369: note = derived and/or modified sequence opt3 from anti-HIV_Chain
  source 1..369: mol_type = other RNA
gagatcgtgctgacccagagccccgccacactctccctttctcctggcgaaagagctactctgtcatgcagggcaagtcaaggggtcaacttcgttgtgtggtaccagcagaagcggggacaggccccacgcttgttaatttatggtccgagcaatcgagcgcccggcgtacctgaccgtttctccgctagagggtctggaacggagttctcgctggtgatatcaagcgtcgaaccagatgactttgccctatactattgtcaagagtacagttccaccccctataacttcggccctggtacaagggtggatcggaaacgcactgttgcagccccatctgtgtttatctttccccctagcgacgaacag

SEQ ID NO: 27124 - RNA, 369 nt, synthetic construct
  misc_feature 1..369: note = derived and/or modified sequence opt3 from anti-HIV_Chain
  source 1..369: mol_type = other RNA
gagatcgtgctgacccagagccccgccacactctccctttctcctggcgaaagagctactctgtcatgcagggcaagtcaagggttgaacttcgtcgtttggtaccagcagaagcggggacaggccccacgcttactgattcacggtccgagccatcgagcgcccggcgtgcctgaccgtttctccgctagagggtctggaacggagttctcgctagtaatatcaagcgtggaaccagatgactttgccatctattactgtcaagagtatagttccaccccctacaatttcggccctggtacaagggtcgatcggaaacgcactgtggcagccccatctgtttttatttttccccctagcgacgaacag

SEQ ID NO: 27125 - RNA, 369 nt, synthetic construct
  misc_feature 1..369: note = derived and/or modified sequence opt3 from anti-HIV_Chain
  source 1..369: mol_type = other RNA
gagatcgtgctgacccagagccccgccacactctccctttctcctggcgaaagagctactctgtcatgcagggcaagtcaagggttgaacttcgtcgtttggtaccagcagaagggaggtcaggccccacggttactgattcacggcccgacggaccgcgcgcccggggtgcctgatcgattcagcgctcgtggatccggcaccgagttctctctagtaatatcgtcagtggaaccagacgattttgccctctattactgtcaagagtatagcagtacaccctacaatttcggtcctgggactagagtcgacaggaaacggaccgtggcagccccatccgtttttatctttcccccttctgatgaacag

SEQ ID NO: 27126 - RNA, 369 nt, synthetic construct
  misc_feature 1..369: note = derived and/or modified sequence opt3 from anti-HIV_Chain
  source 1..369: mol_type = other RNA
gagatcgtgctgacccagagccccgccacactctccctttctcctggcgaaagagctactctgtcatgcagggcaagtcaagggttgaacttcgtcgtttggtaccagcagaagcggggacaggccccacgcttactgattcacgcgccgagcggtcgagctcccggcgtgcctgaccgtttctccgccagagggtctggaacggagttctcgctagtaatatcaagcgtggaaccagatgactttgcaatctattactgtcaagagtatagttccaccccctacaatttcggccctggtacaagggtcgatcggaaacgcactgtggccgctccatctgtttttatttttccccctagcgacgaacag

SEQ ID NO: 27127 - RNA, 369 nt, synthetic construct
  misc_feature 1..369: note = derived and/or modified sequence opt3 from anti-HIV_Chain
  source 1..369: mol_type = other RNA
caggtgcaactggtccagagcggcgccgaggttaagaaacccgggtcctctgtgaaggtatcatgcaaaaccagtggaggtagcttctccaactacgctttttcttgggtgagacaggcacctggcgaagggctcgagtggatgggaaggatcattccaatattcggcacagccaagtatactcagaaacttcaaggtcgggtcacgatcaccgcggacaagtttacatcgactgtgtacatggaactgagctcattgcgcagtgaggataccgctatttattactgtgcctccttacaccaggggccgatcggatatacaccctggcatcctccaccccgagcacctctgggccagtctgtttgcggc

SEQ ID NO: 27128 - RNA, 369 nt, synthetic construct
  misc_feature 1..369: note = derived and/or modified sequence opt3 from anti-HIV_Chain
  source 1..369: mol_type = other RNA
caggtgcaactggtcgagagcggcgggggactcgttcagcccggtggctcccttagaatctcttgctcagccaccgggttcacatttagtactcacgctatgcattgggtgaggcaggcacctggaaagggcctggaatacgtaagcgccattaactccaatggtcggtctgcgttctatgctgactcggtgaaagggcgcgtcacgatatcacgagataacagcaagaataccttgtttttacagatgacaagtctgcgtgccgaggacactgcagtgtactattgtgttaaaggaccactactcagatacctggattcctggggccaaggcacccttgtgacagtctctagcgcctccaccaagggg

SEQ ID NO: 27129 - RNA, 369 nt, synthetic construct
  misc_feature 1..369: note = derived and/or modified sequence opt3 from anti-HIV_Chain
  source 1..369: mol_type = other RNA
gaggtgcagctggtcgaaagcggcgggggactcgttcaacccggtggctcccttagaatctcttgctcagccaccgggttcacatttagtactcacgctatgcattgggtgaggcaggcacctggaaagggcctggagtacgtaagcgccattaactccaatggtcggtctgcgttctatgctgactcggtgaaagggcgcgtcacgatatcacgagataacagcaagaataccttgtttttacagatgacaagtctgcgtgccgaagacactgcagtgtactattgtgttaaaggaccactactcagatacctggattcctggggccagggcacccttgtgacagtctctagcgcctccaccaagggg

SEQ ID NO: 27130 - RNA, 369 nt, synthetic construct
  misc_feature 1..369: note = derived and/or modified sequence opt3 from anti-HIV_Chain
  source 1..369: mol_type = other RNA
gaggaaagcggccccgggctggtgaagccttcccagaccctctctcttacatgctcagtcagtggagacagcgtttcctctggtggctacttctggtcgtggatcagacaacacccaactaaagggctggagtgtttgggatatgtgtactatacgggcaacacctactataatccgtcattaaagagtccccctacaattgaagtagccatggctaacaatcaggtgagcctgaaactaggttccgtcactgcagccgataccgcggtgtactattgcgctaggataaagcggtttcgcgggggaaactacttcgacacatggggccatggcctcctggttaccgtgtctagcgcctccactaaaggg

SEQ ID NO: 27131 - RNA, 369 nt, synthetic construct
  misc_feature 1..369: note = derived and/or modified sequence opt3 from anti-HIV_Chain
  source 1..369: mol_type = other RNA
caggtgcaactgcaggagagcggctccgggctcgtcaagccctctggaaccctttcactgacatgcgccgttagtaacggtcctatcagctccggcaattggtggtcttgggtgagacagactccagaaaaagggttggagtggattggagaagtataccactcgggctcaacgaaccataatccgagcttaaagagtagggctaccatactggtggacaaatccaagaaccagttctctctaaatctccggagcgtcacagcagccgatactgcggtgtattactgtgctcgcgttcgaggttcctggaactttgactattgggggcaaggaatcctggtgaccgtctcaagtgccagcacaaaaggc

SEQ ID NO: 27132 - RNA, 369 nt, synthetic construct
  misc_feature 1..369: note = derived and/or modified sequence opt3 from anti-HIV_HeavyChain
  source 1..369: mol_type = other RNA
gaggtgcagctgcaacagagcggcaccgtcctcgccagacccggggcttccgttaagatgtcttgcaaagcatcaggatacacattcacttcatattggatgcactgggtgaagcagaggcctggtcagggccttgaatggatcggggccatttacccaggaaacagcgacacgtcctataatcaaaaatttaagggcaaagcgaagctgaccgctgtaacatctgcctcgactgcatacatggagttgagtagcttaaccaacgaagatagtgccgtgtattactgtacacggtggccgcattattacggtgggtcccgctactatttcgactactggggacagggcaccactctgacagtctctagc

SEQ ID NO: 27133 - RNA, 372 nt, synthetic construct
  misc_feature 1..372: note = derived and/or modified sequence opt3 from anti-HIV_Chain
  source 1..372: mol_type = other RNA
gtggtccagctggttgagagcggcgggggactcgtgcaacccggtggctcccttagactgtcttgcgccgcttcagggttcgcatttaggagttactggatgagctgggtacggcaggcccctggacgcggcttggaatgggtggcgaacatcaagcaggacggttccgagaaatattacgctgattctgtcaaggggcgattcaccatttcgcgtgacaatactaaaaactcattatatctgcagatgaatagcctaagagccgaagatacagcagtgttttactgtgccagtaggggagaccggtatggcccaatagattactggggccaagggacgctcgttaccgtgtcctctgctagcacaaaggga

SEQ ID NO: 27134 - RNA, 372 nt, synthetic construct
  misc_feature 1..372: note = derived and/or modified sequence opt3 from anti-HIV_Chain
  source 1..372: mol_type = other RNA
caggtgcaactggtccagagcggcgccgagatcaagaaacccggggaatccctcaagatttcttgcaaggcttcaggatacaccttcaacgactattggataggttgggttagacagatgcctggcaaagggcttgagtggatgggaatcttttacccagatgacagtgatagcaattattccccgtctttccagggcagggtgacaatttcggcagacaaatcaatcactacggcctacctgcaatggagcaccttgaaggcgagtgattccgctatgtatttttgtgcccggttactgggtgactctggggcattcgatatttggggacagggcacaatggtaatcgtgagctccgcctcaactaagggc

SEQ ID NO: 27135 - RNA, 372 nt, synthetic construct
  misc_feature 1..372: note = derived and/or modified sequence opt3 from anti-HIV_Chain
  source 1..372: mol_type = other RNA
caggtgcaactggtccagagcggcgggggactcgttaagcccggtggctcccttagactgtcttgcgccgcttcagggttcacctttagtagctactccatgaactgggtgaggcaggcacctggaaaaggcttggagtgggtatcttcgatctcaagcagttcctcttatatttactatgccgacagcgtgaagggtcggttcacaatatcccgcgataatgcgaaaaactcattatacctgcagatgaatagtctacgagctgaagacactgccgtctattactgtgcacgtgaggggagctattactacggaatggatgtgtggggccaaggcacgaccgttacagtgtcttccgcctcaactaagggg

SEQ ID NO: 27136 - RNA, 372 nt, synthetic construct
  misc_feature 1..372: note = derived and/or modified sequence opt3 from anti-HIV_Chain
  source 1..372: mol_type = other RNA
gagatcgtgctgacccagagccccgccacactctccgtctctcctggcgaaagagctactctttcatgcagggcagggcaaagtgttagctccgacctggcctggtaccagcacaagccaggacaggcgccgcggttgttaatttatgatgcttctaaacgcgccacgggtatacccgcacgattctcgggctcagggagcggaaccgactttacactgactatcagttccctagagcctgaagatttcgccgtgtactattgtcagcatcgtaccaactggccaccctctattacatttggccaaggtaccagactcgagatcaagaggactgtagctgcacctagcgtgttcatttttccaccctccgac

SEQ ID NO: 27137 - RNA, 372 nt, synthetic construct
  misc_feature 1..372: note = derived and/or modified sequence opt3 from anti-HIV_Chain
  source 1..372: mol_type = other RNA
gagatcgtgctgacccagagccccggcacactctccctttctcctggggaaagagccactctgtcatgcagggctagtcaaagcgtctcctctcggtacttggcatggtatcagcagaagccaggacaggccccgcgcttaattatatacgacgcgtcgtcacgagctagcggtatccccgatcgtttcagtggctccgggtctgagacggactttaccctgacaattactagactagaacctgaggatttcgccgtttattactgtcaactctatggaaccagcccaaaatttacattcggccagggtaccaagctggaaatcaaaaggactgtggcagccccctccgtatttattttccctccatcagac

SEQ ID NO: 27138 - RNA, 372 nt, synthetic construct
  misc_feature 1..372: note = derived and/or modified sequence opt3 from anti-HIV_Chain
  source 1..372: mol_type = other RNA
gagatcgtgctgacccagagccccggcacactctccctttctcctggggaaagagccactctgtcatgcagggctagtcaaagcgtctccaacaattacttggcatggtatcagcagaagccaggacaggccccgcggttactgatttacggtgcgtcttcgcgcgctacgggcatacccgaccgattctcagggagcggaagtggcaccgattttacactaactatctcccgtctcgagcctgaagacttcgccgtttattactgtcaacagtatgcaacctctagcctgtacacatttggtcaggggaccaaacttgagattaagagaactgtggccgctccatccgtattcatctttcccccttcagat

SEQ ID NO: 27139 - RNA, 372 nt, synthetic construct
  misc_feature 1..372: note = derived and/or modified sequence opt3 from anti-HIV_Chain
  source 1..372: mol_type = other RNA
cccgccaccctggctgtgagccctggcgagagagcaacaatctcctgcaagtcttcacagaacctcctttacagtgccaataaccaacacagcctggcgtggtatcagcagaggccagggcagccgcccaaattgttactgtactgggcttccactcggctatctggagtccctgaccgcttctcgggttcaggcagcgggacggatttcaccctcacaattagtaatctgcaagccgaagacgttgcagtgtattactgtcagcagtattactccccaccccctactttcggacagggcaccaaggtagagatacgacgtacagtggccgctccatctgtctttatctttccccctagcgatgaacaactt

SEQ ID NO: 27140 - RNA, 372 nt, synthetic construct
  misc_feature 1..372: note = derived and/or modified sequence opt3 from anti-HIV_Chain
  source 1..372: mol_type = other RNA
cagcccgtgctgacccaacctccaagcgcctccggcgctccggggcagagagtcacaatctcttgctcaggaggtcccagtaacgttggcgggaattacgtgtattggtacaggcagttccctggaactgcaccaaacctccttattctgcgggacgatcagcgccccagcggcgtacctgaccgattttccgcctctaagtcgggtaattcagcgagcttggctataacggggttacgtccagatgacgaggccttctatttttgtgcaacctacgatagtgacggatccatcagactgttcggcggcgggacagccctaactgtgctctctcaacccaaagctgcacctagcgtcaccctgtttccaccg

SEQ ID NO: 27141 - RNA, 372 nt, synthetic construct
  misc_feature 1..372: note = derived and/or modified sequence opt3 from anti-HIV_Chain
  source 1..372: mol_type = other RNA
aacttcatgctgacccagccccctagcgcctccggcgctccagggcaaagagtgacaatctcttgctcaggaggtccgagtaatgtcggcgggaactacgtttattggtacaggcagtttcccggaactgcacctaatctccttattctgcgggacgatcagcgcccaagcggcgtgcccgaccgattctccgcctctaagtcgggtaactcagcgagcttggctataagtgggttacgtcctgatgacgaggccttttatttctgtgcaacgtacgattccgacggatctatcagactgtttggcggcgggaccacactaactgtactcagccagccaaaagccgctccctccgtgaccctgttccctcca

SEQ ID NO: 27142 - RNA, 372 nt, synthetic construct
  misc_feature 1..372: note = derived and/or modified sequence opt3 from anti-HIV_Chain
  source 1..372: mol_type = other RNA
gacatccagatgacccaaagccctccctccctgtctgcctcagtgggcgatagagtcacaattacttgccaggctagtcaggacataaacaatttcctcaactggtaccagcaaaagccagggaaagcaccgaggcttctgatctatgatgccagcaatttggagtccggagtttcttcgcggttttcaggtagccgcagtggcacggacttcaccttaacaatttcctctctgctacccgaagatatcgcgacttacagctgtcagcagtattccaacctcccttacaccttttcacaggggacaaagctggagattaaacgaaccgtggctgccccaagtgtattcatctttccccctagcgacgaacaa

SEQ ID NO: 27143 - RNA, 372 nt, synthetic construct
  misc_feature 1..372: note = derived and/or modified sequence opt3 from anti-HIV_Chain
  source 1..372: mol_type = other RNA
caggtgcaactggtccagagcggcaccgccgttaagagacccggggcttccgtgagggtatcttgccaggcatcaggatacacattcatcgaccactttatttattggtggcggcaggcccctggtcaaggcctcgagtggcttgggtggataaacccactgacgagtcagccgagctacccctcccgcttccagggacgattgactttaacccgtgatacatttgacgaaatgctgtatatggatctaagaggcctcaggtctgacgatactggtatctacttctgtgcgcggcgccattcggactattgcgattttgacatttgggggtcaggaacccagatcattgtgagcagtgcttccacaaaaggc

SEQ ID NO: 27144 - RNA, 372 nt, synthetic construct
  misc_feature 1..372: note = derived and/or modified sequence opt3 from anti-HIV_Chain
  source 1..372: mol_type = other RNA
caggtgcaactggtccagagcggcgccgctctcaagaaacccggggcatcccttagaatctcttgccaggcctacggatataagttcaccgaccacctgatttactggtggaggcaggcgcctggtcaaggcttggagtggatagggtggatcaaaccagaaacaggacagccgtcatatagttacaagtttcagggccgggttagcttaactcgcgatacgttccaggagattctgtttatggacctacgaggtctccgttccgatgacaccgctatctatttctgtgccagaaggcattctgattactgcgactttgatgtgtgggggtcgggatcacaagtaattgtgagcagtgcatccacaaaaggc

SEQ ID NO: 27145 - RNA, 372 nt, synthetic construct
  misc_feature 1..372: note = derived and/or modified sequence opt3 from anti-HIV_Chain
  source 1..372: mol_type = other RNA
caggtgcaactggtccagagcggcgccgctctcaagaaacccggggcatcccttagaatctcttgccagacctacggatataagttcacagaccacctgatttactggtggaggcaggcccctggtcaaggcttggagtggatggggtggataaaaccagaaactggacagccgtcatatagttaccggtttcagggccgcgttagcttaacgcgagataccttcgaggaaatcgtgtttatggacctgcgtggtctaagatccgatgacacagcgatttatttctgtgctaggcggcattctgattactgcgactttgatgtatgggggtcgggatcacaggtgatcgtcagcagtgcctccactaagggc

SEQ ID NO: 27146 - RNA, 372 nt, synthetic construct
  misc_feature 1..372: note = derived and/or modified sequence opt3 from anti-HIV_Chain
  source 1..372: mol_type = other RNA
caggtgcaactggtccagagcggcgccgctctcaagaaacccggggcatcccttagaatctcttgccagacctacggatataagttcacagaccacctgatttactggtggaggcaggcccctggtcaaggcttggagtggatagggtggatcaaaccagaaactggacagccgtcatatagttaccggtttcagggccgcgttagcttaacgcgagataccttcgaggaaattgcgtttatggacctgcgtggtctaagatccgatgacacagctatctatttctgtgccaggcggcatactgattactgcgtgtttgacgtatgggggtctggatcgcagattatcgtgtcaagcgcaagtaccaagggc

SEQ ID NO: 27147 - RNA, 372 nt, synthetic construct
  misc_feature 1..372: note = derived and/or modified sequence opt3 from anti-HIV_Chain
  source 1..372: mol_type = other RNA
caggtgcaactggtccagagcggcaccgccgttaagagacccggggcttccgtgagggtatcttgccaggcatcaggatacacattcactgactattttatctactggtggcggcaggcccctggtcaaggcctcgagtggcttgggtggattaacccactgacgagtcagccgagctatccctcccgcttccagggacgattgaccttaacacgtgatacttttgacgaaatgctgtacatggatctaagaggcctcaggtctgacgataccggtatatatttctgtgcgcggcgccactcggactactgcgattttgacatctgggggtcaggaacacagattatcgtgagcagtgcttccaccaaaggc

SEQ ID NO: 27148 - RNA, 372 nt, synthetic construct
  misc_feature 1..372: note = derived and/or modified sequence opt3 from anti-HIV_Chain
  source 1..372: mol_type = other RNA
caggtgcaactggtccagagcggcgccgctctcaagaaacccggggcatccgttagaatctcttgccaggcctacggatataagttcaccgaccaccttatttactggtggaggcaggcgcctggtcaaggcctggagtggatagggtggatcaaaccagaaacaggacagccgtcatatgcttacaagtttcagggccgggtgactttgacgcgcgataccttcgaggaaattcattttatggacttacgaggtgtacgtaacgatgacacagccacttatttctgtgcaagaaggcacagtgattactgcgactttgatgtgtgggggagcggatcccaggtcatcgtgtcttcggcctcaaccaaaggc

SEQ ID NO: 27149 - RNA, 372 nt, synthetic construct
  misc_feature 1..372: note = derived and/or modified sequence opt3 from anti-HIV_Chain
  source 1..372: mol_type = other RNA
caggtgcaactggtccagagcggcgccgctctcaagaaacccggggcatccgttagaatctcttgccagacctacggatataagttcacagaccaccttatttactggtggaggcaggcccctggtcaaggcctggagtggatagggtggatcaaaccagaaactggacagccgtcatatagttaccggtttcagggccgcgtgagcttgacgcgagataccttcgaggaaattgtatttatggacttacgtggtctgagatccgatgacacagcgatctatttctgtgctaggcggcattctgattactgcgactttgatgtgtgggggtcgggatcacaggtcctagtgagcagtgcctccactaagggc

SEQ ID NO: 27150 - RNA, 372 nt, synthetic construct
  misc_feature 1..372: note = derived and/or modified sequence opt3 from anti-HIV_Chain
  source 1..372: mol_type = other RNA
caggtgcaactggtccagagcggcgccgctctcaagaaacccggggcatcccttagaatctcttgccagacctacggatataagttcacagaccacctgatttactggtggaggcaggcccctggtcaaggcttggagtggatagggtggatcaaaccagaaactggacagccgtcatatagttaccggtttcagggccgcgttagcttaacgcgagataccttcgaggaaattgtgtttatggacctgcgtggtctaagatccgatgacacagcgatctatttctgtgctaggcggcattctgattactgcgactttgatgtatgggggtcgggatcacaggtgctcgtcagcagtgcctccactaagggc

SEQ ID NO: 27151 - RNA, 372 nt, synthetic construct
  misc_feature 1..372: note = derived and/or modified sequence opt3 from anti-HIV_Chain
  source 1..372: mol_type = other RNA
caggtgcaactggtccagagcggcgccgctctcaagaaacccggggcatccgttagaatctcttgccagacctacggatataagttcacagaccaccttattcattggtggaggcaggcccctggtcaaggcctggagtggatagggtggatcaaaccagatactggacagccgtcatacagtagccggtttcagggccgcgtgtccttgacgcgagacaccttcgaagagattgtatttatggatttacgtggtctgagatctgacgatacagcgatctatttctgtgctaggcggcactcggactactgcgattttgacgtgtgggggtcaggaagccaggtcctagtgagttccgcctctactaagggc

SEQ ID NO: 27152 - RNA, 372 nt, synthetic construct
  misc_feature 1..372: note = derived and/or modified sequence opt3 from anti-HIV_Chain
  source 1..372: mol_type = other RNA
caggtgcaactggtccagagcggcgccgctctcaagaaacccggggcatcccttagaatctcttgccagacctacggatataagttcacagaccacctgatttactggtggaggcaggcccctggtcaaggcttggagtggatagggtggatcaaaccagaaactggacagccgtcatatagttaccggtttcagggccgcgttagcttaacgcgagataccttcgaggaaattgtgtttatggacctgcgtggtctaagatccgatgacacagcgatctatttctgtgctaggcggcattctgattactgcgactttgatgtatgggggtcgggatcacaggtgattgtcagcagtgcctccactaagggc

SEQ ID NO: 27153 - RNA, 372 nt, synthetic construct
  misc_feature 1..372: note = derived and/or modified sequence opt3 from anti-HIV_Chain
  source 1..372: mol_type = other RNA
caggtgcaactggtccagagcggcgccgctctcaagaaacccggggcatcccttagaatctcttgccagacctacggatataagttcacagaccacctgatttactggtggaggcaggcccctggtcaaggcttggagtggatagggtggatcaaaccagaaactggacagccgtcatatagttaccggtttcagggccgcgttagcttaacgcgagataccttcgaggaaattgtgtttatggacctgcgtggtctaagatccgatgacacagcgatctatttctgtgctaggcggcattctgattactgcgactttgatgtatggggagggggctcacaggtgattgtctcgagcgccagtactaagggc

SEQ ID NO: 27154 - RNA, 372 nt, synthetic construct
  misc_feature 1..372: note = derived and/or modified sequence opt3 from anti-HIV_Chain
  source 1..372: mol_type = other RNA
caggtgcaactggtccagagcggcgccgctctcaagaaacccggggcatcccttagaatctcttgcctgacctacggatataagttcacagaccacttgatttactggtggaggcaggcccctggtcagggcttagagtggatagggtggatcaaaccagaaactggacaaccgtcatatagttaccggtttcagggccgcgttagcctgacgcgagataccttcgaggaaattgtgtttatggacctacgtggtctcagatccgatgacacagcgatctatttctgtgctaggcggcattctgattactgcgactttgatgtatgggggtcgggatcacaggtgattgtcagcagtgcctccactaagggc

SEQ ID NO: 27155 - RNA, 372 nt, synthetic construct
  misc_feature 1..372: note = derived and/or modified sequence opt3 from anti-HIV_Chain
  source 1..372: mol_type = other RNA
caggtgcaactggtccagagcggcgccaccctcaagaaacccggggcttccgttagaatctcttgccaggcatacggatataagttcacagaccaccttattcattggtggaggcaggcccctggtcaaggcctggagtggatagggtggatcaaaccagaaactggacagccgtcatacgcgtataagtttcagggccgggtgagtttgacgcgcgataccttcgaggaaattttatttatggacctgcgaggtctacgtagcgatgacacagctatctacttctgtgccagaaggcactccgattattgcgacctcgatgtatggggagggggcactcagctgcttgtgtcttcggcatcaaccaaaggc

SEQ ID NO: 27156 - RNA, 372 nt, synthetic construct
  misc_feature 1..372: note = derived and/or modified sequence opt3 from anti-HIV_Chain
  source 1..372: mol_type = other RNA
caggtgcaactggtccagagcggcgccgctctcaagaaacccggggcatccgttagaatctcttgccaggcctacggatataagttcaccgaccaccttatttactggtggaggcaggcgcctggtcaaggcctggagtggatagggtggatcaaaccagaaacaggacagccgtcatatagttacaagtttcagggccgggtgactttgacgcgcgataccttcgaggaaattcattttatggacttacgaggtctgcgttatgatgacacagctacttacttctgtgccagaaggcacagcgattattgcgactttgatgtatgggggtccggatctcaggtgtcggtctcaagcgcaagtaccaaaggc

SEQ ID NO: 27157 - RNA, 372 nt, synthetic construct
  misc_feature 1..372: note = derived and/or modified sequence opt3 from anti-HIV_Chain
  source 1..372: mol_type = other RNA
caggtgcaactggtccagagcggcgccgctctcaagaaacccggggcatcccttagaatctcttgccaggcctacggatataagttcaccgaccacctgatttactggtggaggcaggcgcctggtcaaggcttggagtggatagggtggatcaaaccagaaacaggacagccgtcatatagttacaagtttcagggccgggttagcttaactcgcgatacgttccaggagattctgtttatgaacctacgaggtctccgttccgacgataccgctatctatttctgtgccagaaggcattctgactactgcgattttgacgtgtgggggtcgggatcacaaattctggtaagcagtgcatccacaaaaggc

SEQ ID NO: 27158 - RNA, 372 nt, synthetic construct
  misc_feature 1..372: note = derived and/or modified sequence opt3 from anti-HIV_Chain
  source 1..372: mol_type = other RNA
caggtgcaactggtccagagcggcaccgccgttaagaaacccggggcttccgtgagagtatcttgccaggcatcaggatacacattcactgactattttatctactggtggaggcaggcccctggtcaaggcctcgagtggcttgggtggattaacccacggacgagtcagccgagctatccctaccgcttccagggacgagtgaccctgacacgtgatatatttgaagagatgttgtatatggacttaagaggcctgaggtccgatgacactggtatctacttctgtgcgcggcgccactctgattattgcgactttgatatttgggggtcgggaacccagatcattgtctcaagcgctagtacaaagggc

SEQ ID NO: 27159 - RNA, 372 nt, synthetic construct
  misc_feature 1..372: note = derived and/or modified sequence opt3 from anti-HIV_Chain
  source 1..372: mol_type = other RNA
caggtgcaactggtccagagcggcgccgctctcaagaaacccggggcatcccttagaatctcttgccaggcctacggatataagttcaccgactacctgattcactggtggaggcaggcgcctggtcaaggcttggagtggatagggtggatcaaaccagaaacaggacagccgtcatatagttacaagtttcagggccgggttagcttaactcgcgatacgttcgaggaaattctgtttatggacctacgaggtctccgttccgatgacaccgctatctatttctgtgccagaaggcattctgattactgcgactttgatgtgtggggagggggctcgcaggtactggtgtcaagcgcaagtacaaaaggc

SEQ ID NO: 27160 - RNA, 372 nt, synthetic construct
  misc_feature 1..372: note = derived and/or modified sequence opt3 from anti-HIV_Chain
  source 1..372: mol_type = other RNA
gaggtgcagctgctcgaaagcggcggggcccttgtccaacccggaggttccctgagattgtcttgcgctgcatcaggcttcacctttagtacaagctccatgtcttgggttaggcaggcccctgggaagggattagagtgggtgtcggcgatcggctcaggtcgggggagcactttctacgctgacagtgtaaaaggacgctttacgatttcccgagataactctaagaataccctgagcctacagatgaactccctcacagccgaagacactgcaacctattactgtacaaaaaccggcggcctgcttcgtttcccagaggtgtgggggaagggaactacagtcaccgtgtcaagtgccagcacgaaaggt

SEQ ID NO: 27161 - RNA, 372 nt, synthetic construct
  misc_feature 1..372: note = derived and/or modified sequence opt3 from anti-HIV_Chain
  source 1..372: mol_type = other RNA
gaggtgcagctggtcgaaagcggcgggggactcgttaagcccggtggctcccttagactgtcttgcgccgactcagggttcacctttaggagttacagcatgcactgggtgcggcaagctcctggaaaaggcttggcatgggtatcctctatctcgtcaacaagcaactatatttactatgccgatagtgtgaagggtcgcttcactatatcccgagacaatgcgaaaaactctttatacctgcagatgaatagcctacgtgctgaggatacggccgtctattactgtgcaagaacctttatcacagcctcctggttcgactcatgggggcagggaactctcgtgaccgttagtagcgcttctacaaagggc

SEQ ID NO: 27162 - RNA, 372 nt, synthetic construct
  misc_feature 1..372: note = derived and/or modified sequence opt3 from anti-HIV_Chain
  source 1..372: mol_type = other RNA
caggtgcaactggtccagagcggcgccgaggttaagaaacccggggcttccgtgaaggtatcttgcaaagcatcaggatacaccttcacaaactatggtgtgagttgggtcagacaggcccctggccaggggctcgaatggatgggatggatcagcccatactccggcaatactaactatgcgcaaaggcttcaggaccgggtgacgatgaccacagatacttctaccaatacagcttacatggagctgcgctcgttgcgatcagacgataccgccgtttattactgtgcagcccgtagctattactactatagtatggacgtgtggggtcaggggactacagtcaccgtgtcctctgctagcacgaaggga

SEQ ID NO: 27163 - RNA, 372 nt, synthetic construct
  misc_feature 1..372: note = derived and/or modified sequence opt3 from anti-HIV_Chain
  source 1..372: mol_type = other RNA
caggtgcaactggtccagagcggcgccgagctcaagaaacccgggtcctctgttaaggtgtcatgcaaagctagtggaggtaccttcagcaactacgcaatcaattgggtaagacaggcccctggccaggggtttgaatggatgggaggcattataccacttttcgcgacaccgacttatgctcaaaagtttcagggtagggtgcggatcacggccgacgattccacctctacagcatacatggagctgtcgtcattgcgcagcgacgatactgccgtctatttctgtgctcgacccaacgtggttcgtagtgcattagactactgggggcagggaaccctggtgacagtctcctctgccagcaccaaaggc

SEQ ID NO: 27164 - RNA, 372 nt, synthetic construct
  misc_feature 1..372: note = derived and/or modified sequence opt3 from anti-HIV_Chain
  source 1..372: mol_type = other RNA
caggtgcaactggtcgagagcggcgggggagttgtgcagcccggtaagtccctcagactttcttgcgccgcttcaggcttcacctttagtacacacgcaatgcattgggtaaggcaggcccctgggaaaggactggactgggtggcggtcatcagccacgatggcgacaaccagtactatgctgatgccgtgaagggtcggttcactatttcccgcgacgattctcgagacacggtgtttttgcaaatgaactcgttacgtaccgaagatacaggggtttactattgtgcagccgactcaagcggaagtaattggttcgattactggggccagggcatactggtcactgtgtcctctgctagcaccaaaggg

SEQ ID NO: 27165 - RNA, 375 nt, synthetic construct
  misc_feature 1..375: note = derived and/or modified sequence opt3 from anti-HIV_Chain
  source 1..375: mol_type = other RNA
caggtgagactgagccaatccggcgggcagatgaagaaacccggagagtctatgaggctctcatgccgggccagtggttacgagttccttaactgtcctatcaattggattcgcctggctccaggccgacgtccggaatggatggggtggttgaagcccagaggaggcgcagtcaactatgccaggaaatttcagggtcgggttaccatgacacgcgacgtgtacagcgatactgcgttcttagaactgagatccctaacgtctgacgataccgctgtatatttttgcacaagggggaagtactgtactgcccgggactattacaattgggatttcgagcactggggacgcggcgcacctgtgaccgtctcgtca

SEQ ID NO: 27166 - RNA, 375 nt, synthetic construct
  misc_feature 1..375: note = derived and/or modified sequence opt3 from anti-HIV_Chain
  source 1..375: mol_type = other RNA
gaggtgcagctggtccaaagcggctccgacgttagaaagcccggggccaccgtgacagtatcttgcaaagctgatgaagacgaggatgacttcactgcatacaactattttatgcactgggtgaggcaggcccctggacatggtctcgaatggatcggctggattaatccacggacggggcagccgaaccacgcgaagcagttccaaggacgcgtcacccttacacgagagcgttcaaccagtactgtgtttatgaaactgacaaatttgagattagatgacaccgctgtttacttctgtgccaggcccctgcggggcggtgatacttggcattatcacagctgggggcgcggaacatccctaaccgtgtcttcg

SEQ ID NO: 27167 - RNA, 375 nt, synthetic construct
  misc_feature 1..375: note = derived and/or modified sequence opt3 from anti-HIV_Chain
  source 1..375: mol_type = other RNA
caggtgcaactggtccagagcggcgggggactcgttcagcccggtgagtcccttagactgtcttgcaccgcctcaggcttcacatttagtagctacaacatgaattgggtgaggcaggctcctgggaagggattggaatggatctcctatatttctgacaaatcgaagaacaaatactatgcagattcagtacggggccgcttcactataagccgagacaatgcccaaaacagtttatttctgcagatgtcctctctacgtgatgaggacacggcggtgtactattgtaccagagaaggtccacagaggagcttctactttgattattgggggcagggaatccaagtcacagtgtcctcagctagtactaagggc

SEQ ID NO: 27168 - RNA, 375 nt, synthetic construct
  misc_feature 1..375: note = derived and/or modified sequence opt3 from anti-HIV_Chain
  source 1..375: mol_type = other RNA
gaggtgcagctggtcgaaagcggcgccgaggttaagaaacccgggtcctctgtgaaggtatcatgcaaagctagtggaggtaccttcagctcctactctatctcgtgggtgagacaagcacctggccaggggctcgaatggatgggaggcattataccaatctttgccacaactcactatggtcagaagttccaggggaggattaaaatcacggcggacaagtcaaccagcacagcttacatggagcttagtcggctgcgctccgaagatactgccgtctattactgtgcacgagaccgtgagttttatttctacggaatggatgtgtggggccaaggcaccacagttaccgtgtctagcgcctccactaagggg

SEQ ID NO: 27169 - RNA, 375 nt, synthetic construct
  misc_feature 1..375: note = derived and/or modified sequence opt3 from anti-HIV_Chain
  source 1..375: mol_type = other RNA
cagctgcaactccaggagagcggccccgggcttgtgaagccttgggaaaccctggtcttgacatgctccgtttctggaggttcaatcagtagcggcgactactattgggggtggattagacagtccccaggaaaaggcccggagtggataggtaacatcttctactcttcggggaatacttattacaacacgtcattaaagagcagggtgaccattagtgtagatgtgtccaaaaatcggttttctctgaagctaacaagcatgactgccgctgacaccgcagtctattactgtggacgcctctccaacaaaggctggttcgatccctggggccaggggacactggtgtcagttagtagcgcctctaccaaggga

SEQ ID NO: 27170 - RNA, 375 nt, synthetic construct
  misc_feature 1..375: note = derived and/or modified sequence opt3 from anti-HIV_Chain
  source 1..375: mol_type = other RNA
gagatcgtgctgacccagagccccgccacactctccctttctcctggcgaaagagctactctgtcatgcagggcaagtcaaagcgtctcctcttacttggcctggtatcagcagaagccagggcaggcgccgcggttactgatttacgacgcttcgaaccgcgccacgggaatacccgcacgattctcaggtagcggcagtgataccgactttacactaactatctcctctctcgagcctgaagatttcgccgtttattactgtcaacagcgtgggatttggccactgcagatcacctttggacagggcacaagacttgagattaaaaggaccgtggctgcacccagcgtattcatctttcctccatccgacgaa

SEQ ID NO: 27171 - RNA, 375 nt, synthetic construct
  misc_feature 1..375: note = derived and/or modified sequence opt3 from anti-HIV_Chain
  source 1..375: mol_type = other RNA
agcgagatcgtgctgacccagtcccccggcacactctctctttcacctggggaaagagccactctgagttgcagggctagccaatccgtctcttcgtcatacttggcatggtatcagcagaagccagttcaggccccgcggttactgatttacggagcgagcagtcgcgctacgggtatacccgaccgattctccggctctgggagcggaaccgattttacactaactatctcccgtctcgagcctgaagacttcgccgtgtattactgtcaacagtatggcaccctgcacccaagaacatttggtcaggggaccaaagtagagattaagaggactgtggcagccccctcagtcttcatctttcctccaagtgat

SEQ ID NO: 27172 - RNA, 375 nt, synthetic construct
  misc_feature 1..375: note = derived and/or modified sequence opt3 from anti-HIV_Chain
  source 1..375: mol_type = other RNA
agccaggccgtggtcacccaacccccttccgtttctggcgctccagggcagagagtgacaatctcatgcagtggaggtccgagcaacgtaggcgggaatctggtgtactggtataagcagttccccggaactgcacctaaactccttattaggcgggacgatcagcgcccatccggcgtccccgaccgattttctggttcgaagtcagggaacagcgccagtctggcgatatccggattgcgtcctgatgacgaggctttctacttttgtgccacgtatgattctcacggcagcatcagattattcggcgggggaaccctgctaacagtgctctcccaaccaaaagcagccccctcagttactctgtttcctcca

SEQ ID NO: 27173 - RNA, 375 nt, synthetic construct
  misc_feature 1..375: note = derived and/or modified sequence opt3 from anti-HIV_Chain
  source 1..375: mol_type = other RNA
gacatccagatgacccaaagcccctccacactggccgcttctattggcgggactgtgagagtctcatgcagggcaagtcagagcataacgggaaactgggttgcctggtaccagcagcggcctggtaaggcgccacgcctccttatctatcgaggcgctgccctgttagggggagtgccgtcccgtttctctggctcggcagccggtaccgattttacattgactattgggaatctgcaagctgaggacttcggaaccttttactgtcagcagtatgatacataccccggcaccttcggccaggggactaaagtagaagtgaagagaacagtcgcagccccttcagtgtttatcttcccacccagcgacgagcaa

SEQ ID NO: 27174 - RNA, 375 nt, synthetic construct
  misc_feature 1..375: note = derived and/or modified sequence opt3 from anti-HIV_Chain
  source 1..375: mol_type = other RNA
gagatcgtgatgacccagagccccgacacactgtccgtctctcctggcgaaagagccactctctcatgcagggctagtcaaagcgttaactccaatcttgcatggtaccagcagaagccagggcaggccccgcggctgttgatttatggagcgtctacgcgcgctaccgccgtgcccgcacgattctcgggttcaggcagcgggacagagtttactttaaccataagttccctgcaatctgaagatagcgccgtatactattgtcagcagtactatcagtggctatcctacacattcggacaaggcaccaaactcgagatcaagcgtactgtggctgcaccttcagtctttattttcccacccagtgacgaacag

SEQ ID NO: 27175 - RNA, 375 nt, synthetic construct
  misc_feature 1..375: note = derived and/or modified sequence opt3 from anti-HIV_Chain
  source 1..375: mol_type = other RNA
agacaggtgcaactggtccagagcggcgccgctctcaagaaacccggggcatcccttaggatctcttgccaggcctacggatataagttcaccgaccacctgatttactggtggcggcaggcgcctggtcaaggcttggagtggatagggtggatcaaaccagaaacaggacagccgtcatatagttacaagtttcagggccgcgttagcttaactcgagatacgttccaggagattctgtttatggacctacgtggtctcagatccgatgacaccgctatctatttctgtgccaggcggcattctgattactgcgactttgatgtgtgggggtcgggatcacaaattctggtaagcagtgcatccacaaaaggc

SEQ ID NO: 27176 - RNA, 375 nt, synthetic construct
  misc_feature 1..375: note = derived and/or modified sequence opt3 from anti-HIV_Chain
  source 1..375: mol_type = other RNA
caggtgcaactggtccagagcggcgccgctctcaagaaacccggggcatccgttagaatctcttgccaggcctacggatataagttcaccgactaccttattcactggtggaggcaggcgcctggtcaaggcctggagtggatagggtggatcaaaccagaaacaggacagccgtcatatagttacaagtttcagggccgggtgactttgacgcgcgataccttcgaggaaattttatttatggacctgcgaggtctacgtagcgatgacacagctatctatttctgtgccagaaggcattccgattactgcgactttgatgtatgggggtctggatcacaggtgattgtctcgagcgcaagtactaaaggcgcc

SEQ ID NO: 27177 - RNA, 375 nt, synthetic construct
  misc_feature 1..375: note = derived and/or modified sequence opt3 from anti-HIV_Chain
  source 1..375: mol_type = other RNA
gaggtgcagctggtcgaaagcggcgggggactcgttaagcccggtggctcccttagactgtcttgcgccgcttcagggttcagttttagcgagcactacatgtcctggatcaggttggcacctggaaaaggcttagaatggctgtcttatatttcgtcaagcacccggacaacttacagtgccgactccgtgcgcggtcgattcacgatatctcgtgataccgcgaagcaactactctttctgcatatgagctcccttagagctgaggacacagccgtatattactgtgtgaggctgtatgggggaatcaacggctggttcgatcagtggggccaggggactttggtctcagtgagtagcgcatctaccaaagga

SEQ ID NO: 27178 - RNA, 375 nt, synthetic construct
  misc_feature 1..375: note = derived and/or modified sequence opt3 from anti-HIV_Chain
  source 1..375: mol_type = other RNA
caggtgcaactggtccagagcggccccgggctcgttaagccttccgagaccctttctctgacatgctcagtgagtaacggaagcatctcctctggtggctactattggtcgtggttgagacagttcccagggaaaggattagaatggattggctcaatacactacactggtaggacgttttataatccgagcctgatggggcggaccgccctaagtatggacacatccaacaatcagttctctctcaaggtaagctccgtgactgctgcagataccgccctgtactattgtgcgcgcgagcttcaatggatgtttgtcgtggacccctggggacagggcacactggttaccgtgtcaagtgctagcactaaaggc

SEQ ID NO: 27179 - RNA, 375 nt, synthetic construct
  misc_feature 1..375: note = derived and/or modified sequence opt3 from anti-HIV_Chain
  source 1..375: mol_type = other RNA
caggtgcaactgcaggagagcggccccgggctcgtcaagccttccgaaaccctttctctgacatgctcagttagtaacggaagcatctcctctggtggctactattggtcgtggttgagacagttcccagggaaaggattagagtggattggctcaatacactacactggtaggacgatgtataatccgagcctgatggggcggcccgccctaagtatggacacctccaacaatcagttttctctcaagctgcgcagcgtgacagctgcagatactgccctttacttctgtgcgcgagacctgcaatggatctttgtagtggatccttggggacagggcaccttggtcacagtgtcctcagctagtaccaaaggc

SEQ ID NO: 27180 - RNA, 375 nt, synthetic construct
  misc_feature 1..375: note = derived and/or modified sequence opt3 from anti-HIV_Chain
  source 1..375: mol_type = other RNA
gaggtgcagctgctcgaaagcggcgggggacttgtccaacccggtggctccctgagattgtcttgcgccgtttcagggttcacctttggaggccacgctgtgagttgggtaaggcaggcacctggtaaggggttagagtggctgagccagatctccggaacaggctctcggactgactacgccgatgcggtgaaaggccgcttcacggtctcgcgagacaactcaaagaaaaccgtgtatctacagatgaatagcctccgtgttgaagatacagctctgttttactgtgccactagaagtccagggggaggttatgcattcgacatttggggccaaggggccatggtgaccgtctcctctgctagcacaaaggga

SEQ ID NO: 27181 - RNA, 375 nt, synthetic construct
  misc_feature 1..375: note = derived and/or modified sequence opt3 from anti-HIV_Chain
  source 1..375: mol_type = other RNA
caggtgcaactggtccagagcggcgccgaggttaagaaacccgggtcctctgtgaaggtatcatgcaaagtgagtttctttagcaactacggaatctcctgggtcagacagaggcctggtcagggcctcgaatggatggggcggattataccagctatcgacgatatgacctatgcacaaacattccgcggacgagtgactttttctgccgacaagttcacgaccacagcgtacatggagcttactggcctgacctttgaagatacagctacctatttctgtgcccgtgacccgcaggttaatagaaggggtaactgctttgatcactgggggcagggaactttggtgacagtctcgtcagcaagcaccaaaggc

SEQ ID NO: 27182 - RNA, 375 nt, synthetic construct
  misc_feature 1..375: note = derived and/or modified sequence opt3 from anti-HIV_Chain
  source 1..375: mol_type = other RNA
caggtgcaactgcaggagagcggccccgggctcgtcaagccttccgaaaccctttctctgacatgcactgtttcaggaggtagtatcagctactattactggtcctggattagacagccaccgggcaaagggttggagtggataggagacatctattactctggcacgaccgattataacccctcgttaaagtcaagggtgacaattagcgtagacaccagtaaaaatcagttctccctgaagctatctagcgtgactgccgctgatacagcagtctactattgtgcccggcgccgaggtcaacgtctcctggcgtactttgactactgggggcagggatcccttgtgaccgtttcaagtgctagcactaaaggc

SEQ ID NO: 27183 - RNA, 375 nt, synthetic construct
  misc_feature 1..375: note = derived and/or modified sequence opt3 from anti-HIV_Chain
  source 1..375: mol_type = other RNA
caggtgcaactgcaggagagcggccccgggcctgtcaagccatccgaaaccctctctcttacatgcactgtttcaggaggtagtatgatcagctactattggtcctggattagacagccgcccggcaaagggctggagtggataggatacatcttcacgaacggcaggaccacatattctccttcgttgcggtcacgcgtgactattagcttagacaccagtacaaatcacttttccctgcgactaaagtctgtaaccgccgctgatactgcaatctactattgtgcccgtctcgacggtgaagcgttcagatactatctggatctttgggggcagggaaacctggtgacagtcagctccgcttcaaccaaaggc

SEQ ID NO: 27184 - RNA, 375 nt, synthetic construct
  misc_feature 1..375: note = derived and/or modified sequence opt3 from anti-HIV_Chain
  source 1..375: mol_type = other RNA
caggtgcaactggtccagagcggcgccgaggttaagaaacccggggcttccgtgaaggtatcttgcaaaccttcaagtaacaccttcacaagccactacatccattgggtgagacaggcaccaggacagggtctcgaatggatgggcatgattaatcccgggggatccactaggtatgccccgaagtttcaaggccgggtcacgcttacccgcgacacatctactcgaaccgtgtacatggagctgtcgtcattgcgtagcgaagatacagcggtttattactgtgctagacctcagtataacttaggtagggacccactggatgtgtgggggctaggaaccatggtcactgtgagttccgcctctacaaaaggc

SEQ ID NO: 27185 - RNA, 375 nt, synthetic construct
  misc_feature 1..375: note = derived and/or modified sequence opt3 from anti-HIV_Chain
  source 1..375: mol_type = other RNA
caggtgcaactgcagcagtggggcgccgggctccttaagcccagcgagaccctgtccttgacatgcgctgtctacggaggttctttctcaggctattactggagttggatcagacagcctccagggaaaggattagaatggattggcgagataaaccacagcggttccactaattataacccgtctctgaagtcgagggttacgatctcagtggacaccagcaaaaatcaatttagtctaaagctctcctctgtaacagcagccgatactgcggtgtactattgtgctcggctgcccattgggagcggatggtacggccgcgactattggggccaggggacccttgtcacagtgtcctcagccagtaccaaagga

SEQ ID NO: 27186 - RNA, 375 nt, synthetic construct
  misc_feature 1..375: note = derived and/or modified sequence opt3 from anti-HIV_Chain
  source 1..375: mol_type = other RNA
caggtgcaactggtccagagcggcgccgaggttaagaaacccggggcttccgtgaaggtatcttgcaaagcatcaggaaacaccttcacaagttacggtatcacttgggtgagacaggcccctggccaggggctcgaatggatgggatggattagcgcgtataatggcaacacgaattacgctcaaaaacttcaggacaggctgaccatgacaactgatacctccacatctaccgcctatatggagttgcggtcgttacgctcagacgatactgcagtctactattgtgcctttagccgacactacggtagtgggaactatgactactggggacagggcacactggtgaccgtttcctctgctagcacgaagggc

SEQ ID NO: 27187 - RNA, 375 nt, synthetic construct
  misc_feature 1..375: note = derived and/or modified sequence opt3 from anti-HIV_Chain
  source 1..375: mol_type = other RNA
cagttcagactggtgcaaagcggccccgaggtcaagaaccctgggtcctctgttaccgtgtcatgcaaagccagtggaggtacatttagcggcctcgggatcaattgggtaaggcaggctccaggacagggccttgaatggctgggtgacattaagactatgtacgggacgaccaactatgcaccgaaattccagggacgggtgacaataactgccgatgagtccacctctacatcgtacatggaattgtcaggcttacgcagcgaggacaccgcggtcttttattgtgtgcgagaactgttcggccaccatcccgcttttggggtttggggacaaggtacaagtgtgatcgtctcctctgccagcactaagggc

SEQ ID NO: 27188 - RNA, 375 nt, synthetic construct
  misc_feature 1..375: note = derived and/or modified sequence opt3 from anti-HIV_Chain
  source 1..375: mol_type = other RNA
agagtgcagctggtccaaagcggcgccgaggttaagaaacccgggtcctctgtgaccgtatcatgcaaggctagtggaggtagcttctcctcttacgcaatctcgtgggtgaggcaggcccctggccaggggctcgaatgggtcggaggcgtgaaagttatgtttggtacagtgcactattcacagaaggtccaagggcgggtgactattacggcggacgatagcaccggaacaagttaccttgagctgtccggcttgcgctctgctgacactgccgtatattactgtgcacgaaacgccggcgcttatttctacccatttgatatatgggggcagggaaccttaatcattgttagctccgcatcaacaaaaggt

SEQ ID NO: 27189 - RNA, 375 nt, synthetic construct
  misc_feature 1..375: note = derived and/or modified sequence opt3 from anti-HIV_Chain
  source 1..375: mol_type = other RNA
caggtgcaactgcaggagagcggccccgggctcgtcaagccttccgaaaccctttctctgacatgcactgtttcaggaggtagtatcagctccagatcttactattggggctggattaggcagccaccggggaaaggattggagtgggtgggctcgatatactatacgggttcaacctactatagccccagtttaaagtcccgggtaacaatctctgtggacactagccagaaccaattctccctgaaactaaattcagtcaccgccgctgatacagcagtgtactattgtgcccgccagaaggggagtggaaccagcctcctgtactggggccagggcactcttgttacagtgtcttccgcgtcaaccaaaggg

SEQ ID NO: 27190 - RNA, 375 nt, synthetic construct
  misc_feature 1..375: note = derived and/or modified sequence opt3 from anti-HIV_Chain
  source 1..375: mol_type = other RNA
caggtgcaactggtccagagcggcaccgaggttaagaaacccgggtcctctgtgaaggtatcatgcaaagccagtggaggtacattcagcgactccgatatcgcttgggtgagacaggcacctggccaggggctcgaatggatgggaggcattactccaatgtttgacatggccaagtctgcgcaaaaattcaggggtcggcttataatcacggctgataagtcgaccgggacagcctacatggagctgagctcattgcgctatgaagacgcagccgtctacttttgtgctcgaagttccggaaacttcgagtttgcattcgaaatttggggccagggcactaagatcattgtgtctttagccagcaccaaaggg

SEQ ID NO: 27191 - RNA, 375 nt, synthetic construct
  misc_feature 1..375: note = derived and/or modified sequence opt3 from anti-HIV_Chain
  source 1..375: mol_type = other RNA
gtggtccagctggttcaaagcggcaccgaggtgaagaaacccgggtcctctgtaaaggtgtcatgcaaagccagtggaggtacattcagcggctccgacatctcttgggtcagacaggctcctgggcagggactcgaatggatgggcggtattataccaatgtttgatatcgaggaccacgcacagaagttcagggggcggcttactattacggccgataaatcgaccggagcggcttacatggaactgagctcattgcgcagtgaggacgccgcagtgtattactgtgcccgatcctctggcaactatgattttgctttcgacatctggggccaagggacacgtttaattgttagctccgcatcaactaaggga

SEQ ID NO: 27192 - RNA, 375 nt, synthetic construct
  misc_feature 1..375: note = derived and/or modified sequence opt3 from anti-HIV_Chain
  source 1..375: mol_type = other RNA
gtggtccagctggttgagagcggcaccgaagtgaagaaacccgggtcctctgtaaaggtgtcatgcaaagccagtggaggtacattcagcggctccgacatctcttgggtcagacaagctcctgggcagggactcgagtggatgggcggtattataccaatgtttgatatcgaaaaccacgcagagaagttcagggggcggcttactattacggccgtgaaatcgaccggagcggcttacatggaactgagctcattgcgcagtgaggacgccgcagtttattactgtgcccgatcctctggcaattatgattttgcttacgacatctggggccaggggacacgtgtgattgtcagctccgcatcaactaaggga

SEQ ID NO: 27193 - RNA, 378 nt, synthetic construct
  misc_feature 1..378: note = derived and/or modified sequence opt3 from anti-HIV_Chain
  source 1..378: mol_type = other RNA
caggtgcaactggtccagagcggctccgccatgaagaaacccggggcttctgttagagtgtcatgctggaccagtgaggacatcttcgatacaactgaactcattcactgggtaaggcaggcacctggacagggtcttgagtggataggctgggtgaaggccgtcagcggggcggtgaactacggatccctggactttcggcatcgcgtttctttgacgcgagatcgtgacttatcgaccgctcacatggatatcagaggcctgacacaagacgatactgccacctatttctgtgcaaggcagaaatttgcccggggtgaccaggggtggttctttgatctatggggacgcggcacactcattgtggtctcaagcgct

SEQ ID NO: 27194 - RNA, 378 nt, synthetic construct
  misc_feature 1..378: note = derived and/or modified sequence opt3 from anti-HIV_Chain
  source 1..378: mol_type = other RNA
caggtgcaactgcaggagagcggccccgggctcgtcaagccttccgaaaccctttctctgacatgcactgtttcaggaggtagtatcagcaaccactactggtcctggattagacagccaccgggcaaagggttggagtggataggatatatctaccattctggcaatattaactataagtcgtcattaaaaagcagggccacgatcagtattgacacctccaataaccagttctctctgaagctaagctccgtgatcgctgcagatacagccgtatactattgtgcgcggaattttggtcccgggtcacctaactacggaatggacgtgtggggccaaggcactaccgtcacagtgagtagcgcttctaccaaaggg

SEQ ID NO: 27195 - RNA, 378 nt, synthetic construct
  misc_feature 1..378: note = derived and/or modified sequence opt3 from anti-HIV_Chain
  source 1..378: mol_type = other RNA
caggtgcaactggtccagagcggcgggggagttgtgcagcccggtagatccctcaggctttcttgcgccgcttcaggcttcacctttagtcaccatgggatccactgggtacggcaggcacctggagagggcctggaatgggtggccgtcattagcgaggacggtacaaatatacattacgaagattccgtgcgcgggcgattcactatctctcgtgacaattcgaagaacacggttgatttgcaaatgaactcattaagagcggaggacaccgctgtgtattactgtgccagcctgattagtatgagggatggagacgcatttgatctatggggccagggcacacgggtcactgtgtcctctgccagcaccaaaggg

SEQ ID NO: 27196 - RNA, 378 nt, synthetic construct
  misc_feature 1..378: note = derived and/or modified sequence opt3 from anti-HIV_Chain
  source 1..378: mol_type = other RNA
caggtgcaactggtcgagagcggcgggggactcggtcagcccggcgggtcccttagactgtcttgcgccgcttcaggattcacctttaggaactacgcaatgagttgggttcggcaggccgcgggcaagggtttggaatgggtgagcggggtatccggaggcggcgacacaacttattacggggattctgtgaaaggacgcttcacgatctcgcgagacaattcaaagaacaccttatatctgcagatgaataacctacgtgctgaggatacagccgtctactattgtgcaaaagacaagggtgtgtggggcagcagtgattttgactactgggggcaaggaactctcgttaccgtgtcctctgccagcacaaaaggc

SEQ ID NO: 27197 - RNA, 378 nt, synthetic construct
  misc_feature 1..378: note = derived and/or modified sequence opt3 from anti-HIV_Chain
  source 1..378: mol_type = other RNA
gaggtgcagctggtcgaaagcggcgggggagttgtgcaacccggtagatccctcaggctttcttgcgccgcttcaggcttcacctttagtcaccatgggatccactgggtacggcaggcacctggagagggcctggaatgggtggccgtcattagcgaggacggtacaaatatacattacgaagattccgtgcgcgggcgattcactatctctcgtgacaattcgaagaacacggttgatttgcagatgaactcattaagagcggaggacaccgctgtgtattactgtgccagcctgattagtatgagggatggagacgcatttgatctatggggccagggcacacgggtcactgtgtcctctgccagcaccaaaggg

SEQ ID NO: 27198 - RNA, 378 nt, synthetic construct
  misc_feature 1..378: note = derived and/or modified sequence opt3 from anti-HIV_Chain
  source 1..378: mol_type = other RNA
agaggccccgtgaccctggccgtcagcctcggggagagggctacaatcacttgcaagtcctctcagtcagttcttgtgcacagtaacaataaaaactacctgagctggtatcaacagaagcctggacagccaccgaaattgttaatttactgggcatccacgcgggaatctggtgtacccgagcgcttctcgggctcagggagcggaaccgactttacactgagtatatcctctctacaggccgaagatgtggcggtctattactgtcatcaatatttcagcactcctcgaacctttggccagggtacaaaggtggagatcaaagggaccgttgctgccccatccgtgttcatttttcccccttcagacgaacagctc

SEQ ID NO: 27199 - RNA, 378 nt, synthetic construct
  misc_feature 1..378: note = derived and/or modified sequence opt3 from anti-HIV_Chain
  source 1..378: mol_type = other RNA
agcgagatcgtgatgacccagtcccccgccacactgtctatgtcacctggcgaaagagctactctcagttgcagggcaagcctttccgtcaacacgaatctggcctggtaccaacagaagccagggcaggcgccgcggttgttaatttatggagcttctacccgcgccacaggtatacccgcacgattctcgggctcagggagcggaactgagtttaccctgacaatcagttccctacagtctgaagacttcgccctctactattgtcaacagtacaaccactggcctcagacctttggccagggtactaaagttgagattaagcgtacagtggctgcaccaagcgtattcatctttcccccttccgatgaacaaaaa

SEQ ID NO: 27200 - RNA, 378 nt, synthetic construct
  misc_feature 1..378: note = derived and/or modified sequence opt3 from anti-HIV_Chain
  source 1..378: mol_type = other RNA
agcgagatcgtgctgacccagtcccccgccacactctctctttcacctggcgaaagagctactctgagttgcagggcaagccaatccattaacaattacttggcctggtatcagcagaagccagggcaggcgccgcggttactgatatacgacgcttctaaccgcgccacgggaatccccgcacgattctcgggtggcgggtcaggaaccgattttacactaactattagcagtctcgagcctgaagacttcgccgtctattactgtcaacagcgtgctaattggagactgcttacctttggcggtgggacaaaagttgagatcaagaggaccgtggcagccccatccgtattcatttttcccccttctgatgaacag

SEQ ID NO: 27201 - RNA, 378 nt, synthetic construct
  misc_feature 1..378: note = derived and/or modified sequence opt3 from anti-HIV_Chain
  source 1..378: mol_type = other RNA
caggtgcaactggtccagagcggcggggccgttaagaaacccggagcttccgtgaaggtatcttgcgagacctacggttatacattcactgaccactttatgcattggtggagacaggcacctggccaggggctcgaatggatgggatggatcaacccatactcaagtgccgtgagctattccccgaggtaccaaggccgggtcacgatgacccgcgatacattccttgagactgtgtatatggaactgcgaggtttgaaatttgacgataccgcgatttactattgtgctacacccaagtctgggcgtgactactggtcgttcgatttatggggacagggcaccctggttactgtgtcaagcgccagtacaaaaggc

SEQ ID NO: 27202 - RNA, 378 nt, synthetic construct
  misc_feature 1..378: note = derived and/or modified sequence opt3 from anti-HIV_Chain
  source 1..378: mol_type = other RNA
agccaggtgcaactggtcgagtccggccccgggctcgttaagccttctgaaaccctttcactgacatgcagtgtgagcaacggatccatctcttcgggtggctactattggtcatggttgagacagttcccagggaaaggattagagtggattggcagcatacactacactggtaggacgatgtataatccgagtctgatggggcggcccgccctatccatggacacctctaacaatcagtttagcctcaagctgtcctcagtaacagctgcagatactgccctttacttctgtgcgcgcgacctgcagtggatctttgtggtcgatccttggggacaaggcaccttggtgacagttagtagcgcttctaccaaaggc

SEQ ID NO: 27203 - RNA, 378 nt, synthetic construct
  misc_feature 1..378: note = derived and/or modified sequence opt3 from anti-HIV_Chain
  source 1..378: mol_type = other RNA
agcgtggtccagctggttgagtccggccccgggctcgtgaagccttctgaaaccctttcactgacatgcagtgtaagcaacggatccatctcttcgggtggctactattggtcatggttgagacaattcccagggaaaggattagagtggattggcagcatacactacactggtaggacgatgtataatccgagtctgatggggcggcccgccctatccatggacacctctaacaatcagtttagcctcaagctgcgctccgtgacagctgcagatactgccctttacttctgtgcgcgagacctgcagtggatctttgtcgtggatccttggggacagggcaccttggttacagtgtcaagtgctagcaccaaaggc

SEQ ID NO: 27204 - RNA, 378 nt, synthetic construct
  misc_feature 1..378: note = derived and/or modified sequence opt3 from anti-HIV_Chain
  source 1..378: mol_type = other RNA
agcggcgggagactggtgcagcccggaggttccctcaggctttcttgctcagccagtggcttcaccctgagcaactccgctatgtcttgggtccggcaagcacctgggaagggattggagtgggtttcgtcaatcttaagcagtggcgtgggtacattttacgccgactccgtaaaagggcgcttcactgtgtctcgagataatagccgtaacacgctgtatctacagatgaagtccctcagagcggaagacaccgctctgtactattgtgccaaagtccagattcagcaacttaattttggagtgataacagatgcaggcctggacgtttggggcaaggggactaccttgatcgtgtcaagtgccagcacaaaagga

SEQ ID NO: 27205 - RNA, 378 nt, synthetic construct
  misc_feature 1..378: note = derived and/or modified sequence opt3 from anti-HIV_Chain
  source 1..378: mol_type = other RNA
caggtgcaactggtccagagcggcgccgctgttaagaaacccggggcatccgtgaaggtatcttgcgaggcctacggatataaattcaccgaccactttatgcattggtggagacaggcgcctggtcagggcctcgaatggatggggtggatcaacccatacacatcagctgtgaattatagtccgaagtaccaaggaagggtcactatgacgcgggataccttccttgagacagtgtatatggaactgcgcggcttgcgagttgacgatactgccatttactattgtgcaacccccaaaagcggtcgtgactactggtcctttgatttatgggggcagggaacactggtgaccgtctcttcggcctcaactaagggc

SEQ ID NO: 27206 - RNA, 378 nt, synthetic construct
  misc_feature 1..378: note = derived and/or modified sequence opt3 from anti-HIV_Chain
  source 1..378: mol_type = other RNA
caggtgcaactggtccagagcggcgccgctgttaagaaacccggggcatccgtgaaggtatcttgcgagacctacggatataaattcacagaccactttatgcattggtggagacaggcccctggtcagggcctcgaatggatggggtggatcaacccatactcaagtgcggtgagctattccccgaggtaccaaggacgggtcactatgacgcgcgataccttccttgagacagtgtatatggaactgcgaggcttgcgttttgacgatactgctatttactattgtgccacccccaagtctggtagagactactggtcgttcgatttatgggggcagggaacactggttaccgtgtcaagcgcaagtactaaaggc

SEQ ID NO: 27207 - RNA, 378 nt, synthetic construct
  misc_feature 1..378: note = derived and/or modified sequence opt3 from anti-HIV_Chain
  source 1..378: mol_type = other RNA
caggtgcaactggtccagagcggcgccgctgttaagaaacccggggcatccgtgaaggtatcttgcgagacctacggatatacattcactgaccactttatgcattggtggagacaggcccctggtcagggcctcgaatggatggggtggatcaacccatactcaagtgcggtgagctattccccgaggtaccaaggacgggtcacgatgacccgcgatacattccttgagactgtgtatatggaactgcgaggcttgaaatttgacgataccgctatttactattgtgccacacccaagtctggtcgtgactactggtcgttcgatttatgggggcagggaaccctggttactgtgtcaagcgcaagtacaaaaggc

SEQ ID NO: 27208 - RNA, 378 nt, synthetic construct
  misc_feature 1..378: note = derived and/or modified sequence opt3 from anti-HIV_Chain
  source 1..378: mol_type = other RNA
caggtgcaactggtccagagcggcgccgaggttaagaaacccgggtcctctgtgaaggtatcatgcaaaaccagtggagtgagattcagctccaacgctatctcttgggtcaggcaggcacctggtcagggcctcgaatggatggggcggacaactccaatgcttggaggcgccaatcacgcgccgtcgtttaagggtcgcgtgacgatttcagctgacgagagcacccgaacagtttacatggaaatgagttccctgcgttatgaggatactgccgtgtactattgtgcatctgggagaagggaaggattgaacttcttactggactactggggccaaggcaccctagtcacagtgagctccgcctcaaccaaaggg

SEQ ID NO: 27209 - RNA, 378 nt, synthetic construct
  misc_feature 1..378: note = derived and/or modified sequence opt3 from anti-HIV_Chain
  source 1..378: mol_type = other RNA
caggtgcaactgcaggagagcggccccgggctcgtcaagccttccgaaaccctttctctgacatgcactgtttcaggaggtagtatcagcacgtactattggtcctggattagacagccaccgggcaaagggttggagtggataggatacatctcttattcgggctcaaccaactacaatcccagcttaaagagtagggtgacaatttccgtagacacttctaaaaaccagttcagcctgaagctatcctcagtgaccgccgctgatacagcagtctattactgtgcccggcacaaaagtgtgctcctgtggtttcgcgaacttgactattggggtcaagggaccctggttactgtgagctctgcgtccacaaaggga

SEQ ID NO: 27210 - RNA, 378 nt, synthetic construct
  misc_feature 1..378: note = derived and/or modified sequence opt3 from anti-HIV_Chain
  source 1..378: mol_type = other RNA
caggtgcaactggtccagagcggcgccgaggttaagaaacccggggctgcagtgaagatctcctgcaaagcctctagattcaccttttcaagttactatattcactgggtaaggcaggcgcctggacagggtctcgaatggatgggcataatcaacccaagcgggggatccacatctaatgctcaaaagttccaggaccgggtgactcttacgcgcgatatgtcgaccggcacagtctacatggagctgtcacgattgactagcgaagacaccgccgtgtattactgtgcaacaccggagcccagttccattgttgcccctttatattactggggtcaggggaccctggtgactgtctctagcgcttccacaaaagga

SEQ ID NO: 27211 - RNA, 378 nt, synthetic construct
  misc_feature 1..378: note = derived and/or modified sequence opt3 from anti-HIV_Chain
  source 1..378: mol_type = other RNA
caggtgcaactggtccagagcggcgccgagatgaagaaacccggggcttccgttaaggtgtcttgcaaagcatcaggacacaccttcacaaactactatatgcattgggtaagacaggcccctggtcagggcctcgaatggatggggatgatcaatccaactggagacagtacgaggtacgcgcaacggtttcagggccgcgtgaccatgacacgagatactagcacccgtacagtctatatggagctttcctctctgagatcggacgataccgctgtgtactattgtgccagggcacaccatgacttctggcgggccccggttgatgtgtggggtaaggggactacagtcaccgtgtcaagcgctagtacgaaagga

SEQ ID NO: 27212 - RNA, 378 nt, synthetic construct
  misc_feature 1..378: note = derived and/or modified sequence opt3 from anti-HIV_Chain
  source 1..378: mol_type = other RNA
caggtggtcctgatccaaagcggcgccgaggttaagagacccgggtcctctgtgaaagtatcatgcaaggctagtggaggtagcttccctattacctgggtgaggcaggcaccaggccacgggctcgaatggatgggaggcataaacccgtttttcggtacaactaattacgcccagaaatttcaggggcgggtctccatcacggcggacgagtctacctcgacaacttatcttcatctgtcagatttgcgcagcgaagacaccgctgtgtacttctgtgcccgagagaaccgtgaaaagtggttagttctgagaagttggtttgcaccctggggacaaggcaccctagtgacagtctcctctgccagcactaaaggc

SEQ ID NO: 27213 - RNA, 378 nt, synthetic construct
  misc_feature 1..378: note = derived and/or modified sequence opt3 from anti-HIV_Chain
  source 1..378: mol_type = other RNA
agccagcaactggtgcagtccggcgcccaggtcaagaaacccggggcttctgttagagtgtcatgccaggcaagtggatacaccttcacaaaccactttctccattggtggaggcaagcccctcggcagggtcttgagtggatgggctggatcaatccagtacacgggggacgcaactatgcgcgacgtttccagggcagaattaattttggtagggacgtgtaccaggaaactgcttatatggagctgagcgggttgcggaacgatgacacggccacctacttctgtgcacgcggaggcggcgatgggagaaattggcatttacacccgtggggacaaggtacactggtcatagtgtccgccgcttctactaagggc

SEQ ID NO: 27214 - RNA, 378 nt, synthetic construct
  misc_feature 1..378: note = derived and/or modified sequence opt3 from anti-HIV_Chain
  source 1..378: mol_type = other RNA
gaggtgcaggtcgttgaaagcggcgggggactggtgcaacccggtggctccctcagactttcttgcgtagcctcagggttcacctttagtgagtactggatgagctgggtgaggcaggctcctggaaagggcctggaatgggtcgcaacaatcaaacgggacggttccgaggaatcttatgtggattcggttaaggggcgcttcactatttcacgagacaacgccaaaaatagcttgtacttacagatgaacagtctgcgtgcggaggatacggctgtgtattactgtgccagagtcagggacccaaattataacctacactttgattcctggggacagggcaccctcgtgacagtatctagcgcatccactaagggc

SEQ ID NO: 27215 - RNA, 378 nt, synthetic construct
  misc_feature 1..378: note = derived and/or modified sequence opt3 from anti-HIV_Chain
  source 1..378: mol_type = other RNA
ctggtgcagctcgtcgagagcggcgggggagttgtgcaacccggtaagtcccttagactgtcttgcgccacctcaggcttcacatttagtacttacgggatgcactgggtaaggcaggctcctggaaaaggcttggaatgggtggcagtcatctggtatgacggtagctacaagtattacgccgattccgtgaaagggcggttcacgatttctcgcgacaactcgaagaataccttatttctgcagatgaactcactacgagcggaggatacagctatgtattactgtggacgtgaaatggccgttggcggcactaaagcactcgaccattgggggcagggaaccctggtgacagtcagcagtgcctccaccaagggt

SEQ ID NO: 27216 - RNA, 378 nt, synthetic construct
  misc_feature 1..378: note = derived and/or modified sequence opt3 from anti-HIV_Chain
  source 1..378: mol_type = other RNA
gagttccagctggtgcaaagcggcgggggactcgtcaagcccggtggctcccttagactgtcttgcaccgggtcaacatttagtttcagctccgacgatatgaactgggttaggcaggcccctggaaaaggcttggaatgggtgtcttcgatgtcagacagcggtagtcacatctactatgctgattttgtaaaggggcggttcactatttcccgcgacaatgccaaaaagtctttatacctgcagatgaacagcctacgagcagaggatacggcggtgtattactgtgctcagtcccgtccaccgcaaagactctatggaatggacgtctggggccagggcaccacagtgactgtttcaagtgccagcaccaaaggg

SEQ ID NO: 27217 - RNA, 381 nt, synthetic construct
  misc_feature 1..381: note = derived and/or modified sequence opt3 from anti-HIV_Chain
  source 1..381: mol_type = other RNA
gaggtgcagctggtcgaaagcggcgggggagttgtgcaacccggtggctccctcagactttcttgcgccgcttcagggttcatgtttaagaactacgcaatgcactgggtaaggcagcctccaggaaaaggcctggagtgggtggccgtcatctggtatggtgggcgggaccagaattacgcggatagtgtgaagggacgcttcaccattagccgagacgattccgacaacacattgtatttacagatgaactctctgcgtgctggcgatactgccgtttacttttgtgcaagaaattcgcaagtgggcaggctaatgccggccgctggggtctggggacagggtacgctcgtgaccgtatcaagcgcaagtacaaaaggc

SEQ ID NO: 27218 - RNA, 381 nt, synthetic construct
  misc_feature 1..381: note = derived and/or modified sequence opt3 from anti-HIV_Chain
  source 1..381: mol_type = other RNA
cagggccacctggtgcaaagcgggggaggtgtcaagaaactcggcacctccgttacaatctcttgccttgcctcagagtacactttcaacgaatttgtgattcattggataagacaggctcccgggcagggacctctgtggttgggcttaatcaagaggagtggtcggctgatgacgagctatcagttccaagaccgcctatccctccgacgtgatagatctaccgggacagtatttatggagctgaggggacttcgggtggacgatactgcagtctactattgtgcccgcgacggcctgggcgaagtggcgccagcttacttgtatgggattgatgcctggggacagggtaccacagttatcgtgacctcggcatcaact

SEQ ID NO: 27219 - RNA, 381 nt, synthetic construct
  misc_feature 1..381: note = derived and/or modified sequence opt3 from anti-HIV_Chain
  source 1..381: mol_type = other RNA
caggtgcaactgctcgagagcggcgggggacttgtccagagaggtggctccctgaggttgtcttgcaccgcctcagggttcgtttttaacaattactggatgacatgggtgcggcaggctcccggaaacggcttagaatgggtagcaaatatcgaccaggatggtagtgagaagcactatctggacagcgtgaaagggcgcttcactatttcccgagataacgccaaaaattctctatacctccaaatgaactcgctgcgtgcggaagacacggctatatattactgtgccagagtcaggtttaaggtgaccgcatggcatcggttcgattcatggggacagggcgaccttgttacagtgagcagtacttccaccaagggc

SEQ ID NO: 27220 - RNA, 381 nt, synthetic construct
  misc_feature 1..381: note = derived and/or modified sequence opt3 from anti-HIV_Chain
  source 1..381: mol_type = other RNA
cagagcgccctgacccaacccccttccgcttctggcacaccagggcagagagtgactatctcatgcagtggaagctaccacaacattggttccaatgcagtcaactggtatcagcagctcccgggcacggcccccaaacttctgatatactctaatgaccaaaggccttcgggggttccagatcggttctcaggaagcaagagtggcacctccgcgtctttggctatcagcggtttacagtccgaggacgaagccgattattactgtgcagcctgggacgattcactgcatgtgtttgggacaggaactaaggtaaccgtgctaggccagcccaaagctaaccctacagtcaccctcttcccacccagtagcgaggaactg

SEQ ID NO: 27221 - RNA, 381 nt, synthetic construct
  misc_feature 1..381: note = derived and/or modified sequence opt3 from anti-HIV_Chain
  source 1..381: mol_type = other RNA
cagagcgtgctgacccaagtcctctccgtttctggcacacccgggcagagagtgatcatttcatgcagtggaactagctccaacgtaggtggcaatcttgtgtcttggtaccagcatctgcctggggccgctccaaggttgttaatacaccgggacgatcagcgcccgtcgggagtccccgaccgattctcaggcagcaagagtggtaactccgcatctctggtgatcagcgggctacgttccgatgacgaggccgattatttttgtgcggcttacgactcaacgttcagtctccctgtttttggaggcggcaccagactgacagtgcttagccaaccaaaagccgcaccctctgtcactctgttccctccatcctcagaa

SEQ ID NO: 27222 - RNA, 381 nt, synthetic construct
  misc_feature 1..381: note = derived and/or modified sequence opt3 from anti-HIV_Chain
  source 1..381: mol_type = other RNA
caggtgcaactgctccagagcggcgccgctgtcaccaagcccggggcatccgttagagtgtcttgcgaggcctcaggatacaacatcagggactatttcattcactggtggcggcaggcgcctggtcagggccttcaatgggtagggtggataaatccaaaaacaggacagccgaacaatccctgtcagtttcagggccgcgtgagtctgactcgacatgctagctgggatttcgacacgttttccttctacatggatttgaaggccttacgttctgacgataccgcagtctatttttgcgccagacaaaggtcggactactgggatttcgacgtgtggggttcagggacacaggttactgtgagcagtgcttccaccaaa

SEQ ID NO: 27223 - RNA, 381 nt, synthetic construct
  misc_feature 1..381: note = derived and/or modified sequence opt3 from anti-HIV_Chain
  source 1..381: mol_type = other RNA
caggtgcaactggtccagagcggcggggaggttagaaagcccggatcctctgtgaaagtaccttgcaagatctcaggtaacgccttcagtaattacggcgtgaactgggtcaggcaggctccagggcagggactcgaatgggtgggccggattataccggttatcggtgtggcacaacacgcccccaaatttcaggggcgcgtcaccattacagcggacaagagcactacgaccgcttatcttgagctgtcctctttgcgatcggatgacacagccgtgtacttctgtgcaaaagatcatggagaccctcgtactggctattactttgattattggggccagggggccttagtaaccgtttcaagcgctagtacaaaggga

SEQ ID NO: 27224 - RNA, 381 nt, synthetic construct
  misc_feature 1..381: note = derived and/or modified sequence opt3 from anti-HIV_Chain
  source 1..381: mol_type = other RNA
caggtgcaactgggccagagcgggaccgaggtcaagaaacccggattctccgttaaggtgtcttgcaaagcctcaggtggcagtagcacagcttacgggtattcctgggtaagacaggcacctggacagggctttgaatggatgggtaggatcattccattctacgggataatcacttatgccccgaagtttcaaggacgggtgacgattaccgcggaccgctctacatcgactgtctacatggagctcacctcacttacattcgctgataccgccctgtttttctgtgcacgagactttggcgatccccgtaacggctattacttcgacagctgggatcaggggttgtggttaactgtgagttccgcctctacaaaagga

SEQ ID NO: 27225 - RNA, 381 nt, synthetic construct
  misc_feature 1..381: note = derived and/or modified sequence opt3 from anti-HIV_Chain
  source 1..381: mol_type = other RNA
caggtgcaactggtccagagcggcgccgaggttaagaaacccgggtcctctgtgaaggtatcatgcaaagctagtggaggtaccttcagcaactacgcaatctcctgggtgagacaggcccctggccaggggctcgaatggatgggaggcattataccaatctttgaggcggcttcttatgcccaaaagttccaggacaggcttacaattactacggatgaatcgaccacaactgcatacatggacctgagctcattgcggagtgaggataccgccatctattactgtgctcgcgcacagggtgacattttaacagaagggtattttgattactggggacagggcaccctggtcactgtgtcctctgccagcacaaaaggc

SEQ ID NO: 27226 - RNA, 381 nt, synthetic construct
  misc_feature 1..381: note = derived and/or modified sequence opt3 from anti-HIV_Chain
  source 1..381: mol_type = other RNA
caggtgcaactgcaggagagcggccccgggctcgtcaagccttccgaaaccctttctctgacatgcactgtttcaggaggtagtatcagctccgccggctactattggtcttggattagacagcacccagagaaagggttggagttcataggatacatctattacttaggcacgacctattacaacccgtcgctgaagtcaagggtgagcattagtatcgacacatccaataaccagttttctctagaactcagctccgtatcagctgcagatactgccatttattactgtgcgcgggactacaccgctagtggtcgccatttctttgattattgggggcaaggaacactggtgaccgtcagctctgcctccactaaaggc

SEQ ID NO: 27227 - RNA, 381 nt, synthetic construct
  misc_feature 1..381: note = derived and/or modified sequence opt3 from anti-HIV_Chain
  source 1..381: mol_type = other RNA
caggtgcaactggtccagagcggcgccgaggttaagaaacccggggcttccgtgaaggtatcttgcaaagcacctggatacaccttcatcggtcactatatgcattggattagacaggccccaggccaggggctcgaatggatgggatggataaaccccaattcaggcgacacaaactacgcgcaaacttttcagggtagggtgacgatgacccgggatacaagtatcagcactgcttatatggagcttacccgcctgcgatccgacgatacagccgtctactattgtgcacgtgacttgagaccgatgagggggaattgggccatgcacgtgtggggagaaggcaccactgttacagtgtcttcggcttcaaccaagggc

SEQ ID NO: 27228 - RNA, 381 nt, synthetic construct
  misc_feature 1..381: note = derived and/or modified sequence opt3 from anti-HIV_Chain
  source 1..381: mol_type = other RNA
caggtgcaactgcaggagagcggccccgggctcgtcaagccttccgaaaccctttctctgacatgcactgttttcggagcctcaatcagaagtttttactggcactggattaggcagagcccaggtaaaggcttggagtggttagggtccgtgttcgacaacggactgacgacctataatccgtctctaaagaaccggctctcgatatcagaagatcccagccgcaatcagatcagtctgaaccttcgatccatgacagctgcagacactgccgtatactattgtgcgcgtgctgattacgacctgttgacctctagctatcattttgattcctggggccaaggtacactcgtgaccgtctcaagtgccagcactaaaggg

SEQ ID NO: 27229 - RNA, 381 nt, synthetic construct
  misc_feature 1..381: note = derived and/or modified sequence opt3 from anti-HIV_Chain
  source 1..381: mol_type = other RNA
agccagcaactggtgcagtccggcacccaggtcaagaaacccggggcctctgttagagtgtcatgccaggctagtggatacacattcactgactatgtactccactggtggaggcaagcacctggtcagggccttgagtggatggggtggatcaagccagtgtacggagcccggaactatgcgcatcgctttcagggccgaattaatttcgatcgtgacgtctacagagaaatagcttatatggatctgagcggtttgaggtccgacgatacggccgtgtacttttgtgcacgggacgggtctggagatgccacctcgtggcacttacatccgtggggccagggcacactggttatcgtgtcaagcgctagtactaaaggg

SEQ ID NO: 27230 - RNA, 381 nt, synthetic construct
  misc_feature 1..381: note = derived and/or modified sequence opt3 from anti-HIV_Chain
  source 1..381: mol_type = other RNA
agccagcaactggtgcagtccggcacccaggtcaagaaacccggggcctctgttagagtgtcatgccaggctagtggatacacattcactaactatatcctccactggtggaggcaagcacctggtcggggccttgagtggatggggctgattaagccagtatacggagccgtgaattatgcgcgccagtttcagggccgaatacagttgacgcgtgacatctacagagaaattgctttcttagatctgagcggtctaaggccggacgataccgccgtctattactgtgcacgggacgagtccgggtatgatctcaactggcatctggactcttggggacaaggcacacaggtgatcgtttcgcccgcctcaactaaaggc

SEQ ID NO: 27231 - RNA, 381 nt, synthetic construct
  misc_feature 1..381: note = derived and/or modified sequence opt3 from anti-HIV_Chain
  source 1..381: mol_type = other RNA
agccagcaactggtgcagtccggcgcccaggtcaagaaacccggggcttctctcagagtttcatgccaggcaagtggatacaccttcatgaactatcttctgcactggtggaggcaagcccctggtcagggcttggagtggatggggtggatcaatccagtgtacggagcggtaaactatgctcatcggtttcagggccgcttaacattcagccgagacgtgtaccgtgaaattgcctatatggatctgaatggtctaagatccgacgatactgcagtctacttttgtgccagggacgggtctggagatgaccggaactggcacctcgatccgtggggccagggcacgctggtgatagtttcgtcagctagcaccaagggg

SEQ ID NO: 27232 - RNA, 381 nt, synthetic construct
  misc_feature 1..381: note = derived and/or modified sequence opt3 from anti-HIV_Chain
  source 1..381: mol_type = other RNA
agccagcaactggtgcagtccggcacccaggtcaagaaacccggggcctctgttagaatctcatgccaggctagtggatacacattcactgactatgtgctccactggtggaggcaagcacctggtcagggccttgagtggatggggtggattaagccagtatacggagcccggaactatgcgcgccgatttcagggccgtataaatttcgatagagacatctacagggaaattgcttttctggatttgagcggtttacggtccgacgatacggcccgctatttctgtgcaagagacgggtctggagatgacacctcgtggcatctgcacccgtggggccagggcactctagtgatcgtctcagccgctagcacaaaaggg

SEQ ID NO: 27233 - RNA, 381 nt, synthetic construct
  misc_feature 1..381: note = derived and/or modified sequence opt3 from anti-HIV_Chain
  source 1..381: mol_type = other RNA
agccagcaactggtgcagtccggcacccaggtcaagaaaacaggggcctctgttagagtgtcatgccaggctagtggatacgacttcactaagtatctcatccactggtggaggcaagcacccggtcagggccttgagtggatggggtggatgaaacctgtatacggagccacgaactatgcgcatcggtttcagggccgcattagcttcacccgagatatataccgtgaaatcgcttttatggacctgaatggtttgagatccgatgacacagccgtgtatttctgtgcaagggatgggggaggcgacgatcggacttggttactggacgcctggggccaggggaccctagtcattgtgtcttcggcttcaacaaaggga

SEQ ID NO: 27234 - RNA, 381 nt, synthetic construct
  misc_feature 1..381: note = derived and/or modified sequence opt3 from anti-HIV_Chain
  source 1..381: mol_type = other RNA
agccagcaactggtgcagtccggcacccaggtcaagaaacccggggcctctgttagagtgtcatgccaggctagtggatacacattcatgaactatatcattcactggtggaggcaagcacctggtcagcggctcgagtggatgggctggataaatccagtatttggggcccgcaactacgcgcatcgattccagggacgtatcaattttgacagagatattaacagggaaactttccagatggaccttacgggcctgcggagcgatgacaccgctgtgtattactgtgcccgcgatggttccggggacgcaagagattggcacttgcatccgtggggacaaggcacattagtcatcgtgtcttcggcctcaactaagggc

SEQ ID NO: 27235 - RNA, 381 nt, synthetic construct
  misc_feature 1..381: note = derived and/or modified sequence opt3 from anti-HIV_Chain
  source 1..381: mol_type = other RNA
agccagcacctggtgcaatccggcacccaggtcaagaaacccggggcctctgttagagtgtcatgccaggctagtggatacacattcactaactatatcctccattggtggaggcaggcacctggtcaaggccttgagtggatggggctgattaagccagtatttggagccgtgaattacgcgcggcagttccagggccgcatacagttgacgcgagacatcaaccgtgaaattgcttttctggatctgagcggtctaagatccgacgataccgccgtctattactgtgcaagggacgagtctggggatgacctcaaatggcacttacatccgtggggacaaggcacacaggtgatcgtttcgcccgcctcaactaagggc

SEQ ID NO: 27236 - RNA, 381 nt, synthetic construct
  misc_feature 1..381: note = derived and/or modified sequence opt3 from anti-HIV_Chain
  source 1..381: mol_type = other RNA
agccagcaactggtgcagtccggcacccaggtcaagaaacccggggcctctgttagagtgtcatgccaggctagtggatacacattcatgaactatatcattcactggtggaggcaagcacctggtcagcggctcgagtggatgggctggataaatccagtatttggggcccgcaactacgcgcatcgattccagggacgtatcaattttgacagagatattaacagggaaactttccagatggagcttacgggcctgcggagcgacgataccgctgtgtattactgtgcccgcgacggttccggggatgcaagagactggcacttggatccgtggggacaaggcacattagtcatcgtgtcttcggcctcaactaagggc

SEQ ID NO: 27237 - RNA, 381 nt, synthetic construct
  misc_feature 1..381: note = derived and/or modified sequence opt3 from anti-HIV_Chain
  source 1..381: mol_type = other RNA
agccagcaactggtgcagtccggcacccaggtcaagaaacccggggcctctgttagaatctcatgccaggctagtggatacacattcactgactatgtgctccactggtggaggcaagcacctggtcagggccttgagtggatggggtggattaagccagtatacggagcccggaactatgcgcgccgatttcagggccgtataaatttcgatagagacatctacagggaaattgcttatatggatctgagcggtttgcggtccgacgatacggcccgctacttttgtgcaagagacgggtctggagatgacacctcgtggcatttacacccgtggggccagggcacactggtgatcgtctcagccgctagcactaaaggg

SEQ ID NO: 27238 - RNA, 381 nt, synthetic construct
  misc_feature 1..381: note = derived and/or modified sequence opt3 from anti-HIV_Chain
  source 1..381: mol_type = other RNA
agccagcaactggtgcagtccggcacccaggtcaagaaacccggggcctctgttagaatctcatgccaggctagtggatacagcttcacagactatgtgctccactggtacaggcaagcacctggtcagggccttgagtggatggggtggattaagccagtatatggagcccggaactacgcgcgccgatttcagggccgtataaatttcgatagagacatctatagggaaattgcttttatggatctgtccggtttgcggtctgacgatactgccttatacttctgtgcacgcgacgggtcgggagatgacacgtcatggtatctggatccgtggggccagggcaccctagtgatcgtcagcgccgctagtacaaaaggg

SEQ ID NO: 27239 - RNA, 381 nt, synthetic construct
  misc_feature 1..381: note = derived and/or modified sequence opt3 from anti-HIV_Chain
  source 1..381: mol_type = other RNA
agccagcaactggtgcagtccggcacccaggtcaagaaacccggggcctctgttagaatctcatgccaggctagtggatacagcttcacagactatgtgctccactggtggaggcaagcacctggtcagggccttgagtggatggggtggattaagccagtatacggagcccggaactatgcgcgccgatttcagggccgtataaatttcgatagagacatctacagggaaattgcttttatggatctgtccggtttgcggtctgacgatactgccttatatttctgtgcacgcgacgggtcgggagatgacacgtcatggcatctggatccgtggggccagggcaccctagtgatcgtcagcgccgctagtacaaaaggg

SEQ ID NO: 27240 - RNA, 381 nt, synthetic construct
  misc_feature 1..381: note = derived and/or modified sequence opt3 from anti-HIV_Chain
  source 1..381: mol_type = other RNA
agccagcacctggtgcaatccggcacccaggtcaagaaacccggggcctctgttagagtgtcatgccaggctagtggatacacattcactaactatatcctccattggtggaggcaggcacctggtcaaggccttgagtggatggggctgattaagccagtatttggagccgtgaattacgcgcggcagttccagggccgcatacagttgacgcgagacatctatcgtgaaattgcttttctggatctgagcggtctaagatccgacgataccgccgtctactattgtgcaagggacgagtctggggatgacctcaaatggcacttacatccgtggggacaaggcacacaggtgatcgtttcgcccgcctcaactaagggc

SEQ ID NO: 27241 - RNA, 381 nt, synthetic construct
  misc_feature 1..381: note = derived and/or modified sequence opt3 from anti-HIV_Chain
  source 1..381: mol_type = other RNA
caggtgcaactggtcgagagcggcgggggagttgtgcagcccggtaagtccctcagactttcttgcgccatctcaggcttcctgtttaacaattacgggggacagtgggtaaggcaggctcctggcaaaggtttggaatgggtggcagccattagttatgacgggaacaatcggtactatgcggatagcgctaagggacgcttcttaatatcccgagacaccccgaaaaacatcctgtacctacaaatttattctctccgtctggatgacacagccgtctactattgtgcaagagattcggtgtcaaagagctacagtgccccacccgagttttggggccagggcactgttgtgacggtctcctctgctagcaccaaaggg

SEQ ID NO: 27242 - RNA, 381 nt, synthetic construct
  misc_feature 1..381: note = derived and/or modified sequence opt3 from anti-HIV_Chain
  source 1..381: mol_type = other RNA
caggtgcacctggaggaaagcggccccgggctcgtcaagacctcccaaacactttctctgacttgctcagttagtagctactccatctctagatcgggatatttctggacgtggattaggcagcggcctggtaaaggcttggagtggatagggtacatctattttaacggacgcaccacatacaatccatcattaaagagccgaattactatcagtcgtgacacctcccattctcagttcagcctgacactaaactccctctcagccgctgataccgcagtgtattactgtggcagatgccaggacggtctggccagtaggccgattgatttttgggggcaaggaactcttgtaacagtgagctctgcgtccaccaaaggc

SEQ ID NO: 27243 - RNA, 381 nt, synthetic construct
  misc_feature 1..381: note = derived and/or modified sequence opt3 from anti-HIV_Chain
  source 1..381: mol_type = other RNA
caggtgcaactggtcgagagcggcgggggagttgtgcagcccggtagatccctcaggctttcttgcgccacctcaggcttcacaagtaagaattacggggtacactgggtgcggcaggctcctggaaaaggcctggaatgggtcgcagtgatctggtatgacggtagcaataagttttacgccgattccgttaaagggcgcttcactatttctcgagaccgttcgaagaacatggtgtatttgcagatgaactcattaagagtcgaggatacggcgatatactattgtgctagggacagcgtggcctttgtactggaaggaccaatcgattactggggccaaggcaccctagttacagtgagttccgcatctactaaaggg

SEQ ID NO: 27244 - RNA, 384 nt, synthetic construct
  misc_feature 1..384: note = derived and/or modified sequence opt3 from anti-HIV_Chain
  source 1..384: mol_type = other RNA
caggtgcaactggtccagagcggcgggggagttaagaaacccggtacctccgcctctttctcatgcagaacaagtgacgatatctacgacaacgagtttttcgatagcgcttttatgcactgggtgaggctcattcctggccagcggccagaatggatggggtggatgaatccgcgctccggagcagtaaactatgcccgacagcttcaaccccgtgtgtctatgtacagagacagggatctgtcgactgcgtatatggagttcaagtcattgacgagcgctgacaccggcacatacttttgtgcccggaaaaagcgcggtgatgggttcaatttatattttgacctgtggggaagaggcagtcaggtcatagtgtcctctgca

SEQ ID NO: 27245 - RNA, 384 nt, synthetic construct
  misc_feature 1..384: note = derived and/or modified sequence opt3 from anti-HIV_Chain
  source 1..384: mol_type = other RNA
cagggccacctggtgcaaagcgggggaggtgtcaagaaactcggcacctccgttacaatctcttgccttgcctcagaggacactttcaacgaatttgtgattcattggataagacaggctcccgggcagggacctctgtggttgggcttaatcaagaggagtggtcggctgatgacgagctaccagttccaagatcgcctatccctccgacgtgacagatctaccgggacagtatttatggagctgaggggacttcgggtggatgacactgcagtctattactgtgcccgcgatggcctgggcgaagtggcgccagcttatttgtacgggattgacgcctggggacagggtaccacagttatcgtgacctcggcatcaactagc

SEQ ID NO: 27246 - RNA, 384 nt, synthetic construct
  misc_feature 1..384: note = derived and/or modified sequence opt3 from anti-HIV_Chain
  source 1..384: mol_type = other RNA
cagagcgccctgacccaacccccttccgtgtctggcgctccagggcagagagtcacaatctcatgcagtggaggtccgagcaacgttggcgggaattacgtgtattggtacaggcagttccccggaactgcacctaagctccttattctgcgggacgatcagcgcccatccggcgtacccgaccgattttctgcctcgaaatcaggtaacagcgcgagtttggctatatccgggttacgtcctgatgacgaggccttctatttttgtgcaacgtacgattctcaaggcagcttcagagtgtttggaggcgggaccgccctgacagtcctatcccagccaaaggctgcaccctcagtgactctctatcctccaagtagcgaagag

SEQ ID NO: 27247 - RNA, 384 nt, synthetic construct
  misc_feature 1..384: note = derived and/or modified sequence opt3 from anti-HIV_Chain
  source 1..384: mol_type = other RNA
aacttcatgctgacccagccccctagcgcctccggcacaccagggcaaagagtgactatctcttgctcaggaggtggcagtaatattgggggaaacctcgtcagctggtaccagcactttccgggcgctgcacccaaacttctgatatataggaatgaccagcggccttccggtgttccagatcgcttctctgggtcgaagtcaggaacgagcgccagtttggcgatctccggcttacgatctgacgataaggctacctacttttgtgccgcatatgacagcacactgtccctacgtctcttcggcgggggaactaccctgacagtgctttcacagcccaaagccgctcctagtgtaaccctgtttccacccagctctgaggaa

SEQ ID NO: 27248 - RNA, 384 nt, synthetic construct
  misc_feature 1..384: note = derived and/or modified sequence opt3 from anti-HIV_Chain
  source 1..384: mol_type = other RNA
aacttcatgctgacccagccccctagcgtgtccgccacaccaggccaaactgtcacgatctcttgctcagggagtggaagcaatgttggtggcaaccacgtgtactggtatagacagctcccgggggctgcacccacccttgtaatttccaagacagaccataggccttctcgggtgccagatcgcttctcgggatcaaaaagcggcaatagtgcctccctggcgatatctggtttgcgacccgacgatgaggctgtctacttctgtgccacttatgacaccgggttaagcctgcgtctatttggaggcggcacaagactcaccgtgctgtcccagcctaaggcagccccatcagttactcagtttccccctagtagcgaagag

SEQ ID NO: 27249 - RNA, 384 nt, synthetic construct
  misc_feature 1..384: note = derived and/or modified sequence opt3 from anti-HIV_Chain
  source 1..384: mol_type = other RNA
cagagcgccctgacccaacccccttccgcttctggcgcaccagggcagagagtgacaatctcatgcagtggaggtccgagcaacgtcggcgggaattacgtttattggtacaggcagttccccggaactgcccctaagctccttattctgcgggacgatcagcgcccatccggcgtgcccgaccgattttctgcgtcgaaatcaggtaacagcgctagtttggccatatccgggttacgtcctgatgacgaggcactgtatttctgtgccacgtacgattctgacggaagcatcagactatttggcggcgggaccgctctcacagtactgtcccaaccaaaggcagccccctcagtgactcttttccctccaggatgggaagag

SEQ ID NO: 27250 - RNA, 384 nt, synthetic construct
  misc_feature 1..384: note = derived and/or modified sequence opt3 from anti-HIV_Chain
  source 1..384: mol_type = other RNA
caggtgcaactgctccagagcggcgccgctgtcaccaagcccggggcatccgttagagtgtcttgcgaggcctcaggatacaacatcagggactatttcattcactggtggcggcaggcgcctggtcagggccttcaatgggtagggtggataaatccaaaaacaggacagccgaacaatccccgcctgtttcagggccgagtgagtttgactcgtcatgctagctgggatttcgacacgttttccttctacatggatttaaaggccgtcagatctgacgataccgcagtgtatttttgtgccaggcagcggtcggactactgggatttcgacgtttggggttcagggacacaagtgactgtcagcagtgcttccaccaaagga

SEQ ID NO: 27251 - RNA, 384 nt, synthetic construct
  misc_feature 1..384: note = derived and/or modified sequence opt3 from anti-HIV_Chain
  source 1..384: mol_type = other RNA
caggtgcaactgctccagagcggcgccgtcgttaccaagcccggggcttccgtgagagtatcttgcgaggcatcaggatacaaaatcagggactatttcattcactggtggcggcaggcccctggtcagggccttcaatgggtggggtggataaacccacagacaggacagccgaatatcccccgcccttttcagggccgagtcactctgacgcgtcatgcgagttgggatttcgacacctttagcttctacatggatttgaaggctttaagatccgacgatacagccatttatttttgtgcaaggcggcgctctgactactgcgatttcgacgtgtggggttcggggactcacgttaccgtgtcaagcgccagtacaaaagga

SEQ ID NO: 27252 - RNA, 384 nt, synthetic construct
  misc_feature 1..384: note = derived and/or modified sequence opt3 from anti-HIV_Chain
  source 1..384: mol_type = other RNA
caggtgcaactgctccagagcggcgccgctgtcaccaagcccggggcatccgttagagtgtcttgcgaggcctcaggatacaacatcagggactatttcattcactggtggcggcaggcgcctggtcagggccttcaatgggtagggtggataaatccaaaaacaggacagccgaacaatccccgccagtttcagggccgagtgagtctgactcgtcaagctagctgggatttcgacacgatctccttttacatggatttgaaggccttaagactggacgataccgcagtctatttctgtgccaggcagcggtctgactactgggattttgacgtgtggggttcggggacacaggttactgtgtcaagcgctagtaccaaagga

SEQ ID NO: 27253 - RNA, 384 nt, synthetic construct
  misc_feature 1..384: note = derived and/or modified sequence opt3 from anti-HIV_Chain
  source 1..384: mol_type = other RNA
caggtgcaactgctccagagcggcgccgctgtcaccaagcccggggcatccgttagagtgtcttgcgaggcctcaggatacaacatcagggactatttcattcactggtggcggcaggcgcctggtcagggccttcaatgggtagggtggataaatccaaaaacaggacagccgaacaatccccgccagtttcagggccgagtgagtctgactcgtcatgctagctgggatttcgacacgttttccttctacatggatttgaaggccttaagatctgacgataccgcagtctatttttgtgccaggcaacggtcggactactgggatttcgacgtgtggggttcagggacacaggttactgtgtatagcgctagtaccaaagga

SEQ ID NO: 27254 - RNA, 384 nt, synthetic construct
  misc_feature 1..384: note = derived and/or modified sequence opt3 from anti-HIV_Chain
  source 1..384: mol_type = other RNA
caggtgcaactgctccccttcggcggggccgtcaccaagcctggagctagcgttagagtgtcctgcgaggcatctggttacaacatcagggactattttattcactggtggcggcaggccccaggccaggggcttcagtgggtaggatggataaatccgaaaacaggccaacccaacaatccttgtcagttccagggtcgcgtgtcactgactcgaccagcgagttgggattttgacacgatcagcttctacatggatttgaaggctttacgtctggacgataccgccgtctatttttgcgcaagacagaggtccgactactgggatttcgacgtgtgggggtctggaacacaagttactgtgtcgtcagccagcaccaaaggc

SEQ ID NO: 27255 - RNA, 384 nt, synthetic construct
  misc_feature 1..384: note = derived and/or modified sequence opt3 from anti-HIV_Chain
  source 1..384: mol_type = other RNA
caggtgcacctgagccaatccggcgccgctgtcaccaagcccggggcatctgttagagtgtcatgcgaggccagtggatacaaaatcagcgaccatttcattcactggtggaggcaggcgcctggtcagggcctccagtgggtagggtggataaacccaaagacaggacaaccgaataacccccggcagtttcagggccgcgtgtcccttactcgacaggcttcttgggatttcgacacgtattcgttttacatggatctgaaagccttgcgttcagacgataccgcaatctatttctgtgccagacaaaggagcgacttttgggatttcgacgtctggggtagtgggacacaggtgactgtttcctctgctagcaccaaggga

SEQ ID NO: 27256 - RNA, 384 nt, synthetic construct
  misc_feature 1..384: note = derived and/or modified sequence opt3 from anti-HIV_Chain
  source 1..384: mol_type = other RNA
caggtgcacctgagccaatccggcgccgctgtcaccaagcccggggcatctgttagagtgtcatgcgaggccagtggatacaaaatcagcgaccatttcattcactggtggaggcaggcgcctggtcagggcctccagtgggtagggtggataaacccaaagacaggacaaccgaataacccccggcagtttcagggccgcgtgtcccttactcgacaggcttcttgggatttcgacacgtattcgttttacatggatctgaaagccgtccgttcagacgataccgcaatctatttctgtgccagacaaaggagcgacttttgggatttcgacgtgtggggtagtgggacacaggttactgtgtcctctgctagcaccaaggga

SEQ ID NO: 27257 - RNA, 384 nt, synthetic construct
  misc_feature 1..384: note = derived and/or modified sequence opt3 from anti-HIV_Chain
  source 1..384: mol_type = other RNA
caggtgcaactgctccagagcggcgccgctgtcaccaagcccggggcatccgttagagtgtcttgcgaggcctcaggatacaaaatcagtgaccacttcattcattggtggaggcaggcgcctggtcagggccttcaatgggtagggtggataaacccaaagacaggacagccgaataacccccggcagtttcagggccgcatcagcctgactcgacaggcttcctgggatttcgacacgttttctttctatatggatttgaaagccttacgttcggacgataccgcagtgtacttttgtgccagacaaaggtcagactattgggatttcgacgtctggggtagcgggacacaggtgactgttagttccgcttctaccaaggga

SEQ ID NO: 27258 - RNA, 384 nt, synthetic construct
  misc_feature 1..384: note = derived and/or modified sequence opt3 from anti-HIV_Chain
  source 1..384: mol_type = other RNA
caggtgcaactgctccagagcggcgccgctgtcaccaagcccggggcatccgttagagtgtcttgcgaggcctcaggatacaacatcagggactatttcattcactggtggcggcaggcgcctggtcagggccttcaatgggtagggtggataaatccaaaaacaggacagccgaacaatccccgccagtttcagggccgagtgagtctgactcgtcatgctagctgggatttcgacacgttttccttctacatggatttgaagggtttaagatctgacgataccgccatctatttttgtgcaaggcaacggtcggactactgggatttcgacgtctgggggtcaggaacacaggtgactgttagcagtgcctccaccaaaggc

SEQ ID NO: 27259 - RNA, 384 nt, synthetic construct
  misc_feature 1..384: note = derived and/or modified sequence opt3 from anti-HIV_Chain
  source 1..384: mol_type = other RNA
caggtgcaactgctccagagcggcgccgctgtcaccaagcccggggcatccgttagagtgtcttgcgaggcctcaggatacaacatcagggactatttcattcactggtggcggcaggcgcctggtcagggccttcaatgggtagggtggataaatccaaaaacaggacagccgaacaatccccgccagtttcagggccgagtgagtctgactcgtcatgctagctgggatttcgacacgttttccttctacatggatttgaaggccttaagatctgacgataccgcagtctatttttgtgccaggcaacggtcggactactgggatttcgacgtgtggggttcagggacacaggttactgtgagcagtgcttccaccaaagga

SEQ ID NO: 27260 - RNA, 384 nt, synthetic construct
  misc_feature 1..384: note = derived and/or modified sequence opt3 from anti-HIV_Chain
  source 1..384: mol_type = other RNA
cacgtgcagctgctccaaagcggcgccgctgtcaccaagcccggggcatccgttagagtgtcttgcgaggcctcaggatacaacatcagggactatttcattcattggtggcggcaggcgcctggtcagggccttcagtgggtagggtggataaatccaaaaacaggacaaccgaacaatccccgccagtttcagggccgagtgagtctgactcgtcaggctagctgggatttcgacacgttttccttctacatggatttgaaggccttaagactggacgataccgcaatctatttttgtgccaggcaacggtctgactactgggatttcgacgtctggggttcggggacacaggtgactgtttcaagcgctagtaccaaagga

SEQ ID NO: 27261 - RNA, 384 nt, synthetic construct
  misc_feature 1..384: note = derived and/or modified sequence opt3 from anti-HIV_Chain
  source 1..384: mol_type = other RNA
caggtgcacctgagccattccggcgccgctgtcaccaagcccggggcatctgttagagtgtcatgcgaggccagtggatacaaaatcagcgaccacttcattcattggtggaggcaagcgcctggtcagggcctccagtgggtagggtggataaacccaaagacaggacagccgaataacccccggcaatttcagggccgcatctcccttactcgacaggcttcttgggatttcgacacgttttcgttctatatggatctgaaagccttgcgttcagacgataccgcagtgtacttttgtgccagacagaggagcgactattgggatttcgacgtctggggtagtgggacacaagtgactgtttcctctgctagcaccaaggga

SEQ ID NO: 27262 - RNA, 384 nt, synthetic construct
  misc_feature 1..384: note = derived and/or modified sequence opt3 from anti-HIV_Chain
  source 1..384: mol_type = other RNA
caggtgcacctgagccaatccggcgccgtcgttaccaagcccggggcttctgtgagagtatcatgcgaggcaagtggatacaaaatcagcgaccatttcattcactggtggaggcaggcccctggtcagggcctccagtgggtggggtggataaacccaaagacaggacaaccgaataacccccggcagtttcagggccgcatctcccttactcgacaggcgtcttgggatttcgacacgttttcgttctatatggatctgaaggctttgcgttcagacgataccgccgtctacttttgtgcaagacaaaggagcgactattgggatttcgacgtgtggggtagtgggacacaggttactgtgtcctctgccagcaccaaagga

SEQ ID NO: 27263 - RNA, 384 nt, synthetic construct
  misc_feature 1..384: note = derived and/or modified sequence opt3 from anti-HIV_Chain
  source 1..384: mol_type = other RNA
caggtgcacctgagccaatccggcgccgtcgttaccaagcccggggcttctgtgagagtatcatgcgaggcaagtggatacaaaatcagcgaccatttcattcactggtggaggcaggcccctggtcagggcctccagtgggtggggtggataaacccaaagacaggacaaccgaataacccccggcagtttcagggccgcatctcccttactcgacaggcgtcttgggatattgacacgttctcgttttatatggatctgaaggctttgcgttcagacgataccgccgtctacttctgtgcaagacataggagcgactattgggattttgacgtgtggggtagtgggacacaagttactgtgtcctctgccagcaccaaagga

SEQ ID NO: 27264 - RNA, 384 nt, synthetic construct
  misc_feature 1..384: note = derived and/or modified sequence opt3 from anti-HIV_Chain
  source 1..384: mol_type = other RNA
caggtgcacctgagccaatccggcgccgtcgttaccaagcccggggcttctgtgagagtatcatgcgaggcaagtggatacaaaatcagcgaccatttcattcactggtggaggcaggcccctggtcagggcctccagtgggtggggtggataaacccaaagacaggacaaccgaatatcccccggcagtttcagggccgcatttcccttactcgacaggcgtctggtgatttcgacacgttttcgttctatatggatctgaaggctttgcgttcagacgataccgccgtctacttttgtgcaagacaaaggagcgactattgggatttcggggtgtggggaagtggcacacaggttactgtgtcctctgccagcaccaaaggc

SEQ ID NO: 27265 - RNA, 384 nt, synthetic construct
  misc_feature 1..384: note = derived and/or modified sequence opt3 from anti-HIV_Chain
  source 1..384: mol_type = other RNA
caggtgcacctgagccaatccggcgccgtcgttaccaagcccggggcttctgtgagagtatcatgcgaggcaagtggatacaaaatcagcggtcatttcattcactggtggaggcaggcccctggccaggggctccagtgggtgggatggataaacccaaagacaggccaaccgaataacccccggcagtttcagggtcgcatctcccttactcgacaggcgtcttgggacttcgatacgttttcgttctatatggacctgaaggctttgcgttcagatgacaccgccgtctacttttgtgcaagacataggagcgattattgggacttcgatgtgtgggggagtggaacacaagttactgtgtcctctgccagcaccaaaggc

SEQ ID NO: 27266 - RNA, 384 nt, synthetic construct
  misc_feature 1..384: note = derived and/or modified sequence opt3 from anti-HIV_Chain
  source 1..384: mol_type = other RNA
caggtgcacctgagccaatccggcgccgctgtcaccaagcccggggcatctgttagagtgtcatgcgaggccagtggatacaaaatcagcgaccatttcattcactggtggaggcaggcgcctggtcagggcctccagtgggtagggtggataaacccaaagacaggacaaccgaataacccccggcagtttcagggccgcatctcccttactcgacaggcttcttgggatttcgacacgttttcgttctatatggatctgaaagccttgcgttcagacgataccgcagtgtacttttgtgccagacataggagcgactattgggatttcgacgtctggggtagtgggacacaagtgactgtttcctctgctagcaccaaggga

SEQ ID NO: 27267 - RNA, 384 nt, synthetic construct
  misc_feature 1..384: note = derived and/or modified sequence opt3 from anti-HIV_Chain
  source 1..384: mol_type = other RNA
caggtgcacctgagccaatccggcgccgctgtcaccaagcccggggcatctgttagagtgtcatgcgaggccagtggatacaaaatcagcgaccatttcattcactggtggaggcaggcgcctggtcagggcctccagtgggtagggtggataaacccaaagacaggacaaccgaataacccccggcagtttcagggccgcgtgtcccttactcgacaggcttcttgggatttcgacacgtattcgttttacatgggtctgaaagccgtccgttcagatgacaccgcaatctatttctgtgccagacaaaggagcgatttttgggacttcgatgtgtgggggagtggaacacaggttactgtgtcctctgctagcaccaagggc

SEQ ID NO: 27268 - RNA, 384 nt, synthetic construct
  misc_feature 1..384: note = derived and/or modified sequence opt3 from anti-HIV_Chain
  source 1..384: mol_type = other RNA
caggtgcacctgagccaatccggcgccgtcgttaccaagcccggggcttctgtgagagtatcatgcgaggcaagtggatacaaaatcagcgaccatttcattcactggtggaggcaggcccctggtcagggcctccagtgggtggggtggataaacccaaagacaggacaaccgaataacccccggcagtttcagggccgcatctcccttactcgacaggcgtcttgggatttcgacacgttttcgttctatatggatctgaaggctttgcgttcagacgataccgccgtctacttttgtgcaagacataggagcgactattgggatttcgacgtgtggggtagtgggacacaagttactgtgtcctctgccagcaccaaagga

SEQ ID NO: 27269 - RNA, 384 nt, synthetic construct
  misc_feature 1..384: note = derived and/or modified sequence opt3 from anti-HIV_Chain
  source 1..384: mol_type = other RNA
caggtgcacctgagccaatccggcgccgtcgttaccaagcccggggcttctgtgagagtatcatgcgaagcaagtggatacaaaatcagcgaccatttcattcactggtggaggcaggcccctggtcagggcctccagtgggtggggtggataaacccaaagacaggacaaccgaataacccccggcagtttcagggccgcatctcccttactcgacaggcgtcttgggatttcgacacgttttcgttctatatggatctggaggctttgcgttcagacgataccgccgtctacttttgtgcaagacaaaggagcgactattgggatttcgacgtgtggggtagtgggacacaggttactgtgtcctctgccagcaccaaagga

SEQ ID NO: 27270 - RNA, 384 nt, synthetic construct
  misc_feature 1..384: note = derived and/or modified sequence opt3 from anti-HIV_Chain
  source 1..384: mol_type = other RNA
caggtgcacctgagccaatccggcgccgctgtcaccaagcccggggcatctgttagagtgtcatgcgaggccagtggatacaaaatcagggactatagcattcattggtggcggcaggcgcctggtcagggcctccagtgggtagggtggataaacccacaaacaggacagccgaatatcccccgccctttccagggccgaatttcccttactcgtcaggcttcttgggattttgacacgttctcgttttacatggatctggaagccttgagatcagacgataccgcagtgtatttctgtgccaggcaacggagcgactactgggattttgacgtctggggtagtgggacacaggtgactgtttcctctgctagcaccaaggga

SEQ ID NO: 27271 - RNA, 384 nt, synthetic construct
  misc_feature 1..384: note = derived and/or modified sequence opt3 from anti-HIV_Chain
  source 1..384: mol_type = other RNA
caggtgcacctgagccaatccggcgccgctgtcaccaagcccggggcatctgttagagtgtcatgcgaggccagtggatacaaaatcagcgaccatttcattcactggtggaggcaggcgcctggtcagggcctccagtgggtagggtggataaacccaaagacaggacaaccgaataacccccggcagtttcagggccgcatctcccttactcgacaggcttcttgggatttcgacacgttttcgttctatatggatctgaaagccttgcgttcagacgataccgcagtgtacttttgtgccagacaaaggagcgactatcgggatttcgacgtctggggtagtgggacacaggtgactgtttcctctgctagcaccaaggga

SEQ ID NO: 27272 - RNA, 384 nt, synthetic construct
  misc_feature 1..384: note = derived and/or modified sequence opt3 from anti-HIV_Chain
  source 1..384: mol_type = other RNA
caggtgcacctgagccaatccggcgccgtcgttaccaagcccggggcttctgtgagagtatcatgcgaggcaagtggatacaaaatcagcgaccatttcattcactggtggaggcaggcccctggtcagggcccacagtgggtggggtggataaacccgaagacaggacaacccaataaccctcggcagtttcagggccgcatctccctcactcgacaggcgtcttgggatttcgacacgttttcgttctatatggatcttaaagctctgcgttcagacgataccgccgtctacttttgtgcaagacataggagcgactattgggatttcgacgtgtggggtagtgggacacaagttactgtgtcctctgccagcaccaaggga

SEQ ID NO: 27273 - RNA, 384 nt, synthetic construct
  misc_feature 1..384: note = derived and/or modified sequence opt3 from anti-HIV_Chain
  source 1..384: mol_type = other RNA
caggtgagactgctccaaagcggcgccgctgtcaccaagcccggggcatccgttagggtgtcttgcgaggcctcaggatacgaaatccgggactatttcattcactggtggcgccaggcgcctggtcagggccttcagtgggtagggtggataaacccaaaaacaggacaaccgaataacccccgacagtttcagggccgtgtgagtctgactagacaggctagctgggatttcgactcctactctttttatatggatttgaaggccttaaggtcggacgatacggcagtctacttctgtgcccggcaacgctcagactattgggattttgacgtgtggggtagcgggacccaggttacagtgagttccgcttctactaaagga

SEQ ID NO: 27274 - RNA, 384 nt, synthetic construct
  misc_feature 1..384: note = derived and/or modified sequence opt3 from anti-HIV_Chain
  source 1..384: mol_type = other RNA
caggtgagactgctccaaagcggcgccgctgtcaccaagcccggggcatccgttagggtgtcttgcgaggcctcaggatacgaaatccgggactatttcattcactggtggcgccaggcgcctggtcagggccttcagtgggtagggtggataaacccaaaaacaggacaaccgaataacccccgacagtttcagggccgtgtgagtctgactagacaggctagctgggatttcgactcctactctttttatatggatttgaaggccttaaggtcggacgatacgggtgtctacttctgtgcacggcaacgctcagactattgggattttgacgtgtgggggagcggaacccaggttacagtgagttccgcctctactaaaggc

SEQ ID NO: 27275 - RNA, 384 nt, synthetic construct
  misc_feature 1..384: note = derived and/or modified sequence opt3 from anti-HIV_Chain
  source 1..384: mol_type = other RNA
caggtgagactgctccaaagcggcgccgctgtcaccaagcccggggcatccgttagggtgtcttgcgaggcctcaggatacgaaatccgggactatttcattcactggtggcgccaggcgcctggtcagggccttcagtgggtagggtggataaacccaaaaacaggacaaccgaataacccccgacagtttcagggccgtgtgagtctgactagacaggctagctgggatttcgactcctactctttttatatggatttgaaggccttaaggtcggacgatacggcagtctacttctgtgcccggcaacgctcagactattgggattttgacgtgtggggtagcgggagtcaggttaccgtgtcctctgctagcacaaaagga

SEQ ID NO: 27276 - RNA, 384 nt, synthetic construct
  misc_feature 1..384: note = derived and/or modified sequence opt3 from anti-HIV_Chain
  source 1..384: mol_type = other RNA
caggtgcaactgctccagagcggcgccgctgtcaccaagcccggggcatccgttagagtgtcttgcgaggcctcaggatacaacatcagggactatttcattcactggtggcggcaggcgcctggtcagggccttcaatgggtagggtggataaatccaaaaacaggacagccgaacaatccctgtcagtttcagggccgcgtgagtctgactcgacaagctagctgggatttcgacacgatctccttttacatggatttgaaggccttacgtctggacgataccgcagtctatttctgcgccagacagaggtctgactactgggattttgacgtgtggggttcggggacacaggttactgtgtcaagcgctagtaccaaagga

SEQ ID NO: 27277 - RNA, 384 nt, synthetic construct
  misc_feature 1..384: note = derived and/or modified sequence opt3 from anti-HIV_Chain
  source 1..384: mol_type = other RNA
caggtgcaactgctccagagcggcgccgctgtcaccaagcccggggcatccgttagagtgtcttgcgaggcctcaggatacaacatcagggactatttcattcactggtggcggcaggcgcctggtcagggccttcaatgggtagggtggataaatccaaaaacaggacagccgaacaatccccgccagtttcagggccgagtgagtctgactcgtcatgctagctgggatttcgacacgttttccttctacatggatttgaaggccttaagatctgacgataccgcagtctatttttgtgccaggcaacggtcggactactgggatttcgacgtgtggggttcagggacacaggttatcgtgagcagtgcttccactaaagga

SEQ ID NO: 27278 - RNA, 384 nt, synthetic construct
  misc_feature 1..384: note = derived and/or modified sequence opt3 from anti-HIV_Chain
  source 1..384: mol_type = other RNA
caggtgcaactggtccagagcggcgccgacgttaagaaacccggggctaccgtgacagtatcctgcaagactgatgaggacgaagatgacttcagagcacacctcatgcagtggatgaggcaggcccctggacaacggcttgagtgggtgggttggatcaaaccacagacgggccagccgtcttacgggcagaagtttcaaggacgcgtcaccctgacacgagaagtgtcaaccagtactgttttcttgcagttacgtaacctgagaagcgatgacacagcggtgtattactgtgctaggccccggggcggtcgcgataattggtcctttcatgtctgggggagaggaaccctagtgactgtatcttcggcctcaacaaaaggc

SEQ ID NO: 27279 - RNA, 384 nt, synthetic construct
  misc_feature 1..384: note = derived and/or modified sequence opt3 from anti-HIV_Chain
  source 1..384: mol_type = other RNA
gaggtgcagctggtcgaaagcggcgccgaggttaagaaacccggggcttccgtgaaggtatcttgcaaagtgtcaggaaacagtctcaccgagttcagcatccactgggtcagacaagcacctggtaagggccttgaatggatgggagggtttgacccagaagagggcgagacagtgccggcccagaaattcaagggtaggctgactatgacggaagatacctccacaaatactgcgtacatggagttgtcttcgttacggtcagaagacaccgctgtttattactgtagcacagagccccgcgagatggggaccctgactgccggatttgaatattggggccagggcaccctagtgacagtcagttccgcatctacgaagggg

SEQ ID NO: 27280 - RNA, 384 nt, synthetic construct
  misc_feature 1..384: note = derived and/or modified sequence opt3 from anti-HIV_Chain
  source 1..384: mol_type = other RNA
agagtgcagctgggccaaagcggggccgaggtcaagaaacccggagcttccgttaaggtgtcttgcaaagtatcaggtaacagtctcaccgagttcagcatccactgggtgaggcaggcacctggcaaggggcttgaatggatgggaggctttgacccagaagagggtgaaacagtcccggcccagaaattcaaggggcgggtgactatgacggaggatacctccacaaatactgcgtacatggagctgtcttcgttgcgctcagaagacaccgctgtttattactgtagcacagagccccgagaaatgggaaccttaactgccggctttgagtattggggccaggggacactggtgattgtcagttccgcatctaccaaggga

SEQ ID NO: 27281 - RNA, 384 nt, synthetic construct
  misc_feature 1..384: note = derived and/or modified sequence opt3 from anti-HIV_Chain
  source 1..384: mol_type = other RNA
caggtgcaactggtccagagcggcgccgacgttaagaaacccggggcttccgtgaccgtatcttgcaagacagatgaggacgaagatgacttcagagcacacctcgtgcagtggatgaggcaggcccctggacaacggcttgagtgggtcggttggatcaaaccacagactggccagccgtcatacgcgcagaagtttcaagggcgcgtgacgctgacccgagaagttagtacaagcactgtgttcttgcagttacgtaacctgagatccgatgacaccgctgtctattactgtgccaggccccggggaggccgcgataattggtcttttcatgtgtggggtagagggaccctagtaacagtttcgtcagcaagcactaaagga

SEQ ID NO: 27282 - RNA, 384 nt, synthetic construct
  misc_feature 1..384: note = derived and/or modified sequence opt3 from anti-HIV_Chain
  source 1..384: mol_type = other RNA
caggtgcaactgcaggagagcggccccgggctcgtcaagccttccgaaaccctttctctgacatgctcagttagtggagccagcatctccaacttctactggacttggattagacagccagctggtaaaggcttggagtgggtggggaggttatattcttcggaccggacgaattacaacccgtcactgaatggacgcgtaaccatgagcctagatacaagtaagaaccagttttccctccgactgacttctatgaccgacgcagatacagccatatatttctgtgcgcgtgaaaaaggccaatggcttaccgtgcccccttactattttgacagctggggtcaggggatcctggtcactgtgtcctcagctagtacaaaggga

SEQ ID NO: 27283 - RNA, 384 nt, synthetic construct
  misc_feature 1..384: note = derived and/or modified sequence opt3 from anti-HIV_Chain
  source 1..384: mol_type = other RNA
caggtgcaactggtccagagcggcgccgaggttagaaagcccggggcttccgtgaaagtatcttgcaagacctcaggatacacattcactaacagttatatccactgggtgaggcaggcacctggtcagggcctcgaatggatggggattataaatccaccgggaggcaacacgtactatgcccaaaaatttcatggtcgggtcacccttacacgcgacactagcacctccacagtgtacatggagctgaactctttgcgatcggaagataccgcggtttatttctgtgctcgtccccactcacctactaatatcccaagcagacccttagactactgggggcagggaacactggtgaccgtcagttccgcctctacgaagggc

SEQ ID NO: 27284 - RNA, 384 nt, synthetic construct
  misc_feature 1..384: note = derived and/or modified sequence opt3 from anti-HIV_Chain
  source 1..384: mol_type = other RNA
caggtgcaactgcaggagagcggccccgggctcgtcaagccttccggaaccctttctctgacatgcaacgtttacggtggctcaatgatcagttattactggagctggattagacagccaccggggaaaggattggaatggataggccacgtgtataattccggtaacactaagtactctccctcgctgaaaaatagggtaacgatctcaatggacaccagccggaacttattcagtctaaaggtgacatccgtcactcctgccgataccgctgtgtattactgtgcacgcgccgactatgataatatttgggactctcgagggggatttgatctctggggccagggcacactggttaccgtgagctccgcgtcaactaaaggg

SEQ ID NO: 27285 - RNA, 384 nt, synthetic construct
  misc_feature 1..384: note = derived and/or modified sequence opt3 from anti-HIV_Chain
  source 1..384: mol_type = other RNA
caggtgcaactggtccagagcggcgccgaggttaagaaacccgggtcctctgtgaaggtatcatgcaaagctagtggaggtaccctcagctcctacacaatctcttgggtgagacaggcacctggccaggggcttgaatggatgggaaggctgattccattggtcgacataactacgtatgcccaaaagttccagggccgggtgaccatcacagcggatacttcgaccaacacagcttacatggagttatcaaatctgcgcagcgaagacaccgccatttatcactgtgcaacaagtactatgatcgccgctgttattaacgatgcatttgacctatggggtcaggggaccacggtgactgtctcctctgccagcaccaaagga

SEQ ID NO: 27286 - RNA, 384 nt, synthetic construct
  misc_feature 1..384: note = derived and/or modified sequence opt3 from anti-HIV_Chain
  source 1..384: mol_type = other RNA
caggtgcaactggtccagagcggcgccgaggttaagaaacccggggcttccgtgaagatctcttgcaaagcatcaggatacagtttcagaaactatgccgtacactgggtgaggcaggcgcctggtcagggcctcgaatggatgggggagattaatggaggcaacggtaataccgaatacagccaaaagtcccaggggcggcttacaataactcgcgacatctctgctacgaccgcctatatggagctgtcgtcattgcgaagcgatgacacagcagtctactattgtgcccgtgtggcttacgttcatgtggtcactaccagaagtttagataactggggacagggcacactggtgaccgtatcctctgcaagcactaaaggc

SEQ ID NO: 27287 - RNA, 384 nt, synthetic construct
  misc_feature 1..384: note = derived and/or modified sequence opt3 from anti-HIV_Chain
  source 1..384: mol_type = other RNA
caggtgagactgagccaatccggcgccgctgtcatgaagaccggggcatctgttacaatctcatgcgagactgaaggattcaactttgtgaattacattatacactgggtaaggcggccccctggtcgcggcttcgagtggctcgggatgatcgacccacgaaacggacatccgtggtttgcccagacggtgcgtggcagacttagtctgaggcgggataccttcaatgaaattgtctatatgacattgagcggtttaactaccgacgatacagggctgtacttttgtgcgcgcaacgagccccagtatcactccctacctggaatgttcgactactggggccagggcaccccagtgactgtttcttcggcttcaacaaaaggg

SEQ ID NO: 27288 - RNA, 384 nt, synthetic construct
  misc_feature 1..384: note = derived and/or modified sequence opt3 from anti-HIV_Chain
  source 1..384: mol_type = other RNA
caggtgagactgagccaatccggcgccgctgtcgttaagaccggggcatctgtgacaatctcatgcgagactgaaggatacaacttcgtaaattatattatacactgggtgaggcggccccctggtcgcggctttgagtggctcgggatgatcgacccacgaaacggacatccgtggttcgcccagacggtccgtggcagacttagtctgaggcgggatacctttaaagaaacagtgtacatgactttgagcggtttaacctccgacgatacaggggtttatttctgtgcgcgcaatgagccccagtaccactctctgcctggaatgtttgactattggggccatggcaccccagtgactgtctcgtcagctagcacaaagggg

SEQ ID NO: 27289 - RNA, 384 nt, synthetic construct
  misc_feature 1..384: note = derived and/or modified sequence opt3 from anti-HIV_Chain
  source 1..384: mol_type = other RNA
cagggccaactggtgcagagcgggggaggtgtcaagaaactcggcacctccgttacaatctcttgccttgcctcagagtacactttcaacgaatttgtgattcactggataagacaggctcccgggcagggacctctgtggttgggcttaatcaagaggagtggtcggctgatgacgagctatcaattccaggaccgcctatccctccgacgtgatagatctaccgggacagtatttatggagctgaggggacttcgggtggacgatactgcagtctactattgtgcccgcgacggcctgggcgaagtggcgccagcttacttgtatgggattgatgcctggggacagggtaccacagttatcgtgacctcggcatcaactagc

SEQ ID NO: 27290 - RNA, 384 nt, synthetic construct
  misc_feature 1..384: note = derived and/or modified sequence opt3 from anti-HIV_Chain
  source 1..384: mol_type = other RNA
caggtgcaactggtccagagcggcgccgaggttaagaaacccggggcttccgtgaaggtatcttgcaaagcatcaggatacaccttcacaagttatgacatcaactgggtgagacaggccactggtcagggcctcgaatggatggggtggatgaatcctaacagcggaaatacgggctacgcgcaaacctttcagggtagggtcacaatgactcggaacacctccatttctacagcttatatggagctttcgtcactgcgcagcgaagataccgccgtgtactattgtgcacgagaccgttggttgccacagtactattactacgggatggatgtttggggacagggcactacagtgaccgtcagttccgcctctacgaagggc

SEQ ID NO: 27291 - RNA, 384 nt, synthetic construct
  misc_feature 1..384: note = derived and/or modified sequence opt3 from anti-HIV_Chain
  source 1..384: mol_type = other RNA
caggtgcaactggtccagagcggcgccgaggttaagaaacccgggtcctctatgaaggtgtcatgcaaaagtagcggaggtaccttctccaaccacgctatctcttgggtaagacaggcacctggcaaggggctcgaatggatgggaggcattataccaatgtcgggtacaactaattaccttcagaaatttcaagggagggtgacgatcaccgccgacgagttcgcgacaactgcttatatggaactgagctcattgaccagtgaggatacagccgtctactattgtgcacgggcccgcgctgactcccataccccgattgatgcatttgacatctggggacccggcactcgagtgattgtttctagcgcctccacaaagggc

SEQ ID NO: 27292 - RNA, 384 nt, synthetic construct
  misc_feature 1..384: note = derived and/or modified sequence opt3 from anti-HIV_Chain
  source 1..384: mol_type = other RNA
caggtgcaactggtccagagcggcgccgaggttaagaaacccggggcttccgtgaaggtatcttgcaaagtgtcaggatacaccctcacagaacttagtatccactgggtcagacaggcacctggtaagaggctggagtggatgggcgggttcgacccagaagatggagagcggatttatgcccagaaatttcaaggccgcgtgactatgacggaagacaccagcacagatactgcgtacatggagttgaactccttacgatctgacgataccgctgtttattactgtgccacaggtgggctgtattgctcgtcaataagctgtatcatggacgtgtggggacagggcaccactgtcacagtgagttccgcatctaccaagggc

SEQ ID NO: 27293 - RNA, 384 nt, synthetic construct
  misc_feature 1..384: note = derived and/or modified sequence opt3 from anti-HIV_Chain
  source 1..384: mol_type = other RNA
caggtgcaactggtccagagcggcgccgaggttaagatgcccggggcttccgtgaaagtatcttgcaaggtgtcaggatacagtctcaccgaacttagcatccactgggtcagacaggcacctggtaaaaggctggagtggatgggcgggttcgacccagaagatgacgagcggatttatgcccagaagtttcaagatcgcgtgacaatgactgaagacacgtccaccgatacagcgtacatggacttgaactctttacgatcggaggatactgctgtttattactgtaccacaggaggcctgtattgctcaagcataagttgtatcatggacgtgtggggtcaggggaccactgtcattgtgtcctctgccagcacaaaagga

SEQ ID NO: 27294 - RNA, 387 nt, synthetic construct
  misc_feature 1..387: note = derived and/or modified sequence opt3 from anti-HIV_Chain
  source 1..387: mol_type = other RNA
gaggtgcagctgagcgaatccggcgggggattcgtcaagcccggtggctctctcagactttcatgcgaggccagtgggtttaccttcaacaattacgctatgagctgggttaggcaagcacctggaaaaggcctggaatgggtgtccgtaacatctgcccacggtgggtcggcgtattacggagagtttgtgaagggccggttcactatgtcacgcgaccattttatcgatacggtctatttggaaatgaacggcttaaccgtggaggacacagctgtttactattgtgtgcgagtcactttctaccacgaggggagcggatattactaccgtgccggtaattattttgatagttggggcaaagggaccagagtggtagtttccgca

SEQ ID NO: 27295 - RNA, 387 nt, synthetic construct
  misc_feature 1..387: note = derived and/or modified sequence opt3 from anti-HIV_Chain
  source 1..387: mol_type = other RNA
gaggtgcagctgagcgaatccggcgggggattcgtcaagcccggtggctctctcagactttcatgcgaggccagtgggtttaccttcaacaattacgctatgagctgggttaggcaagcacctggaaaaggcctggaatgggtgtccgtaacatctgcccacggtgggtcggcgtattacggagagtttgtgaagggccggttcactatgtcacgcgaccattttatcgatacggtctatttggaaatgaaccgattaaccgtggaggacacagctgtttactattgtgtgcgtgtcactttctaccacgagggcagcgggtattactacagagccggaaattattttgatagttggggtaaaggcaccagggtggtagtttccgca

SEQ ID NO: 27296 - RNA, 387 nt, synthetic construct
  misc_feature 1..387: note = derived and/or modified sequence opt3 from anti-HIV_Chain
  source 1..387: mol_type = other RNA
gaggtgcagctgagcgaatccggcgggggagtcgttaagcccggtggctctctcagactttcatgcgaggccagtgggttcacctttagcaactacgctatgtcctgggtgaggcaagcacctggaaaaggcctggaatgggtatctgtgacaggtgggcacggaacttatggctactatggcgagttcgtcaaggggcggtttacgatctcgcgcgaccattcaatggataccgtgtacttgcagatgaatcgattacgtgttgaagacacagccgtgtattactgtgtcagaactccatattaccacgagagcagtggatactattacagggcgggtaactatttcgatttttggggcaaagggaccctggtgattgtatccgct

SEQ ID NO: 27297 - RNA, 387 nt, synthetic construct
  misc_feature 1..387: note = derived and/or modified sequence opt3 from anti-HIV_Chain
  source 1..387: mol_type = other RNA
gaggtgcagctgagcgaatccggcgggggattcgtcaagcccggtggctctctcagactttcatgcgaggccagtgggtttaccttcaacaattacgctatgggatgggttaggcaagcacctggcaaaggtctggaatgggtgagcgtaacatccgcccacgggggatctgcgtattttggcgagttcgtgaagggccggtttactatgtcgcgcgaccatttcatcgatacggtctacttggaaatgaaccgattaaccgtggaggacacagctgtttattactgtgtgcgtgtcactttttatcacgaggggtcaggatactattacagagccggtaattacttcgatagctggggccaggggaccctggtgattgtaagtgca

SEQ ID NO: 27298 - RNA, 387 nt, synthetic construct
  misc_feature 1..387: note = derived and/or modified sequence opt3 from anti-HIV_Chain
  source 1..387: mol_type = other RNA
caggtgcaactggtcgagagcggcgggggactcgttcagcccggtggctcccttagactgtcttgcgccgcttcagggttcacctttagtacacactggatgcattgggtgaggcaggcacctggaaagggcttggtatgggtgagccggatccactccgacggtcgctctacttcgtacgccgattcagtcaaagggcgattcacgattagccgtgacaacgcgaagaataccttatatctgcagatgaacagtctaagagctgaagatacagccgtgtactattgtgcaaggggagccgctgtttttggcgtggtcataatcggcgggatggacctctggggacaaggtactaccgtgacagtatcctctgcaagcaccaaaggc

SEQ ID NO: 27299 - RNA, 387 nt, synthetic construct
  misc_feature 1..387: note = derived and/or modified sequence opt3 from anti-HIV_Chain
  source 1..387: mol_type = other RNA
caggtgcaactggtcgaaagcggcggggccctcgttcagcccggaggttcccttagactgtcttgcgctgcatcaggcttcagttttagctcctacgccatgtcttgggtgaggcaggcgcctgggaagggattggaatgggtatcggctatctcacggagcggcggtagtacctattacgccgactccgtgaaagggcgcttcacaatttctatagataatagcaataacactttatatctgcagatgaactccctacgagtcgaggacacggcagtgtactattgtgccaagcgtgaggctttttactatggagcaggcggctacgggatggatgtttggggacaaggtaccacagtgactgtctcaagtgccagcaccaaaggc

SEQ ID NO: 27300 - RNA, 387 nt, synthetic construct
  misc_feature 1..387: note = derived and/or modified sequence opt3 from anti-HIV_Chain
  source 1..387: mol_type = other RNA
ttccagggccacctggtgcaaagcgggggaggtgtcaagaaacccggcacctccgttacactctcttgccttgcctcagagtacacttttacggagttcaccatccattggattagacaggctcctgggcagggaccactgtggttgggcttaataaagaggagtggtcggctgatgacaagctatcgctttcaggaccgactatccctccgtagagataggtctactgggaccgtgttcatggaactgcggtcgcttcgcacagacgataccgcagtatactattgtgccagagacggactgggcgaattggcgccggcttaccactatggcatcgatgcctgggggcaaggaactacagtgattgtcacctcagcaagcacgagt

SEQ ID NO: 27301 - RNA, 387 nt, synthetic construct
  misc_feature 1..387: note = derived and/or modified sequence opt3 from anti-HIV_Chain
  source 1..387: mol_type = other RNA
cagggcctgctcgtgcaaagcgggggaggtgtcaagaaacttggcacctccgttacaatctcttgcctggcctcagagtacactttcaacgaatttgtgattcactggataagacaggctcccgggcagggacctttgtggttaggcctgatcaagaggagtggtcggctaatgacgagctatcagttccaagaccgcctctccctgcgacgtgatagatctaccgggacagtatttatggagcttaggggactgcgggtggacgatactgcagtctactattgtgcccgcgacggcttgggcgaagtggcgccagcttacctctatgggattgatgcctggggacagggtaccacagttatcgtgacctcggcatcaactaaaggc

SEQ ID NO: 27302 - RNA, 387 nt, synthetic construct
  misc_feature 1..387: note = derived and/or modified sequence opt3 from anti-HIV_Chain
  source 1..387: mol_type = other RNA
aacttcatgctgacccagcccgccagcgtgtccggctctcctgggcaatcaatcacaattagttgcagcggaactggttccgacataggcgtctacaattatgtttcttggtaccagcagcacccagggaaggctccgagactcatgatctatgatgtgacgaacaggccctcgggagtatcaaatcggttcagcggcagtaaatccggtttcaccgcatctcttacaattagcgggctgcagggagacgatgaggccgactactattgttcctcatacagtagcactaacacctatgtgtttggcacaggcacccatgtcactgtgttggggcaacctaaggcgaatccaacagttaccttatttcccccttcttccgaggaactg

SEQ ID NO: 27303 - RNA, 387 nt, synthetic construct
  misc_feature 1..387: note = derived and/or modified sequence opt3 from anti-HIV_Chain
  source 1..387: mol_type = other RNA
cagagcgccctgacccaacccagatccgtgtctggctcacctgggcagagtgtcacaatcagctgcactggaacgtcctctgacgttggtgcttacaactatgtgtcgtggtacaggcagcacccaggcaaggcaccgaaactcatgattaatgatgtatcaaagcggcccagcggggtgcctgaccgcttcagtggatccaaatctggcaacaccgccagccttacaatatccggtctgcaggcggaggatgaagctgactattactgttgctcatatgccgggacttacagttatgtctttggaaccggcacaaaggtgaccgttttgggccaaccaaaagcaaatcccactgtgacattattccctccaagctctgaggaactg

SEQ ID NO: 27304 - RNA, 387 nt, synthetic construct
  misc_feature 1..387: note = derived and/or modified sequence opt3 from anti-HIV_Chain
  source 1..387: mol_type = other RNA
cagggccaactggtgcagagcgggggaggtctcaagaaacccggcacctccgtcacaatctcttgccttgcctcagagtacactttcaacgaatttgttattcactggataagacaggctcctgggcagggaccactgtggttgggcttaatcaagaggagtggtcggctgatgacggcatataatttccaagaccgcctaagcctccgacgtgatagatccaccgggacagtgtttatggagctgaggggacttcggccggacgatactgccgtatactattgtgcgcgcgacggcctgggcgaagtggctcccgattacagatatgggattgacgtctggggacagggttctaccgtgatcgttacagccgcatcgaccaaaggc

SEQ ID NO: 27305 - RNA, 387 nt, synthetic construct
  misc_feature 1..387: note = derived and/or modified sequence opt3 from anti-HIV_Chain
  source 1..387: mol_type = other RNA
aacttcatgctgacccagccccctagcgcctccggcgctccagggcaaagagtgacaatctcttgctcaggaggtccgagtaatgtcggcgggaactacgtttattggtacaggcagtttcccggaactgcacctaatctccttattctgcgggacgatcagcgcccaagcggcgtgcccgaccgattctccgcctctaagtcgggtaactcagcgagcttggctataagtgggttacgtcctgatgacgaggccttttatttctgtgcaacgtacgattccgacggatctatcagactgtttggcggcgggaccacactaactgtactcagccagccaaaagccgctccctccgtgaccctgttccctccatcaagtgaggaactt

SEQ ID NO: 27306 - RNA, 387 nt, synthetic construct
  misc_feature 1..387: note = derived and/or modified sequence opt3 from anti-HIV_Chain
  source 1..387: mol_type = other RNA
cagctggtgctcacccaaccccctagcgtctccggcgccccagggcagagagttacaatctcttgctcaggaggtccgagtaacgtgggcgggaatcttgtatactggtataagcagttccccggaactgctcctaaactgttgattaggcgggacgatcagcgcccaagcggcgtgcccgaccgattttccggttctaagtcggggaactcagcaagcctgacgataagtggactgcgtcctgatgacgaggccttctacttttgtgcgacctatgattcccaaggctctacaagactattcggcgggggaactgtcctcaccgtgctgagccagccaaaagctgccccctccgttacactttttcctccatcaagtgaagagtta

SEQ ID NO: 27307 - RNA, 387 nt, synthetic construct
  misc_feature 1..387: note = derived and/or modified sequence opt3 from anti-HIV_Chain
  source 1..387: mol_type = other RNA
aacttcatgctgacccagccccctagcgtgtccggcgccccagggcaaagagtcacaatctcttgctcaggaggtccgagtaatgttggcgggaacctcgtgtactggtataagcagtttcccggaactgctcctaaacttctgattaggcgggacgatcagcgcccaagcggcgtacccgaccgattctccggttctaagtcggggaatagcgcatcattggccataagtggattacgtcctgatgacgaggcgttttacttctgtgctacgtatgattcccacggctctatcagactgtttggcgggggaaccctactcacagtgctgagccagccaaaagccgcaccctccgtcactcttttccctccatcaagtgaggaactg

SEQ ID NO: 27308 - RNA, 387 nt, synthetic construct
  misc_feature 1..387: note = derived and/or modified sequence opt3 from anti-HIV_Chain
  source 1..387: mol_type = other RNA
cagagcgccctgaccagaacaccctccgtgtctggcgctcctgggcaaagggtcactatctcatgcagtggaggtccaagcaacgttggcgggaattacgtgtattggtaccagcagttcccgggagcagcccccaagctccttattcggcgcgacgatcagcgaccttccggcgtaccagaccgtttttctggttcgaaatcagggaacagcgcgagtctggctatatccggattgagattagatgacgaggcctattacttctgtgcaacgtatgattctggctggagcatcaggctgtttggcgggggaacccggctaacagtgctctcccaacccaaggccgctccttcagtcactctgttcccacccagtagcgaggaactt

SEQ ID NO: 27309 - RNA, 387 nt, synthetic construct
  misc_feature 1..387: note = derived and/or modified sequence opt3 from anti-HIV_Chain
  source 1..387: mol_type = other RNA
cagagcgccctgacccaacccccttccgtgtctgctacaccaggccagactgtcacgatctcatgcagtgggagcggatccaacgttggtggcaatcacgtgtactggtatagacagctcccgggggcagcccccacccttctgatttctaagacagaccataggccttcgcgggtaccagatcgcttctcagcgagcaaaagtggaaactccgcttctttggccataagcggcttacgacccgacgatgaggcaatctacttttgtgccacttatgacaccggtctgtccctacgtctcttcgggggaggcacaagactgaccgtgctttcacagcctaaggctgcaccaagtgtcactctgtttccccctagctctgaagagttg

SEQ ID NO: 27310 - RNA, 387 nt, synthetic construct
  misc_feature 1..387: note = derived and/or modified sequence opt3 from anti-HIV_Chain
  source 1..387: mol_type = other RNA
caggtgcaactgctcgagagcggccccgggcttgtcaccccttccggaacactgtctttggcctgcgctgtttcaggtgcaagtatcagctcctctcactggtggacttgggtgagacagtcgccaggcaaggggttagaatggattggagagatagacaggcggggcacgaccaactacaatccgtcactgcgcagccgagtaacaatcctactcgataacagtaaaaatcagttctccctgtctcttcgtagcgtgactgccgcggacaccgctgtctattactgtacaaaggtgtatgccggtctgtttaacgaaagaacctacgggatggatgtttggggacatggcactacagtgttggtctcctcagcaagtaccaaaggc

SEQ ID NO: 27311 - RNA, 387 nt, synthetic construct
  misc_feature 1..387: note = derived and/or modified sequence opt3 from anti-HIV_Chain
  source 1..387: mol_type = other RNA
caggccgtggtcacccaaccccctagcgtttccgctacaccaggccagactgtgacgatctcttgctcagggagtggaagcaacgtaggtggcaatcacgtgtactggtatagacagctgccgggggcagcccccaccctccttatttccaagacaaacaggcggccttctcaggtcccagaccgcttctcgggatcaaaaagcggcaatagtgcgtccctggctatatctggtttgcgacccgatgacgaggccgattacttttgtgcaacttatgacaccgatttaagcctgcgtctattcgggggaggcacaagactcaccgtgctgtcccaacctaaggccgctccatcagttactctttttccccctagtagcgaggaactg

SEQ ID NO: 27312 - RNA, 387 nt, synthetic construct
  misc_feature 1..387: note = derived and/or modified sequence opt3 from anti-HIV_Chain
  source 1..387: mol_type = other RNA
cagagcgccctgacccaacccccttccgtgtctggcacaccagggcagaacgtcactatctcatgcagtggaggtggcagcgacgttgggggaaatctcgtgtcctggtaccagcacttcccgggcgctgcacccaaacttctgattcatagagataaccagaggccttctggtgtaccagaccggttttcggccttgaagtcagggaatagcgcgagtttagctatatccggactgcgctctgatgacgaggccttctatttttgtgcagtgtacgatagctccctatcactcggcctgttcggcgggggaacgaaacttaccgtcctgagtcaacccaaggccgctcctagcgtgacattgtttccaccctcttccgaggaactc

SEQ ID NO: 27313 - RNA, 387 nt, synthetic construct
  misc_feature 1..387: note = derived and/or modified sequence opt3 from anti-HIV_Chain
  source 1..387: mol_type = other RNA
cagagcgccctgacccaacccccttccgcttctggcacaccagggcagagagtgactatctcatgcagtggaggtggcagcaacattgggggaaatctcgtctcctggtaccagcacttcccgggcacggcacccaaacttctgatatataggaacgaccagcggccttctggtgttccagatcgcttttcggggtcaaagagcggaaccagtgcctccttgacaatctctggcttacgaagcgacgatgaggcgacttacttctgtgctgcctatgactcctcactgagtctacgtctctttggcgggggaaccacactgaatgtgcttagccaacccaaggcagccccttctgtaaccctgttcccaccctcctcagaagagttg

SEQ ID NO: 27314 - RNA, 387 nt, synthetic construct
  misc_feature 1..387: note = derived and/or modified sequence opt3 from anti-HIV_Chain
  source 1..387: mol_type = other RNA
cagagcgccctgacccaacccccttccgtgtctgctacaccaggccagactgtcacgatctcatgcagtgggagcggatccaacgttggtggcaatcacgtgtactggtatagacagctcccgggggcagcccccacccttctgatttctaagacaaaccataggccttcgcaggtaccagaccggttctcagcgagcaaaagtggaaattccgcttctttggccataagcggcttacgccccgatgacgaggcagattacttttgtggtacttatgacacctccctgtcactacgactcttcgggggaggcacacgtctgaccgtgcttagtcaacctaaggccgctccaagcgtcactctgtttcccccttcttccgaagagttg

SEQ ID NO: 27315 - RNA, 387 nt, synthetic construct
  misc_feature 1..387: note = derived and/or modified sequence opt3 from anti-HIV_Chain
  source 1..387: mol_type = other RNA
cagagcgtgctgacccaagtcctctccgtttctggcacacccgggcagagagtgatcatttcatgcagtggaactagctccaacgtaggtggcaatcttgtgtcttggtaccagcatctgcctggggccgctccaaggttgttaatacaccgggacgatcagcgcccgtcgggagtccccgaccgattctcaggcagcaagagtggtaactccgcatctctggtgatcagcgggctacgttccgatgacgaggccgattatttttgtggagcgtacgactcaacgttcagtctccctgtttttggcggcgggaccagactgacagtgcttagccaaccaaaagctgccccctctgtcactctgttccctccatcctcagaagagttg

SEQ ID NO: 27316 - RNA, 387 nt, synthetic construct
  misc_feature 1..387: note = derived and/or modified sequence opt3 from anti-HIV_Chain
  source 1..387: mol_type = other RNA
cagagcgccctgacccaaccccctgctacatccggcactccagggcagagagtgacgatctcttgctcaggaggtggcagtaacgtcgggggaaatctcgttagctggtaccagcagttcccgggcgcagcccccaaacttattctgcacagggacggtcaacggccttccggggtgccagatcgcttttctgcgtcgaagtcaggaaccagcgctagtttgacaatatccggcttacgatctgacgatgaggccacttatttctgtgcagcctttgacagcgctctgtccctacccctcttcggcgggggaaccaagctgacagtactttcacagcctaaagcagccccaagtgtgaccctgtttccccctagctctgaagagttg

SEQ ID NO: 27317 - RNA, 387 nt, synthetic construct
  misc_feature 1..387: note = derived and/or modified sequence opt3 from anti-HIV_Chain
  source 1..387: mol_type = other RNA
cagctggtgctcacccaaccccctagcgtctccgccacaccaggccagactgttacgatctcttgctcagggagtggaagcaacgtgggtggcaatcacgtatactggtatagacagcttccgggggctgcacccaccctggtgatttccaagacagaccataggccttctcgggtcccagatcgcttctcgggatcaaaaagcggcaacagtgcctccttggcgatatctggtttacgacccgacgatgaggctgcctacttttgtgcaacttatgacaccgggctgagcctacgtctcttcggaggcggcacaagactggccgtgctttcccagcctaaggctgcaccatcagttaccctgtttccccctagtagcgaagagttg

SEQ ID NO: 27318 - RNA, 387 nt, synthetic construct
  misc_feature 1..387: note = derived and/or modified sequence opt3 from anti-HIV_Chain
  source 1..387: mol_type = other RNA
cagagcgccctgacccaacccccttccgtgtctggcacaccagggcagaacgtcactatctcatgcagtggaggtggcagcaatgttgggggaaacctcgtgtcctggtaccagcacttcccgggcgctgcacccaaacttctgattcatagagacaatcagaggccttctggtgtaccagatcggttttcggtgttgaagtcagggaacagcgccagtttagcgatatccggaccccgctctgacgatgaggctttctatttttgtgccgtctacgacagctccctgtcactaggcctcttcggcgggggaacgaagctgaccgtgcttagtcaacctaaagcagccccaagcgttacactgtttcccccttcttccgaagagttg

SEQ ID NO: 27319 - RNA, 387 nt, synthetic construct
  misc_feature 1..387: note = derived and/or modified sequence opt3 from anti-HIV_Chain
  source 1..387: mol_type = other RNA
cagaccgtggtcacacaaccccctagcgcctccggcactccagggcagagagttacgatctcttgctcaggaggtggcagtaacattgggggaaatctggtgagctggtaccagcacttcccgggcgctgcacccaagctccttatatataggaacgaccagcggccttccggtgtaccagatcgcttttctgggtcgaaatcaggaaccagcgccagtctgacaatctccggcttgcgatctgacgatgaggcgacttacttctgtgctgcctatgactgcaccttaagcctgcgtctatttggcgggggaacaaccctcaatgtgctgtcccaacccaaggcagccccttcagtcactcttttcccacccagtagcgaggaactg

SEQ ID NO: 27320 - RNA, 387 nt, synthetic construct
  misc_feature 1..387: note = derived and/or modified sequence opt3 from anti-HIV_Chain
  source 1..387: mol_type = other RNA
cagagcgccctgacccaaacaccctccgtgtctggcgctcctgggcagagagtcactatctcatgcagtggaggtccaagcaacgttggcgggaattacgtgtattggtaccagcagttcccgggagcagcccccaagctccttattaggcgggacgatcaacgcccttccggcgtaccagaccgattttctggttcgaaatcagggaacagcgcgagtctggctatatccggattgcgtttagatgacgaggcctattacttctgtgcaacgtatgattctggctggagcatcagactgtttggcgggggaaccaggctaacagtgctctcccagcccaaggccgctccttcagtcactctgttcccacccagtagcgaggaactt

SEQ ID NO: 27321 - RNA, 387 nt, synthetic construct
  misc_feature 1..387: note = derived and/or modified sequence opt3 from anti-HIV_Chain
  source 1..387: mol_type = other RNA
cagagcgtgctgacccaacccccttccgcctctggcgctccagggcagagagtcacaatctcatgcagtggaggtccgagcaacgttggcgggaattacgtgtattggtacaggcagttccccggaactgcacctaacctccttattctgcgggacgatcagcgcccatccggcgtacccgaccgattttctgcctcgaagtcaggtaatagcgcgagtttggctatatccgggttacgtcctgatgacgaggccttctatttttgtgcaacgtacgattctgacggaagcgtgagactgttcggcggcgggaccacactaactgtcctctcccaaccaaaagccgctccctcagtgaccctgtttcctccaagtaacggaggtagg

SEQ ID NO: 27322 - RNA, 387 nt, synthetic construct
  misc_feature 1..387: note = derived and/or modified sequence opt3 from anti-HIV_Chain
  source 1..387: mol_type = other RNA
cagggccaactggtgcagagcgggggaggtgtcaagaaacccggcacctccgttacaatctcttgcctcgcctcagagtacactttcaacgaatttgtgattcactggataagacaggctcctgggcagggaccactttggctgggcttgatcaagaggagtggtcggttaatgacgagctataaattccaagaccgcctgaatctacgacgtgatagatccaccgggacagtatttatggagctcaggggactgcggccggacgatactgcagtgtactattgtgcccgcgacggccttggcgaagtcgcgcccgattacagatatgggattgacgtgtggggacagggttctaccgttatcgtgacagctgcctcgaccaagggc

SEQ ID NO: 27323 - RNA, 387 nt, synthetic construct
  misc_feature 1..387: note = derived and/or modified sequence opt3 from anti-HIV_Chain
  source 1..387: mol_type = other RNA
gaggtgcagctggtcgaaagcggcgccgaggttaagaaacccggggcttccgtgaaggtagcatgcaaagtgtctggaaagaaactctcagaccttagtatccactgggtcagacaagcccctggtaagggcctggaatggatgggagggttcgatgaggaagacggcaagattagctacgagaggaaatttcagggtcgggtgaccatgacagaggatactgcgcgcgacacggctttcatggaaatgtcctctttgcgatcggatgacaccgccgtttatttttgtgcagccgctccacgtttagatctgggggagctatcaagcggattccatttttggggcctcggcacactggtgagtgtctcctctgcaagcactaagggg

SEQ ID NO: 27324 - RNA, 387 nt, synthetic construct
  misc_feature 1..387: note = derived and/or modified sequence opt3 from anti-HIV_Chain
  source 1..387: mol_type = other RNA
cagggccaactggtgcagagcgggggaggtggcaagaaactcgggacctccgtcacaatctcttgccttgcctcagagtacactttcaacgaatttgttattcactggataagacaggctcccggacagggccctctgtggttgggtttaatcaagaggagtgggcggctgatgacgagctatcaattccaggaccgcctatccctccgacgtgatagatctaccggaacagtgtttatggagctgaggggccttcgggtagacgatactgcagtgtactattgtgcccgcgacggcctgggggaagtcgcgccagcttacttgtatggaattgatgcctggggtcagggcaccacagtgatcgtttcgtcagcaagcaccaaaggg

SEQ ID NO: 27325 - RNA, 387 nt, synthetic construct
  misc_feature 1..387: note = derived and/or modified sequence opt3 from anti-HIV_Chain
  source 1..387: mol_type = other RNA
gaggtgcagctggtcgaaagcggcgccgaggttaagaaacccggggcttccgtgaaggtatcttgcaaagtgtcaggatacaccctcagtgaccttagcatgcactgggtcagacaagcacctggtaagggcctggaatggatgggagggttcgatgaggaagacggcgagatcacatatgcccagaaatttcagggtagggtgtccatgactgaggatacgtctcgggacaccgcgtacatggaattgtcgtcattacgcagcgaggatacagctgtttattactgtgccactgcaccacgactggaactaggggagctcagttccggattccattattggggcctgggcacccttgtgacagtctctagcgcctccaccaagggg

SEQ ID NO: 27326 - RNA, 387 nt, synthetic construct
  misc_feature 1..387: note = derived and/or modified sequence opt3 from anti-HIV_Chain
  source 1..387: mol_type = other RNA
cagggccaactggtgcagagcgggggaggtgtcaagaaaaccggcacatccgttactatctcttgcctcgcctcagagtacacgttcaccgaatttacaattcactggataagacaggctcccgggcagggacctctttggctgggcttgatcaagaggagtggtcggttaatgactgcaaaccgcttccaagaccgactgagcctacgtagagataggtccaccgggacagtgtttatggagctccggtctctgcgcattgacgataccgccgtatattactgtgcgagagacggacttggcgaactggctccagcctatcattacggcatcgatgtgtgggggcagggaactacaattatcgtcacctcggcatcaacgaaaggt

SEQ ID NO: 27327 - RNA, 387 nt, synthetic construct
  misc_feature 1..387: note = derived and/or modified sequence opt3 from anti-HIV_Chain
  source 1..387: mol_type = other RNA
cagggccaactggtgcagagcgggggaggtgtcaagaaactcggcacctccgttacaatctcttgccttgcctcagagtacactttcaacgaatttgtgattcactggataagacaggctcccgggcagggacctctgtggttgggcttaatcaagaggagtggtcggctgatgacgagctatcaattccaggaccgcctatccctccgacgtgatagatctaccgggacagtatttatggagctgaggggacttcgggtggacgatactgcagtctactattgtgcccgcgacggcctgggcgaagtggcgccagcttacttgtatgggattgatgcctggggacagggtaccacagttatcgtgacctcggcatcaactaaaggc

SEQ ID NO: 27328 - RNA, 387 nt, synthetic construct
  misc_feature 1..387: note = derived and/or modified sequence opt3 from anti-HIV_Chain
  source 1..387: mol_type = other RNA
cagggccaactggtgcagagcgggggaggtgtcaagaaactcggcacctccgttacaatcccctgccttgcctctgagtacactttcaacgaatttgtgattcactggataagacaggctcctgggcagggaccactgtggttgggcttaatcaagaggtcaggtcggctgatgacgagttatcaattccaggaccgcctaagcctccgacgtgatagatccaccgggacagtatttatggagctgaggggacttcgggtggacgatactgcagtctactattgtgcccgcgacggcctgggcgaagtggcgccggcttacttgtatgggattgatgcctggggacagggtaccacagttatcgtgacctctgcatcgactaaaggc

SEQ ID NO: 27329 - RNA, 387 nt, synthetic construct
  misc_feature 1..387: note = derived and/or modified sequence opt3 from anti-HIV_Chain
  source 1..387: mol_type = other RNA
cagggccaactggtgcagagcgggggaggtgtcaagaaacccggcacctccgttacaatctcttgcctcgcctcagagtacactttcaacgaatttgtgattcactggataagacaggctcctgggcagggaccagtatggcttggcctgatcaagaggagtggtcggttgatgacgagctataaattccaagaccgcttatccctgcgacgtgatagatctaccgggacagtgtttatggagctaaggggactccggctggacgatactgcagtctactattgtgcccgcgacggccttggcgaagtggcgccggcttacctgtatgggattgatgcctggggacagggttcgaaggttatcgtgacccccgcatcaacaaaaggc

SEQ ID NO: 27330 - RNA, 387 nt, synthetic construct
  misc_feature 1..387: note = derived and/or modified sequence opt3 from anti-HIV_Chain
  source 1..387: mol_type = other RNA
caggccagactggaccaatggggcaccgggctccttaagcccagcgagacactgtccttgaaatgcgctgtgttcggagtcttatttactgattacaactggacgtgggttaggcagtctcctggtaaggaactggagtggatcggccacctagaccatcgcgggggaggcaattataacccatcactcgaaagtcgggtgaccattagcctggattactccaaagcacagttctctcttcacctgaagtcggtaacagtggccgacactgcgcgatattactgtgctggtgccgtcaaagggttttggttcgatgacccgtatacctggtttggaccctggtcacagggcacattggtgaccgttgcaagcgccagtactaagggc

SEQ ID NO: 27331 - RNA, 387 nt, synthetic construct
  misc_feature 1..387: note = derived and/or modified sequence opt3 from anti-HIV_Chain
  source 1..387: mol_type = other RNA
caggccagactggaccaatggggcaccgggctccttaagcccagcgagacactgtccttgaaatgcgctgtgttcggagtcttatttactgattacaactggacgtgggttaggcagtctcctggtaagggcctggaatggatcgggcacctagaccatcggggaggcggttcatataatccaagtctcgagagccgcgtgtccatttctctggattactcgaaagcacagttctcacttcacctgaaaagcgtaaccgtggccgacacagcgttgtattactgtgctggggccgtcaagggattttggttcgatgaaccgagtacttggtttggcccctggtcccagggcaccatggtgacagttgcatctgccagcaccaagggg

SEQ ID NO: 27332 - RNA, 387 nt, synthetic construct
  misc_feature 1..387: note = derived and/or modified sequence opt3 from anti-HIV_Chain
  source 1..387: mol_type = other RNA
cagggccacctggtgcaaagcgggggaggtgtcaagaaactcggcacctccgttacaatctcttgccttgcctcagaggacactttcaacgaatttgtgattcattggataagacaggctcccgggcagggacctctgtggttgggcttaatcaagaggagtggtcggctgatgacgagctaccagttccaagatcgcctatccctccgacgtgacagatctaccgggacagtatttatggagctgaggggacttcgggtggatgacactgcagtctattactgtgcccgcgatggcctgggcgaagtggcgccagcttatttgtacgggattgacgcctggggacagggtaccacagttatcgtgacctcggcatcaactaaaggc

SEQ ID NO: 27333 - RNA, 387 nt, synthetic construct
  misc_feature 1..387: note = derived and/or modified sequence opt3 from anti-HIV_Chain
  source 1..387: mol_type = other RNA
caggtgcaactggtccagagcgaggccgaagttaagaaacccggctcctctgtgaaggtatcatgcaaagctagtgggggaaccttcagaggttacacaatcagctgggtgaggcaggcacctggccaggggctcgagtggatgggacggattataccaatccttggcaaggccatttatgcgccgtcctttcaaggtcgcgtcactctgacggctgacaaatctaccgggacagcctacatggaattgtcgcgattacgttcagatgacactgcagtgtattactgtgccaaggttaagatgagaggaagcagtggctattactatctgttcgatgactggggccaggggaccctagtgacagtctcctctgctagcaccaaagga

SEQ ID NO: 27334 - RNA, 387 nt, synthetic construct
  misc_feature 1..387: note = derived and/or modified sequence opt3 from anti-HIV_Chain
  source 1..387: mol_type = other RNA
caggccagactggaccaatggggcaccgggctccttaagcccagcgagacactgtccttgaaatgcgctgtgttcggagtcttatttactgattacaactggacgtgggttaggcagtctcctggtaagggcctggaatggatcgggcacctagaccatcggggaggcggtaattataacccatcactcgagagtcgcgtgaccattagcctggattactccaaagcacagttctctcttcacctgaagtcggtaacagtggccgacactgcgttgtattactgtgctggggccgtcaaaggattttggttcgatgaagtgtataattggtttggcccgtggtcacagggcaccctcgttacagtggcaagcgccagtaccaagggg

SEQ ID NO: 27335 - RNA, 387 nt, synthetic construct
  misc_feature 1..387: note = derived and/or modified sequence opt3 from anti-HIV_Chain
  source 1..387: mol_type = other RNA
cagggccaactggtgcagagcgggggaggtgtcaagaaacccggcacctccgttacaatctcttgcctcgcctcagagtacactttcacggaatttaccattcactggataagacaggctcctgggcagggaccactttggctgggcttgatcaagaggagtggtcggttaatgacagcatatcgcttccaagaccgactgagcctacgtagagataggtccactgggaccgtgtttatggagctccggaacctgcgcatggacgatacagccgtatactattgtgcgagagacggacttggcgaactggctccggcctaccagtatggcattgatgtgtgggggcagggaaccactgtcatcgtgtcttcggcatcaacaaaaggt

SEQ ID NO: 27336 - RNA, 387 nt, synthetic construct
  misc_feature 1..387: note = derived and/or modified sequence opt3 from anti-HIV_Chain
  source 1..387: mol_type = other RNA
caggtgagactggtccaaagcggcccccaggttaagaggcctggggcctccatccggctctcttgcgagtcaagtggataccgcttccaggactatattgtggcttggatacgacagacccgtggtcaaggctttgagttcgtagggatggtgaacccaagaggaggcaggccgtggcccagctcccggtttcgcgatagagtcacacttactagggacatcgaatctgaaacgttctacctgggtttgaatgatttaacctcggacgatacagcaacttatttttgtgcccggctggaggcggacgggtcagattacagccctaaaatgttcgacttttggggacagggcaccaagattgtggttagtccagcttccacaaaaggc

SEQ ID NO: 27337 - RNA, 387 nt, synthetic construct
  misc_feature 1..387: note = derived and/or modified sequence opt3 from anti-HIV_Chain
  source 1..387: mol_type = other RNA
caggtgagactggtccaaagcggcccccaggttaagacccctggggcctccatgagggtgtcttgcgaggcttcaggataccggttcctcgactatatcattgtatggatacgccagacacacggtcagcattttgaatacgtgggcatgatcaacccacgagggggaactccgtggcccagtagcaaattccgtgatagactttccctgacgagggacattcacaccgatacattttatttgggcttaaataacctgggttctgacgatactgcaatctacttctgtgcccggctagaggcggacggggatgactattcgcctaagatgtttgatcattggggacaaggcacccgcattatcgtctcagctgccagcacaaaaggc

SEQ ID NO: 27338 - RNA, 387 nt, synthetic construct
  misc_feature 1..387: note = derived and/or modified sequence opt3 from anti-HIV_Chain
  source 1..387: mol_type = other RNA
caggtgagactggtccaaagcggcccccaggttaagacccctggggcctccatcaggctctcttgcgaggcttcaggataccggttccttgactattttattgtgtgggtacgccagacaccaggtcagggcttcgaatacgtggggatgataaacccgcgaggaggccgtccctggagtagctggaaatttagagataggctgtccttgactcgggagatcgacacggataccttctatttaggtctgtctaatctacgctcggacgatacagcaatttacttttgtgccagactcgaagcggacggggatgactattcacctaagatggtcgattactggggacaaggcactaaaatcattgtgagcgctgccagtaccaagggc

SEQ ID NO: 27339 - RNA, 387 nt, synthetic construct
  misc_feature 1..387: note = derived and/or modified sequence opt3 from anti-HIV_Chain
  source 1..387: mol_type = other RNA
caggtgagactggtccaaagcggcccccaggttaagaggcctggggcctccatccggctctcttgcgagacctcaggataccgcttccaggactatattgtggcttggatacgacagacacgtggtcaaagatttgagttcgtaggcatggtgaacccaaggggagggcggccgtggcccagtagcaaatttcgcgatagagtcactcttacgagggacatcgaatccgaaaccttccacctgggcttgaatgatttaacatctgacgatactgcaacctacttttgtgcccggctggaggcggacggtgctgattattcgcctaagatgttcgacttttgggggcagggaacaaaaattgtggtttcaccagccagcaccaagggc

SEQ ID NO: 27340 - RNA, 387 nt, synthetic construct
  misc_feature 1..387: note = derived and/or modified sequence opt3 from anti-HIV_Chain
  source 1..387: mol_type = other RNA
caggtgagactggtccaaagcggcccccaggttaagacccctggggcctccatgaggatctcttgcgaggcttcaggataccggttccaggactatattatagtgtggatccgccagacacacggtcaaggctttgaatacgtagggatgattaacccacgaggaggcactccgtggagtagctccaaattccgtgatagactctctcttacgagggacatctataccgatacattttacctgggtttgaataacttagggtcggacgatactgcaatttatttctgtgcccggctggaggcggacggaggcgattactcacccaagatgtttgactattggggccaggggacccgcatcatagtgagcgctgccagtacaaaagga

SEQ ID NO: 27341 - RNA, 387 nt, synthetic construct
  misc_feature 1..387: note = derived and/or modified sequence opt3 from anti-HIV_Chain
  source 1..387: mol_type = other RNA
cagggccaactggtgcagagcgggggaggtgtcaagaaacccggcgcctccgttaccatctcttgcctcgcttcagagtacacattcaacgaatttgtgattcactggataagacaggcacctgggcagggaccactttggctgggcttgatcaagaggagtggtcggttaatgactgcctataaattccaagaccgcctgagcctacgacgtgatagatccacggggaccgtatttatggagctcaggggactgcggccggaagacacagcggtgtactattgtgctcgcgatggccttggcgaggtcgcccccgactacagatatgggattgatgtgtggggacagggttctactgttatcgtgtcggcagcctcaaccaagggc

SEQ ID NO: 27342 - RNA, 387 nt, synthetic construct
  misc_feature 1..387: note = derived and/or modified sequence opt3 from anti-HIV_Chain
  source 1..387: mol_type = other RNA
caggtgagactggtccaaagcggcccccagatgaagacccctggggcctccctcaggctttcttgcgaggtttcaggataccggttcctggactattttatcgtgtgggtacgccagacaggtggccaggggttcgaatacgtgggaatgattaacccacgaggcggtcgtccgtggagtagctggaaatttagagataggttgtccttaactcgggacatagagacggataccttctatctggggctaaataacctccgctctgacgatacagctatctacttttgtgcaagactggaagccgacggagataattattcgcccaagatggtcgactactggggccaaggcactaaaattatcgtgagccctgcgtcaaccaagggg

SEQ ID NO: 27343 - RNA, 387 nt, synthetic construct
  misc_feature 1..387: note = derived and/or modified sequence opt3 from anti-HIV_Chain
  source 1..387: mol_type = other RNA
caggtgagcctggtccaatccggcccccaggttaagacccctggggcctctatgagagtgtcatgcgagacaagtggatacaggttcctcgactatatcattgtatggatacggcagactcacggtcagcattttgaatacgtgggcatgatcaacccacgcgggggaacgccgtggcccagctccaaattccgagatcgtcttaccatgacaagagacattcacactgataccttttatctgggcttgaataacttaaggtctgacgatacagctatctacttctgtgcacggctggaggccgacggtgatgactattcgcctaagatgtttgattactgggggcaaggaacccgcattatcgtctcagcggctagcactaaaggc

SEQ ID NO: 27344 - RNA, 387 nt, synthetic construct
  misc_feature 1..387: note = derived and/or modified sequence opt3 from anti-HIV_Chain
  source 1..387: mol_type = other RNA
caggtgagactggtccaaagcggcccccaggttaagaccgccggggcttccatgagggtgtcttgcgaggcatcaggataccggttcctcgactatatcattgtatggatacgccagacacacggtcagcattttgaatacgtgggcatgatcaaccctcgagggggaactccatggccgagtagcaaattccgtgatagacttacgctgaccagggacatttatacagatactttttacttgggcttaaataacctgggttccggggacaccgccatctatttctgtgcgcggctagaggctgatggagacgattactctcccaagatgtttgactattggggccaaggcacacgcattatcgtctcggccgcatcaaccaaaggg

SEQ ID NO: 27345 - RNA, 387 nt, synthetic construct
  misc_feature 1..387: note = derived and/or modified sequence opt3 from anti-HIV_Chain
  source 1..387: mol_type = other RNA
cagggccaactggtgcagagcgggggaggtgtcaagaaacccggcacctccgttacaatctcttgcctcgcctcagagtacactttcaacgaatttgtgattcactggataagacaggctcctgggcagggaccagtatggcttggcctgatcaagaggagtggtcggttgatgacgagctataaattccaagaccgcttatccctgcgacgtgatagatctaccgggacagtgtttatggagctaaggggactccggctggacgatactgcagtctactattgtgcccgcgacggccttggcgaagtggcgccggcttacctgtatgggattgatgcctggggacagggttcgaccgttatcgtgacatcagcaagcaccaagggc

SEQ ID NO: 27346 - RNA, 387 nt, synthetic construct
  misc_feature 1..387: note = derived and/or modified sequence opt3 from anti-HIV_Chain
  source 1..387: mol_type = other RNA
cagggccaactggtgcagagcgggggaggtctcaagaaacccggcacctccgtcacaatctcttgccttgcctcagagtacactttcaacgaatttgttattcactggataagacaggctcctgggcagggaccactgtggttgggcttaatcaagaggagtggtcggctgatgacggcatataatttccaagaccgcctacgactccgtagagataggagcaccgggacagtgtttatggagctgcggggacttcgcccggacgatactgccgtatactattgtgcgagagacggcctgggcgaagtggctcccgattacaggtatgggattgacgtctggggacagggttccaccgtgatcgttacagccgcatctaccaaaggc

SEQ ID NO: 27347 - RNA, 387 nt, synthetic construct
  misc_feature 1..387: note = derived and/or modified sequence opt3 from anti-HIV_Chain
  source 1..387: mol_type = other RNA
cagggccacctggtgcaaagcgggggaggtgtcaagaaactcggcacctccgttacaatctcttgccttgtgtcagagtacactttcaacgaatttgtaattcattggataagacaggcccccgggcagggacctctgtggttgggcttaatcaagaggagtggtcggctgatgacgagctatcagttccaagaccgcctatccctccgacgtgatagatctaccgggacagtgtttatggagctgaggggacttcgggtcgacgatactgctgtgtactattgtgcacgcgacggcctgggcgaagttgccccagcgtacttgtatgggattgatgcttggggacagggtaccacagtgatcgtcacctcggcctcaactaaaggc

SEQ ID NO: 27348 - RNA, 387 nt, synthetic construct
  misc_feature 1..387: note = derived and/or modified sequence opt3 from anti-HIV_Chain
  source 1..387: mol_type = other RNA
cagggccaactggtgcagagcgggggaggtgtcaagaaactcggcacctccgttacaatctcttgccttgcctcagagtacactttcaacgaatttgtgattcactggataagacaggctcccgggcagggacctctgtggttgggcttaatcaagaggagtggtcggctgatgacgagctatcaattccaggaccgcctatccctccgacgtgatagatctaccgggacagtatttatggagctgaggggacttcgggtggacgatactgcagtctactattgtgcccgcgacggcctgggcgaagtggcgccagcttacttgtatgggattgatgcctggggacagggtaccacagttatcgtgtcgtcagcaagcaccaaaggc

SEQ ID NO: 27349 - RNA, 387 nt, synthetic construct
  misc_feature 1..387: note = derived and/or modified sequence opt3 from anti-HIV_Chain
  source 1..387: mol_type = other RNA
cagggccacctggtgcaaagcgggggaggtgtcaagaaactcggcacctccgttacaatctcttgccttgcctcagagtacactttcaacgaatttgtgattcattggataagacaggctcccgggcagggacctctgtggttgggcttaatcaagaggagtggtcggctgatgacgagctatcagttccaagaccgcctatccctccgacgtgatagatctaccgggacagtatttatggagctgaggggacttcgggtggacgatactgcagtctactattgtgcccgcgacggcctgggcgaagtggcgccagcttacttgtatgggattgatgcctggggacagggtaccacagttatcgtgacctcggcatcaactaaaggc

SEQ ID NO: 27350 - RNA, 387 nt, synthetic construct
  misc_feature 1..387: note = derived and/or modified sequence opt3 from anti-HIV_Chain
  source 1..387: mol_type = other RNA
caggtgcaactggtccagagcggctccgagctcaagaaacccggggcctctgttaaggtgtcatgcaaagctagtggatacaccttcacaagctatgcaatcaactgggtaagacaggcccctggtcagggccttgaatggatggggtggattaatactaacacgggaaatccaacctacgcgcaaggctttacaggtaggttcgtgttttccctggagacttctgtctcgaccgcttatttgcagataaactcattaaaggccgaagacacagcagtgtactattgtgcccgggatctgctagagagccgcacctactataatgacatccgagattgctgggggcagggaactctcgttacagtgagttccgcttctaccaaaggc

SEQ ID NO: 27351 - RNA, 387 nt, synthetic construct
  misc_feature 1..387: note = derived and/or modified sequence opt3 from anti-HIV_Chain
  source 1..387: mol_type = other RNA
caggtgcaactggtccagagcggcgccgaggttaagaaacccggggcttccgtgaaggtatcttgcaaagcatcaggatacaccttcacagactattacatccactgggtgagacaggcccctggtcagggcctcgaatggatggggtggattaacccaagtactggaggcacgaattttgtccaaaagttccttggtagggtgaccatgacaagcgatacttccataaacaccgcgtatatggagctgcggcgcttgaaaaatgacgatgctgccatctactattgtgcaacatactctacccgacagtttttccattattactacgttactgacgtgtgggggcagggaacaaccgtcacggtgtcgtcagccagcactaagggc

SEQ ID NO: 27352 - RNA, 387 nt, synthetic construct
  misc_feature 1..387: note = derived and/or modified sequence opt3 from anti-HIV_Chain
  source 1..387: mol_type = other RNA
ttccagggccaactggtgcagagcgggggaggtgtcaagaaacccggctcctctgttaccatctcatgcctcgccagtgagtacacatttactgagttcacgattcactggataagacaggctcctgggcagggaccactttggctgggcttgatcaagaggagcggtcggttaatgacctcctatgggtttcaagaccgcctgtctgtgcgacgtgatagatcgacaggaactgtattcatggaactaaggtcactccggaccgacgatacagcagtgtactattgtgcccgcgacggcctgggcgaacttgcgccggcttaccattatgggattgatgtctggggacagggtaccactgtgatcgttacaagcgccagtacctcc

SEQ ID NO: 27353 - RNA, 387 nt, synthetic construct
  misc_feature 1..387: note = derived and/or modified sequence opt3 from anti-HIV_Chain
  source 1..387: mol_type = other RNA
caggtgcaactggtcgagagcggcgggggagttgtgcagcccggtagatccctcaggctttcttgcgccgcttcaggcttcacctttagtagctacgcaatgcactgggtacggcaggcccctgggaagggactggaatgggtggcggtcatctcctatgacggctctaacaaatactatgctgattcggtgaagggtcgcttcacaatttcacgagacgatagcaaaagtactgtttacttgcagataaattccttacgtgccgcagacacggccgtgtatttttgtgctagagaagggggactgaggttcctagagtggctcttttggggccaaggcaccctggtcacagtgtctagcggggagtcctcagcaagtactaaggga

SEQ ID NO: 27354 - RNA, 390 nt, synthetic construct
  misc_feature 1..390: note = derived and/or modified sequence opt3 from anti-HIV_Chain
  source 1..390: mol_type = other RNA
caggtgcaactggtccagagcggcgccgttgtgaagtcccccgggtcttcagctaaactcagttgcagacttctgggagacgagttcggtacctactttatcagctggattaggcaggcacctggccgggggttggaatgggtaggaggcatagtgccacactcccagttacaatcttcggcccagaagttccatggtcgctttttcatcacagggggagtcactccgcccattatctttctgcagctaacgaacgtgaccttcgaggatacaggcacttatttttgtgcgcgagaacgtggcagacacagggaccctaaaaccgggaagtcactccggggacgctacttcgatttttggggtagaggcacaggggttaccgtgagccca

SEQ ID NO: 27355 - RNA, 390 nt, synthetic construct
  misc_feature 1..390: note = derived and/or modified sequence opt3 from anti-HIV_Chain
  source 1..390: mol_type = other RNA
cagatcgagctgagacaaagcggcgccgctatgaagtcccccgggtcttcagtgaaactcagttgcaccgtccttggagaaaacttcggtacatactttattagctggataaggcaggcacctggccaggggctggagtgggttggaggcatcgtgccacactcccagttgcaatcttcggcccagaagttccatggtcggattaaaatctcagggggaggcactccgcccgtagtgagcttagaactgacgaatgtcacctttgacgatacaggcacttatttctgtgcgcgcgagcgagggcgtcacgtggaacctaagaccggagacagactagctggtaggtactttgatatttggggccgggggacaggactccgcgttagtcca

SEQ ID NO: 27356 - RNA, 390 nt, synthetic construct
  misc_feature 1..390: note = derived and/or modified sequence opt3 from anti-HIV_Chain
  source 1..390: mol_type = other RNA
gaggtgcagctggtcgaaagcggcgggggactcgttaagcccggtggctcccttagactgtcttgcgaggcctcagggttcacctttacaaacgcttggatgaattgggtgaggcaagcacctggaaaaggcttggaatgggtaggtcggatcaagagtcagactcacgggggaacgacccgctacgccgcgccagtgaaaggccgattcacaattagccgtgacgattccaagcatactttatatctgcagatggacagactaaccacagaggataccgctgtctactattgtactggcacaataaccgggtctacgttttactattacggaatggacgtgtggggtcagggcactaccgttacagtgtcgccggcctcaactaaaggg

SEQ ID NO: 27357 - RNA, 390 nt, synthetic construct
  misc_feature 1..390: note = derived and/or modified sequence opt3 from anti-HIV_Chain
  source 1..390: mol_type = other RNA
gtggtccagctggttcaaagcggccccgggctcgtgaagccttcccagaccctttctctgacatgcactgtatcaggaggtagtatcagctccggcgacttctactggtcttggattagacagccaccggggaaaggattggagtggataggctatatctactattcgggttcaacgtactataaccccagcttaaagagtaggctgaccatttccgtggatacatctaaaaatcagtttagcctacggctctcctcagtcactgccgctgacaccgcagtgtactattgtgcccgcgatctgaacagtcgaatcgttggggcgcttgacgctttcgatatttggggacaaggcacaatggtgaccgtcagctctgcctccactaagggc

SEQ ID NO: 27358 - RNA, 390 nt, synthetic construct
  misc_feature 1..390: note = derived and/or modified sequence opt3 from anti-HIV_Chain
  source 1..390: mol_type = other RNA
gaggtgcagctggtccaaagcggcgggggactcgttcagcccggtagatcccttaggctgtcttgcgccgcttcaggcttcacctttgacgattacgcaatgcactgggtgcggcaggcccctgggaagggattggaatgggtaagtggcatcagctggaactccggtacaattgggtatgcggactctgtgcgcggacgattcactatatcgcgtgatgacgctaaaagctcattatacctgcagatgaatagtctaagaacggaggataccgccctctattactgtgcaaaggacggctgggtcggctccgggtctagcacactgaggggatccgattattggggtcaaggcactcttgtgaccgtttcaagtgccagcacaaaaggg

SEQ ID NO: 27359 - RNA, 390 nt, synthetic construct
  misc_feature 1..390: note = derived and/or modified sequence opt3 from anti-HIV_Chain
  source 1..390: mol_type = other RNA
cagagcgtgctgacccaacccccttccgcctctggctcaccagggcagagtatcacaattagctgcactggaacgtcctctgacgtcggtggctacaactatgtttcgtggtaccagcagccgcccgggaaggctcctaaagtgataatctatgaggtatcaaagagaccaagcggagtgcccgataggttcagtggctccaaatctggtaataccgcaagcctcacagtctccgggcttcaagccgaagacgaggcggattactattgttcaagttacgctggaagcaacaattttgtgttcggcactggcaccgaagttacagtggtcgggcagcctaaggccaacccaaccgtgactctgtttcccccttcttccgaggaattgtta

SEQ ID NO: 27360 - RNA, 390 nt, synthetic construct
  misc_feature 1..390: note = derived and/or modified sequence opt3 from anti-HIV_Chain
  source 1..390: mol_type = other RNA
caggccgtggtcacccaagagcccagcctgacagtttcccctggcgggactgtgacgcttacctgcgcttcttcaacaggagcagtaacaagtggtttctacccacactggtttcagcagaagccgggccaggcccccagagcgcttatctatagcacctccaacaggtactcttggactcctgctcggttctcggggtcactgttgggaggcaaagccgcattaaccctgagcggtgtgcaaccagaagacgaggccgaatattactgtctactcctgccctattacgggggaccttggatttttggcggcgggactaagctcacagtcctgggacagccaaaagctgcacccagtgtgaccttgttccctccatcctctgaggaactc

SEQ ID NO: 27361 - RNA, 390 nt, synthetic construct
  misc_feature 1..390: note = derived and/or modified sequence opt3 from anti-HIV_Chain
  source 1..390: mol_type = other RNA
cagagcgccctgacccaacccccttccgcttctggcgcaccagggcagagagtgacaatctcatgcagtggaggtccgagcaacgtcggcgggaattacgtttattggtacaggcagttccccggaactgcccctacgctccttattctgcgggacgatcagcgcccatccggcgtgcccgaccgattttctgcgtcgaagtcaggtaacagcgctagtttggccatatccgggttacgtcctgatgacgagggattctatttttgtgcaacctacgattctgacggcagcatcagactgttcggcgggggaacagccctaactgtactctcccaaccaaaagctgcaccctcagtgaccctgtttcctccaagtagcgaggaacttaag

SEQ ID NO: 27362 - RNA, 390 nt, synthetic construct
  misc_feature 1..390: note = derived and/or modified sequence opt3 from anti-HIV_Chain
  source 1..390: mol_type = other RNA
caggtgcaactggtcgagagcggctccgacgttagaaagcccggggccaccgtgacagtatcttgcaaagctgatgaagacgaggatgacttcactgcatacaactattttatgcactgggtgaggcaggcccctggacatggtctcgaatggatcggctggattaatccacggacggggcagccgaaccacgcgaagcagttccaaggacgcgtcacccttacacgagagcgttcaaccagtactgtgtttatgaaactgacaaatttgagattagatgacaccgctgtttacttctgtgccaggcccctgcggggcggtgatacttggcattatcacagctgggggcgcggaacatccctaaccgtgtcttcggcatcaacgaagggc

SEQ ID NO: 27363 - RNA, 390 nt, synthetic construct
  misc_feature 1..390: note = derived and/or modified sequence opt3 from anti-HIV_Chain
  source 1..390: mol_type = other RNA
gaggtgcagctggtcgaaagcggctccgacgttagaaagcccggggccaccgtgacagtatcttgcaaagctgatgaggacgaagatgacttcactgcatacaactattttatgcactgggtgaggcaagcccctggacatggtctcgagtggatcggctggattaatccacggacggggcagccgaaccacgcgaagcagttccagggacgcgtcacccttacacgagaacgttcaaccagtactgtgtttatgaaactgacaaatttgagattagatgacaccgctgtttacttctgtgccaggcccctgcggggcggtgatacttggcattatcacagctgggggcgcggaacatccctaaccgtgtcttcggcatcaacgaagggc

SEQ ID NO: 27364 - RNA, 390 nt, synthetic construct
  misc_feature 1..390: note = derived and/or modified sequence opt3 from anti-HIV_Chain
  source 1..390: mol_type = other RNA
gaggtgcagctggtccaaagcggctccgacgttagaaagcccggggccaccgtgacagtatcttgcaaagctgatgaagacgaggatgacttcactgcatacgattattttatgcactgggtgaggcaggcccctggacatggtctcgaatggatcggctggattaacccacggacggggcagccgaatcacgcgaagcagttccaaggacgcgtcacccttacacgagagcgttcaaccagtactgtgtttatgaaactgacaaacttgagattagacgataccgctgtttacttctgtgccaggcccctgcggggcggtgacacttggcattatcacagctgggggcgcggaacatccctaaccgtgtcttcggcatcaacgaagggc

SEQ ID NO: 27365 - RNA, 390 nt, synthetic construct
  misc_feature 1..390: note = derived and/or modified sequence opt3 from anti-HIV_Chain
  source 1..390: mol_type = other RNA
caggtgcaactggtccagagcggctccgacgttagaaagcccggggccaccgtgacagtatcttgcaaagctgatgaggacgaagatgacttcactgcatacaactattttatgcactgggtgaggcaggcccctggacatggtctcgagtggatcggctggattaatccacggacggggcagccgaaccacgcgaagcaattccagggacgcgtcacccttacacgagaacgttcaaccagtactgtgtttatgaaactgacaaatttgagattagatgacaccgctgtttacttctgtgccaggcccctgcggggcggtgatacttggcattatcacagctgggggcgcggaacatccctaaccgtgtcttcggcatcaacgaagggc

SEQ ID NO: 27366 - RNA, 390 nt, synthetic construct
  misc_feature 1..390: note = derived and/or modified sequence opt3 from anti-HIV_Chain
  source 1..390: mol_type = other RNA
caggtgcaactggtccagagcggctccgacgttagaaagcccggggccaccgtgacagtatcttgcaaagctgatgaggacgaagatgacttcactgcatacaactattttatgcactgggtgaggcaggcccctggacatggtctcgagtggatcggctggattaatccacggacggggcagccgaaccacgcgaagcaattccagggacgcgtcacccttacacgagaacgttcaaccagtactgtgtttatgaaactgacaaatttgagattagatgacaccgctgtttacttctgtgccaggcccctgcggggcggtgatacttggcattatcacagccgcgggagaggaacatccctaaccgtgtcttcggcatcaacgaagggc

SEQ ID NO: 27367 - RNA, 390 nt, synthetic construct
  misc_feature 1..390: note = derived and/or modified sequence opt3 from anti-HIV_Chain
  source 1..390: mol_type = other RNA
gaggtgcagctggtcgaaagcggctccgacgttagaaagcccggggccaccgtgacagtatcttgcaaagctgatgaggacgaagatgacttcactgcatacaactattttatgcactgggtgaggcaagcccctggacagggtctcgagtggatcggctggattaatccacggacggggcagccgaaccatgcgaagcagttccaaggacgcgtcacccttacacgagaacgttcaaccagtactgtgtttatgaaactgacaaatttgagattagatgacaccgctgtttacttctgtgccaggcccctgcggggcggtgatacttggcactatcatagctgggggcgcggaacatccctaaccgtgtcttcggcatcaacgaagggc

SEQ ID NO: 27368 - RNA, 390 nt, synthetic construct
  misc_feature 1..390: note = derived and/or modified sequence opt3 from anti-HIV_Chain
  source 1..390: mol_type = other RNA
gtggtccagctggttcaaagcggctccgacgtgagaaagcccggggccaccgtaacagtgtcttgcaaagctgatgaggacgaagatgacttcactgcatacaactattttatgcactgggtcaggcaggcccctggacatggtctcgagtggatcggctggattaatccacggacggggcagccgaaccacgcgaagcagttccaaggacgcgtgacccttacacgagaacgttcaaccagtactgtttttatgaaactgacaaatttgagattagatgacaccgctgtgtacttctgtgccaggcccctgcggggcggtgatacttggcattatcacagctgggggcgcggaacatccctaaccgtctcttcggcatcaacgaagggc

SEQ ID NO: 27369 - RNA, 390 nt, synthetic construct
  misc_feature 1..390: note = derived and/or modified sequence opt3 from anti-HIV_Chain
  source 1..390: mol_type = other RNA
gaggtgcagctggtccaaagcggctccgacgttagaaagcccggggccaccgtgacagtatcttgcaaagctgatgaagacgaggatgacttcactgcatacaactattttatgcactgggtgaggcaggcccctggacatggtctcgaatggatcggctggattaatccacggacggggcagccgaaccacgcgaagcagttccaaggacgcgtcacccttacacgagagcgttcaaccagtactgtgtttatgaaactgacaaatttgagattagatgacaccgctgtttacttctgtgccaggcccctgcggggcggtgatacttggcattatcacagctgggggcgcggaacatccctaaccgtgtcttcggcatcaacgaagggc

SEQ ID NO: 27370 - RNA, 390 nt, synthetic construct
  misc_feature 1..390: note = derived and/or modified sequence opt3 from anti-HIV_Chain
  source 1..390: mol_type = other RNA
gaggtgcagctggtccaaagcggctccgacgttaagaaacccgggaccacagtgactatctcttgcaaggccgatgaagacgaggatgacttcacggcttacaactattttatgcactgggtaagacaggcacctggacagggtctcgaatggattggctggataaatccaaggaccgggcagccgaaccatgccaaacaacttcagggacgggtgacactgactcgcgagcgatcaaccagtacagtcttcatgaagttgaccaatttacgtctggatgacactgcggtgtacttttgtgctagacccctaaggggcggtgatacatggcactatcatagctgggggcggggaacctccctcatcgtttcttcggcctcaacgaaaggc

SEQ ID NO: 27371 - RNA, 390 nt, synthetic construct
  misc_feature 1..390: note = derived and/or modified sequence opt3 from anti-HIV_Chain
  source 1..390: mol_type = other RNA
caggtgcaactggtcgagagcggcgggggactcgttaagcccggtggctcccttagactgtcttgcgccgcttcagggttcagttttaacgaatactatatgagctggatcaggcaggcacctggacagggcttggagtgggtggccaatattggttcctctgacgcgtacaccatatatgctgattcggtaaaagggcggttcacaatctcacgcgacaacgccgaaaatactgtgtacttacagatgaacagcctgcgaggagaggatacggcagtctattactgtgcccgtattgaaggctattgcagtaattccagatgttctaactactttgacccatggggccaaggggctctagtgaccgttagctccgcatcaacaaaggga

SEQ ID NO: 27372 - RNA, 390 nt, synthetic construct
  misc_feature 1..390: note = derived and/or modified sequence opt3 from anti-HIV_Chain
  source 1..390: mol_type = other RNA
caggtgcaactggtccagagcggcgccgaggttaagaaacccggggcttccgtgaaggtatcttgcaaagtgtcaggataccctctcgcagaacttagtgtccactgggtgagacaggttccaggtaagggcctggagtgggtcgggggattcgacccggaagagggcaaaaccgtgtatgcccagaagtttcaaggtagggtgacaatgactgaagatcggagcacggacaccgtatacatggagttgatctccttacgctatgaggatacagcggtttactattgtgctactgacaaccccgtgctgcagctaggggaactctcttcgtcactggattactggggacagggcacccttgtcacagtgagcagtgcctccaccaagggc

SEQ ID NO: 27373 - RNA, 390 nt, synthetic construct
  misc_feature 1..390: note = derived and/or modified sequence opt3 from anti-HIV_Chain
  source 1..390: mol_type = other RNA
gaggtgcagctggtccaaagcggcgccgaagttaagaaacccggggagtccctcagaatctcttgcaagacctcaggatacaacttcaatgacgattggattgcttgggtgaggcagcggcctgacaaaggtccagaatggatgggcatattttatccgggggatagtcaggcaacatacagcccctccttccagggacacgtaactttttctgccgacacgtcgatctcaaccgcgtatcttcaatggacaagcctgaaggctagtgatactgccatttactattgtgcacgcacccgatgcttcggcgccaactgttttaatttcatggacgtgtggggtaaagggacagctttgaccgtcactgtgtcctctgcaagcacaaaggga

SEQ ID NO: 27374 - RNA, 390 nt, synthetic construct
  misc_feature 1..390: note = derived and/or modified sequence opt3 from anti-HIV_Chain
  source 1..390: mol_type = other RNA
caggtgcaactggtccagctccttcagagcggcgccgaggttaagaaacccgggtcctctgtgaaggtatcatgccagatcagtggatacggtttcagcaactatgctatttcctgggtgagacaagcacctggccaggggctggaatggttgggaaggatagtcccagccgtgggcatgaccgagtacgcgcagaaatttcagggtcgggttacattcactgctgaccgctctacgatcaccgcctatatggatttacgagggctgcgttcggacgatacagcagtgtactattgtgtcagagacccgcaagtggaagtaaggggaaatgcctttgatatttggggccagggcactatggttaccgtgtcaagcgctagtacaaagggg

SEQ ID NO: 27375 - RNA, 390 nt, synthetic construct
  misc_feature 1..390: note = derived and/or modified sequence opt3 from anti-HIV_Chain
  source 1..390: mol_type = other RNA
caggtgcatctgcaacagtggggcgccgggctccttaagcccagcgagaccctgtccttgacatgcgctgtctctggaggttcattcagtggctttttctggacttggatcagacagagccctgggaaaggattagaatggattggcgaggttaaccactccggttttacgcactctaatccatcgctggaatcaagggcaaccataagcgtggccgcgagtaacacacagttctccctacggctcgcttctgtaactgccgcagacaccgccatctacttttgtgctctgcgctatttcgattggagcccgtttcgacgtgacacatacgggaccgatgtgtggggacaaggcactacagtcattgtgtcctcagcaagtaccaagggc

SEQ ID NO: 27376 - RNA, 390 nt, synthetic construct
  misc_feature 1..390: note = derived and/or modified sequence opt3 from anti-HIV_Chain
  source 1..390: mol_type = other RNA
caggtgagactggagcaaagcggcggggccctcagaaagcccggagcttccgtcaccctttcttgccaggcatcaggttacaacttcgttaaatatatcattcactgggtgcggcagcgccctggcctggggtttgaatgggtaggaatgatagacccataccgaggccgtccgtggtatgcccatagtttcgcgggtagattgagcttatccagggatacatctactgagacgctgtacatgaccctatcgtcactcaagagcgacgatacagctacttatttttgtgcccgggcagaagccgctagtgactcccactctcgccccatcatggattggacctggaggattctgtgccttctggcagtggtccctgccagcacaaaaggg

SEQ ID NO: 27377 - RNA, 390 nt, synthetic construct
  misc_feature 1..390: note = derived and/or modified sequence opt3 from anti-HIV_Chain
  source 1..390: mol_type = other RNA
caggtgagactggagcaaagcggcgccgctgtcaggaagcccggggcatccgttaccctctcttgccaggcctcaggatacaacttcgtgaattatatcattcactgggtacggcagcgccctggtcttgactttgaatgggtgggcatgatagatccataccgagggcgtccgtggagtgcgcataaattccagggaagactgagcttgtccagggacgtctctacagagatcttatatatgactctgaactcgctacggtcagatgacacggctacctacttttgtgcccgcgcagaagccgagagccaaagtcactccagacccattatgttcgattcttggggccagggtagcagggtgacagtttcctcagctagtactaagggg

SEQ ID NO: 27378 - RNA, 390 nt, synthetic construct
  misc_feature 1..390: note = derived and/or modified sequence opt3 from anti-HIV_Chain
  source 1..390: mol_type = other RNA
caggtgagactggagcaaagcggcgccgctgtcaagaaacccggggcatccgttaccatctcttgccaggcctcaggatacaacttcgtgaagtttttcattcactgggtaaggcagcggcctggtcagggctttgaatgggtggggatgatagagccatatcgcggacgaccgtggagtgcgggcaatttccaaggtcgtctcagcctttccagagacgtctctacagaaactctgtacatgacgttgaacaatttaaggtcggatgacaccgctgtgtatttttgtgcccggctggaggcagaatcagatagccatagtcgccccatcatgttcgaccactgggggcatggatccctagttacagtgtctagcgcctccactaaaggc

SEQ ID NO: 27379 - RNA, 390 nt, synthetic construct
  misc_feature 1..390: note = derived and/or modified sequence opt3 from anti-HIV_Chain
  source 1..390: mol_type = other RNA
caggtgagactggagcaaagcggcgccgctgtcaggaagcccggggcatccgttaccctctcttgccaggcctcaggatacaacttcgtgaattatatcattcactgggtacggcagcgccctggtcttgactttgaatgggtgggcatgatagatccataccgagggcgtccgtggagtgcgcataaattcgagggaagactgagcttgtccagggacgtctctacagaagtgttatatatgactctgtcgtcactacggagcgatgacacggctacctacttttgtgcccgcgcagaggccgaaagtcagtcccactctagacccatcatgttcgattattggggccaaggtagcagggttacagtgtcctcagctagtactaagggg

SEQ ID NO: 27380 - RNA, 390 nt, synthetic construct
  misc_feature 1..390: note = derived and/or modified sequence opt3 from anti-HIV_Chain
  source 1..390: mol_type = other RNA
caggtgagactggagcaaagcggcaccgccgtcaggaagcccggggcttccgttacaatctcttgccaggcatcaggatacaacttcgtgaaatttttcattcacggtgtacggcagcgccctggccaggggtttgaatgggtgggaatgatagagccattccgaggccgtccgtggagtgccggtaattttcaagggagactcagcctttccagggacgtctctactgaaacgctgtatatgaccttgaacaatttacggtcggatgacacagcggtgtacttctgtgctcgcctggaggccgaatcagatagccatagtagacccatcatgtttgaccactggggacatggctccctagttactgtgtctagcgcatccaccaagggc

SEQ ID NO: 27381 - RNA, 390 nt, synthetic construct
  misc_feature 1..390: note = derived and/or modified sequence opt3 from anti-HIV_Chain
  source 1..390: mol_type = other RNA
caggtgagactggagcaaagcggcaccgccatgaggaagcccggggcttccgtcacactctcttgccaggcatcaggatacaacttcgttaaatatatcgtgcactgggtacggcagaagcctggtcttggctttgaatgggtggggatgattgacccataccgcggacgaccgtggagtgcccataaattccagggccgtctgagcttgtccagagatacttctatggagatattatatatgacgctgacctcgctaaagtcagacgatacagcgacttacttttgtgctagggccgaagcagccagcgacagtcactcccggcccatcatgttcgatcattggggtcaagggtctcgcgtcaccgtgagctccgcttcaacaaaagga

SEQ ID NO: 27382 - RNA, 390 nt, synthetic construct
  misc_feature 1..390: note = derived and/or modified sequence opt3 from anti-HIV_Chain
  source 1..390: mol_type = other RNA
caggtgagactggagcaaagcggcgccgctatgaggaagcccggggcatccgtcaccctctcttgccaggcctcaggatacaacttcgttaaatatatcgtgcactgggtacggcagaagcctggtcttggctttgaatgggtggggatgattgacccataccgcggacgaccgtggagtgcgcataaattccagggccgtctgagcttgtccagagatacatctatggagatattatatatgactctgacgtcgctaaagtcagacgataccgctacatacttttgtgccagggcagaagccgctagcgacagtcactcccggcccatcatgttcgatcattggggtcaagggtctcgcgtcactgtgagctccgcatcaaccaaagga

SEQ ID NO: 27383 - RNA, 390 nt, synthetic construct
  misc_feature 1..390: note = derived and/or modified sequence opt3 from anti-HIV_Chain
  source 1..390: mol_type = other RNA
caggtgagactggagcaaagcggcgccgctatgaggaagcccggggcatccgtcaccctctcttgccaggcctcaggatacaacttcgttaaatatatcattcactgggtgcggcagaagcctggtcttggctttgaatgggtagggatgatagacccataccgcggacgaccgtggagtgcgcataaattccagggccgtctgagcttgtccagagatacatctatggagatcttatatatgactctgacgtcgctaaagtcagacgataccgctacatacttttgtgccagggcagaagccgctagcgacagtcactcccggcccattatgttcgatcattggggtcaagggtctcgcgtgactgtcagctccgcatcaaccaaagga

SEQ ID NO: 27384 - RNA, 390 nt, synthetic construct
  misc_feature 1..390: note = derived and/or modified sequence opt3 from anti-HIV_Chain
  source 1..390: mol_type = other RNA
caggtgagactggagcaaagcggcaacgccgtcaggaagcccggggcttccgttaccatctcttgccaggcatcaggatacaatttcgtgaaatttttcattcactgggtacggcagcgccctggtcagggctttgaatgggtggggatgatagagccattccgaggacgtccgtggagtgccggcaactttcaaggtagactcagcctttccagggacgtctctacagaaactctgtatatgacgttgaataacttacggtcggatgacaccgcggtgtacttctgtgctcgcctggaggccgaatcagatagccatagtagacccatcatgtttgaccactgggggcatggatccctagttacagtgtctagcgcatccactaagggc

SEQ ID NO: 27385 - RNA, 390 nt, synthetic construct
  misc_feature 1..390: note = derived and/or modified sequence opt3 from anti-HIV_Chain
  source 1..390: mol_type = other RNA
caggtgagactggagcaaagcggcgccgctgtcaggaagcccggggcatccgttaccctctcttgccaggcctcaggatacaacttcgtgcggtatatcattcactgggtacgccagcgacctggtcttgactttgaatgggtgggcatgatagatccataccgtgggagaccgtggagtgcgcataaattcggaggcaggctgagcttgacacgggacgtctccactgagatcttatatatgacgctgacctctctacgctcggatgacacagctacttacttttgtgccagagcagaagccgagtcacagagccacagtaggcccattatgttcgattcctggggtcaagggtctcgggtgaccgttagctccgcttcaacaaaggga

SEQ ID NO: 27386 - RNA, 390 nt, synthetic construct
  misc_feature 1..390: note = derived and/or modified sequence opt3 from anti-HIV_Chain
  source 1..390: mol_type = other RNA
caggtgagactggagcaaagcggcgccgctgtcaggaagcccggggcatccgttaccctctcttgccaggcctcaggatacaacttcgtgaattatatcattcactgggtacggcagcgccctggtcttgactttgaatgggtgggcatgatagatccataccgagggcgtccgtggagtgcgcataaattccagggaagactgagcttgtccagggacgtctctacagagatcttatatatgactctgtcgtcactacggagcgatgacacggctacctacttttgtgcccgcgcagaagccgagagtcaatcccactctagacccattatgttcgatttttggggccagggtagcagggtgacagtttcctcagctagtactaagggg

SEQ ID NO: 27387 - RNA, 390 nt, synthetic construct
  misc_feature 1..390: note = derived and/or modified sequence opt3 from anti-HIV_Chain
  source 1..390: mol_type = other RNA
caggtgagactggagcaaagcggcaccgccgtcaggaagcccggggcttccgttacaatctcttgccaggcatcaggatacaacttcgtgaaatttttcattcactgggtacggcagcgccctggtcagggctttgaatgggtggggatgatagagccattccgaggacgtccgtggagtgccggcaattttcaaggtagactcagcctttccagggacgtctctactgaaacgctgtatatgaccttgaacaatttacggtcggatgacacagcggtgtacttctgtgctcgcctggaggccgaatcagatagccatagtagacccatcatgtttgaccactgggggcatggatccctagttactgtgtctagcgcatccaccaagggc

SEQ ID NO: 27388 - RNA, 390 nt, synthetic construct
  misc_feature 1..390: note = derived and/or modified sequence opt3 from anti-HIV_Chain
  source 1..390: mol_type = other RNA
caggtgagactggagcaaagcggcgccgctatgaggaagcccggggcatccgtcaccctctcttgccaggcctcaggatacaacttcgttaaatatatcgtgcactgggtacggcagaagcctggtcttggctttgaatgggtggggatgattgacccataccgcggacgaccgtggagtgcgcataaattccagggccgtctgagcttgtccagagatacatctatggagatattatatatgactctgacgtcgctaacctcagacgatacagctacttacttttgtgccagggcagaagccgctagcgacagtcactcccggcccatcatgttcgatcattggggtcaagggtctcgcgtcaccgtgagctccgcatcaacaaaggga

SEQ ID NO: 27389 - RNA, 390 nt, synthetic construct
  misc_feature 1..390: note = derived and/or modified sequence opt3 from anti-HIV_Chain
  source 1..390: mol_type = other RNA
gaggtgcagctggtccaaagcggcgggggactcgttcagcccggtggctcccttagactgtcttgcgccgcttcagggttgaccttcaggaattttgcaatgagttgggtgcggcaggcccctggaaagggcttagaatgggtaagctccatctctggttcagggggatcgacatactatgcggacagcgtgaaaggccgcttcactattagtcgagataattccaagaacacgctgtacctacagatgaactctctccgtggcgaggacaccgctgtctatttttgtgccaaaggggtgggatacgatatactgacaggtcttggcgacgcattcgatatctgggggcaaggaactgttgtggccgtcagctccgcttcaaccaagggc

SEQ ID NO: 27390 - RNA, 393 nt, synthetic construct
  misc_feature 1..393: note = derived and/or modified sequence opt3 from anti-HIV_Chain
  source 1..393: mol_type = other RNA
caggtgcaactggtccagagcggcgccgctgttagaaagcccggggcatccgtgaccgtatcttgcaaattcgccgaggacgatgactactcacctcactgggtgaacccagcgccggaacattatatccactttctcaggcaggctcccggacagcaacttgagtggctggcctggatgaatcctacaaacggtgcagtcaattacgcctggcagttgcatggccggttaactgctacgcgcgatgggagtatgaccacagcattcctggaagtgcgaagcctacgttccgacgatactgccgtttattactgtgctagagcccagaagaggggacggtctgagtgggcgtatgcacactggggccagggtaccccagtgctcgtctcgtca

SEQ ID NO: 27391 - RNA, 393 nt, synthetic construct
  misc_feature 1..393: note = derived and/or modified sequence opt3 from anti-HIV_Chain
  source 1..393: mol_type = other RNA
caggtgcaactgcagcagtggggcgccgggctccttaagcccagcgagaccctgtccttgacatgcgctgtctacgcaggatctttctcaggttattactggacttggatcagacagcctccaggcaaagggttagaatggattggagaggttaaccacggcggtagtacgaattataacccgagcctgaagtccagggtgaccctatctgtagacacatcgaaaaatcaattttcactcaagctgactagcgtgaccgccgcggatacagctgtctactattgtgcccgggtgagtcgctacgacttctggtccgggaactatggatcttacggccttgatgtttggggccaggggaccactgtgacagtcagctccgcatcaaccaaagga

SEQ ID NO: 27392 - RNA, 393 nt, synthetic construct
  misc_feature 1..393: note = derived and/or modified sequence opt3 from anti-HIV_Chain
  source 1..393: mol_type = other RNA
gaggtgcagctggtccaaagcggcgggggagttgtgcagcccggtagatccctcaggctttcttgcgtagtgtcaggcttcacctttagtagcttcacatttcactgggtccggcaggcccctgggaagggactggaatgggtggctggcatgtccttccatgcaacttacatctattacgccgactctgttaaaggtcgctttacgatttcgcgagatgactcacaggataccttgtatttagagatggacagcctgcgtagtgaagatacagcgatatactattgtgctagagacccagggatccacgattacggagactatgccccgggcgcattcgattactggggccaagggtcccccgtgactgtctctagcgcctccaccaaggga

SEQ ID NO: 27393 - RNA, 393 nt, synthetic construct
  misc_feature 1..393: note = derived and/or modified sequence opt3 from anti-HIV_Chain
  source 1..393: mol_type = other RNA
caggtgcaactggtccagagcggcaccgaggttcagaagcccggggcctccgtgaaagtatcttgcaagacatcaggatacactttcagtaaatattacatccactgggtgagacaggctcctggtcaaggcctcgaatgggtcgggaggattaacacggacagcggaggcaccgattatgcagagaagtttcagggtcgggtgacaatgactcgcgacacctccataacaaccgtttaccttgaaatgcgagggctgacttctgatgacacagccgcgttctattgtgctcgtggaccaccgcatgccggcggctggaccatctactattacgggttggatgtgtggggacagggtacgtcggtcattgtgtcaagcgcaagtactaaaggc

SEQ ID NO: 27394 - RNA, 393 nt, synthetic construct
  misc_feature 1..393: note = derived and/or modified sequence opt3 from anti-HIV_Chain
  source 1..393: mol_type = other RNA
agaaccgtggtcacacagccccctagcgtttccggcgccccagggcaaagggtgactatctcttgcacgggatcaagtagcaacattggtgctggctacgacgtacactggtatcagcagctgccggggaccgcacccaagctccttatatacggaaattccaaccggccttctggcgtgccagatcgcttctcgggttcaaaaagcgggacaagtgcctccctggcgatcactggattgcaggctgaggacgaagccgattattactgtcaatcttatgacagctccttatcaggcagtggcgtctttgggaccggaacaaaggtgaccgttctgggtcagcccaaagcaaatcctactgtgacactattcccacccagctctgaggaactc

SEQ ID NO: 27395 - RNA, 393 nt, synthetic construct
  misc_feature 1..393: note = derived and/or modified sequence opt3 from anti-HIV_Chain
  source 1..393: mol_type = other RNA
caggtgcagctgcagcagtggggcagcgggctccttaagccctccgagaccctgtctttgacatgcgccgtctacggaggttcattcagaagttattactggaactggatcaggcagagccctggcaaagggttagaatggattggagaggtttcccactctggctcgactaattataacccagctctgaagtcacgggtgacgataagcgtagacaccagtaaaaatcaattttccctaaaggtgaaatctgtcacagcagccgatactgcgctctactattgtagccgcggtcgagggaagcgttgctccggagcttactgtttcgccggctattttgactcatggggccaagggggactggtggttgtgagtagcgcatctaccaagggt

SEQ ID NO: 27396 - RNA, 393 nt, synthetic construct
  misc_feature 1..393: note = derived and/or modified sequence opt3 from anti-HIV_Chain
  source 1..393: mol_type = other RNA
caggtgcacctggtccaaagcggcgccgaggttaagaaacccgggtcctctgtgagagtatcatgcgaagctagtggatggaccttcggtagcgtgaactccgcaatcacatgggtcaggcaggcccctggccaggggctcgagtggatgggacggactattccatttcttggcatatctaattacgcgcagaagttccaaggtcgcgtgacgatcaccgctgacaaatcgacaaacattgcctatgttgatgtgacttcactgaccagccaggacacagcagtctactattgtgcccgattgatcaccgggatgactgctccgtggttttactatatggatgtgtggggaaagggcacaaccgtaacggttagttccgcatctactaaaggc

SEQ ID NO: 27397 - RNA, 393 nt, synthetic construct
  misc_feature 1..393: note = derived and/or modified sequence opt3 from anti-HIV_Chain
  source 1..393: mol_type = other RNA
caggtgcatctgcaagagagcggccccagactcgtcaggtcctctgaaaccctttcactgacatgcagtgttcctgggggaagcatcgtgaacccaattactaattactattggtcctggatacggcagtctccgcgcaagggtttgcagtggatcggcgacatttactatacggggacctcgtcacgaaaccccagcttagatagtcgtgtatccatctctatggacgtgagcagaaaacagatttccctgacactatactcagtcactgccgctgataccgcagtgcactattgtgccagtcaaagcctctcttggtacaggccttccggatatttcgagtcatggggccagggtatcctggttacagtgagcagtgcgtctaccaagggg

SEQ ID NO: 27398 - RNA, 393 nt, synthetic construct
  misc_feature 1..393: note = derived and/or modified sequence opt3 from anti-HIV_LightChain
  source 1..393: mol_type = other RNA
atgaagctgcccgtgagactccttgtcctgatgttctggatccctgccagctcctctgacattgttatgacccagtcaccattgagtttaccggtgacacccggcgagcctgctagcatatcctgcaggtcttcgcaacggctgctatcaagctacgggcacacttatctccattggtacctgcagaaaccaggacagagtccccagcttctgatctatgaagtatccaaccgcttttctggtgtgcctgatcgattcagcggctccgggtcaggaacggactttaccttgaagattagtcgtgtcgaggcagaagatgtgggcgtttactattgtagccaatctacacacgtgccactcactttcggtcaggggaccaaagtcgagatcaag

SEQ ID NO: 27399 - RNA, 396 nt, synthetic construct
  misc_feature 1..396: note = derived and/or modified sequence opt3 from anti-HIV_Chain
  source 1..396: mol_type = other RNA
caggtgcaactgcaggagagcggccccgggctcgtcaagccttccgaaaccctttctgttacatgctcagtgagtggagacagcatgaacaattactattggacttggatcagacagtccccaggtaaaggcctggagtggattgggtacatatctgatagggcctcggctacgtataacccgtcattgaatagccgggtagtgatcagtcgcgacacctccaagaaccagttatctctgaaactaaatagcgtcacacccgcagatactgccgtgtactattgtgcgaccgctcgacgtggacaaagaatttacggcgttgtgtccttcggtgaatttttctattactactcaatggacgtctgggggaagggaacaaccgtgactgtaagtagc

SEQ ID NO: 27400 - RNA, 396 nt, synthetic construct
  misc_feature 1..396: note = derived and/or modified sequence opt3 from anti-HIV_Chain
  source 1..396: mol_type = other RNA
caggtgcaactgcaggagagcggccccgggctcgtcaagcctccagaaaccctttccctgacatgctctgtttcaggagccagtgtgaacgacgcttactggagctggatcagacagtccccgggtaaaaggcccgagtgggtaggctatgtgcaccattctggggatactaattacaacccttcgttgaagcggcgcgtcacgttctcattagacaccgccaaaaatgaagtgagcctgaagctagttgcactcacagcggctgatagtgccgtgtatttttgtgcacgagccctgcacggaaaacgtatttacggcatagtcgctcttggtgagctgttcacttatttttacatggacgtgtgggggaagggaaccacagtaaccgtttcctct

SEQ ID NO: 27401 - RNA, 396 nt, synthetic construct
  misc_feature 1..396: note = derived and/or modified sequence opt3 from anti-HIV_Chain
  source 1..396: mol_type = other RNA
caggtgcaactgcaggagagcggccccgggctcgtcaagccttccgaaaccctttctctgacatgctcagttagtggagccagcatctccgactcttactggtcgtggattagaaggtcaccaggtaaaggcttggagtggatagggtatgtgcacaagagcggagatactaactacagtccgtccttaaaatctcgggtaaatctgagcctagacacgtccaagaaccaggtgtcactcagtctggtcgctgcaaccgccgcggatagcggcaaatattactgtgctcgcacacttcatggtcgacgtatctatgggattgtggccttcaatgaatggtttacttacttctatatggacgtttggggaaacggcacccaggtgacagtctcttcc

SEQ ID NO: 27402 - RNA, 396 nt, synthetic construct
  misc_feature 1..396: note = derived and/or modified sequence opt3 from anti-HIV_Chain
  source 1..396: mol_type = other RNA
caggtgcatctgcaagagagcggccccgggctcgtcaagccttccgaaaccctttctctgacatgcaacgtttcaggaactttggtgagagacaattactggagttggatgaggcagccattaggtaaacagccggagtggatcggctatgtacacgatagcggggacacgaactacaatccctccctgaagtctcgggtgcacctatcgctcgataaatcaaacaatctggtcagccttcgcctgaccgccgtgacagctgcagacagtgccacttattactgtgcgaccacaaagcatggacgacgtatttatggcatagttgctttcaacgaatggtttacctacttctatatggatgtgtggggtaaagggactacagtcaccgtgtcctct

SEQ ID NO: 27403 - RNA, 396 nt, synthetic construct
  misc_feature 1..396: note = derived and/or modified sequence opt3 from anti-HIV_Chain
  source 1..396: mol_type = other RNA
caggtgcaactgcaggagagcggccccgggctcgtcaagccttccgaaaccctttctgttacatgctcagtgagtggagacagcatgaacaattactattggacttggatcagacagtccccaggtaaaggcctggagtggattgggtacatatctgatagggaatcggccacgtataacccgtcattgaatagccgggtagtgatcagtcgcgacacctccacaaaccagttatctctgaagctaaatagcgtcactcccgctgataccgcagtgtactattgtgccacagcgcgacgtggacaaagaatttacggcgttgtgtccttcggtgagtttttctattactactcaatggacgtctgggggaggggaaccactgtgacagtaagtagc

SEQ ID NO: 27404 - RNA, 396 nt, synthetic construct
  misc_feature 1..396: note = derived and/or modified sequence opt3 from anti-HIV_Chain
  source 1..396: mol_type = other RNA
caggtgcaactggtcgagagcggccccgggctcgttaccccttccgaaacactttctctgacttgcacggtgtcaaacggaagtgtaagcggtagattctggtcctggatcaggcagtctccaggccgggggttggagtggattggatacttttcggacaccgatcgctcagaatatagcccgagtttacgatcccgtctgacactatctctcgacgccagcagaaatcagctgtcccttaagctgaaatcagtgactgctgcagatagtgccacctactattgtgcgagggctcagcaaggcaagcggatatacggtatcgtcagcttcggggagtttttctattactattacatggacgcctggggaaaaggcacagcagtgaccgtttcttcc

SEQ ID NO: 27405 - RNA, 396 nt, synthetic construct
  misc_feature 1..396: note = derived and/or modified sequence opt3 from anti-HIV_Chain
  source 1..396: mol_type = other RNA
caggtgcaactgcaggagagcggccccgggctcgtcaagcctccagaaaccctttccctgacatgctctgtttcaggagccagtatcaacgacgcttactggagctggattagacagtccccgggtaaaaggcccgagtgggtgggctatgtacaccattctggggatactaattacaacccttcgttgaagcggcgcgtgacgttctcattagacaccgccaaaaatgaagtcagcctgaagctagtggatctcacagcagcggacagtgctgtttatttttgtgcccgagcactgcacggaaaacgtatatacggcatcgtggcccttggtgagctgttcacttatttttacatggatgtctgggggaagggaaccacagtgaccgtatcctct

SEQ ID NO: 27406 - RNA, 396 nt, synthetic construct
  misc_feature 1..396: note = derived and/or modified sequence opt3 from anti-HIV_Chain
  source 1..396: mol_type = other RNA
caggtgcaactgcaggagagcggccccgggctcgtcaagcctccagaaaccctttccctgacatgctctgtttcaggagccagtatcaacgacgcttactggagctggattagacagtccccgggtaaaaggcccgagtgggtgggctatgtacaccattctggggatactaattacaacccttcgttgaagcggcgcgtgtcattcagcttagacacggccaaaaatgaagtcagtctgaagctagtggatctcaccgcagcggactccgctatatatttttgtgcccgagcactgcacggaaaacgtatctacggcattgttgcccttggtgagctgttcacatatttttacatggatgtgtgggggaagggaactaccgtcacagtgtctagc

SEQ ID NO: 27407 - RNA, 396 nt, synthetic construct
  misc_feature 1..396: note = derived and/or modified sequence opt3 from anti-HIV_Chain
  source 1..396: mol_type = other RNA
caggtgcaactgcaggagagcggccccgggctcgtcaagccttccgaaaccctttctgttacatgctcagtgagtggagacagcatgaacaattcctactggacttggatcagacagtctccaggtaaaggcctggagtggattgggtatatatcgaagtcagaaagcgccaactacaatccgagtttgaactccagggtagtgatctctcgggatacgagcaaaaatcagttatccctgaagctaaactcagtcacccccgctgacacagcagtgtattactgtgccactgcgcgccacggacaacgaatttatggcgttgtgagtttcggtgagtttttcacctactatagcatggatgtctgggggaaaggaacaaccgtgactgtatcttcc

SEQ ID NO: 27408 - RNA, 396 nt, synthetic construct
  misc_feature 1..396: note = derived and/or modified sequence opt3 from anti-HIV_Chain
  source 1..396: mol_type = other RNA
caggtgcaactgcaggagagcggccccgggctcgtcaagccttccgaaaccctttctctgacatgctcagttagtaacggaagcgtgtccggtagattctggtcttggatcaggcagtcgccaggccgggggttggagtggattggatacttttcagacactgagaaaagcaattataacccgagtttacgctcccgactgacgctatctgtagatgccagcaagaatcagctctccctgaaacttaactcagtgaccgctgcagacagtgccacatactattgtgcgcgtactcaacagggcaagagaatatacggtgtcgtgagcttcggggaatttttccactattactatatggatgcttggggaaaaggcaccgccgttacagtgtcttcc

SEQ ID NO: 27409 - RNA, 396 nt, synthetic construct
  misc_feature 1..396: note = derived and/or modified sequence opt3 from anti-HIV_Chain
  source 1..396: mol_type = other RNA
caggtgcaactggtccagagcggcaccgccctcaagtcccccgggtcttcagctaaacttagttgcacagttctgggagacgagttcggtacttactttatcagctggattagacaggcacctggccaggggttggaatgggtgggaggcatagtaccacactcccaattacagtcttcggcccagaagttccatggtaggatcattatctcagcgggggctggagtgacgccgcccgtcgtgagcctgcagctaaccaacctcacatttgaggatactggcacctatttctgtgcccgggaacgcggccgacaccgtgaccctaaaacaggggatgcactgagaggaaggtactttgacttctggggtcggggcaccggggttagtgtgtccgcc

SEQ ID NO: 27410 - RNA, 396 nt, synthetic construct
  misc_feature 1..396: note = derived and/or modified sequence opt3 from anti-HIV_Chain
  source 1..396: mol_type = other RNA
caggtgcaactggtccagagcggcaccgccctcaagtcccccgggtcttcagctaaacttagttgcacagttctgggagacgagttcggtacttactttatcagctggattagacaggcacctggccaggggttggaatgggtgggaggcatagtaccacactcccaattacagtcttcggcccagaagttccatggtaggatcattatctcagcgggggctggagtgacgccgcccgtcgtgagcctgcagctaaccaacctcacatttgaggatactggcacctatttctgtgcccgggaacgcggccgacaccgtgaccctaaaacagggaaggcaccaagaggaaggtactttgatttctggggtcggggcaccggggttactgtgagtgcc

SEQ ID NO: 27411 - RNA, 396 nt, synthetic construct
  misc_feature 1..396: note = derived and/or modified sequence opt3 from anti-HIV_Chain
  source 1..396: mol_type = other RNA
caggtgcaactggtccagagcggcaccgccctcaagtcccccgggtcttcagctaaacttagttgcacagttctgggagacgagttcggtacttactttatcagctggattagacaggcacctggccaggggttggaatgggtgggaggcatagtaccacactcccaattacagtcttcggcccagaagttccatggtaggatcacgatttcagcgggggctggagtgaccccgcccgtcgtgagcctgcagctaacaaacctcacttttgaggataccggcacatatttctgtgcccgggaacgcggccgacaccgtgaccctaaaaccggggatgcactgagaggaaggtactttgacttctggggtcggggcactggggttcgcgtgagtaca

SEQ ID NO: 27412 - RNA, 396 nt, synthetic construct
  misc_feature 1..396: note = derived and/or modified sequence opt3 from anti-HIV_Chain
  source 1..396: mol_type = other RNA
caggtgcaactggtccagagcggcgccgctgttaagtcccccgggtcttcagcaaaactcagttgcaccgtgcttggagacgagttcggtacatactttatcagctggattagacaggcccctggccaggggctggaatgggtaggaggcatagtgccacactcccaattgcagtcttcggcgcagaggttccatggtcggatcactatttcagctggggccggagtcacgccgcccgtggttagcttacagctgaccaacctaacatttgatgacgcaggcacttatttctgtgcccgcgagcgaggccgtcacagagatcctaagaccggggacgctctcaggggacggtactttgatttctggggtcgcggcacagggatcagtgtgtcccca

SEQ ID NO: 27413 - RNA, 396 nt, synthetic construct
  misc_feature 1..396: note = derived and/or modified sequence opt3 from anti-HIV_Chain
  source 1..396: mol_type = other RNA
gaggtgcagctggtccaaagcggcgccgaagttaagaaacccggggcttccgtgaaggtatcttgcaaagtgtcaggatacaccctcacagagcttagtatccactgggtcagacaggcacctggtaagggcctggaatggatgggagggttcgacccagaggatgacgaagccatttatgagccgaaatttcagggcaggttgactatgacggaggataccagcacagacactgcgtacatggaattatcctctctgcggtcggaggataccgctgtgtattactgtgccacagcagaccccttcaaggttgcccaggatgaaggtctatatgtgatatttgactactgggggcaaggaaccctcgtcactgtgtcaagcgctagtacaaagggc

SEQ ID NO: 27414 - RNA, 396 nt, synthetic construct
  misc_feature 1..396: note = derived and/or modified sequence opt3 from anti-HIV_Chain
  source 1..396: mol_type = other RNA
gaggtgcagctggtcgaaagcggcgggggactccttcaacccggtggctccctgagattgtcttgcgccgcttcagggttcagttttaacgacttcgagatgaattgggttaggcaggcacctggaaagggcttagaatgggtgagctacatctccaacgatggtaccatgattcactatgccgactctgtaaaagggcggtttacaatatcgcgcgataatgcgaagaaatcactgttcctacagatgaacagcctccgagctgaggacactgccgtgtactattgtgcacgtctggccgaagtcccaccggctatcagaggaagttactattacggcatggatgtgtggggccaggggacgaccgttacagtggcatccgcctctactaaggga

SEQ ID NO: 27415 - RNA, 396 nt, synthetic construct
  misc_feature 1..396: note = derived and/or modified sequence opt3 from anti-HIV_Chain
  source 1..396: mol_type = other RNA
caggtgcaactgatgcagagcggcgccgaggtcaagagacccggggcttccgttaaagtgtcttgcaaggcattcaggcactcactcaacaatcttggaatcagttggattcggcgcgcccctggtcgaggcctggaatggttggggtggataaacgtatacgagggaaataccaaatatggccgtagatttcagggtagggtgacaatgactacggaccggagcaccaacacagtctccatggaattacgctctctgacttcggatgacaccgcggtgtactattgtgctagagataatcatttctggtcagggagcagtaggtactattactttggaatggacgtttggggccagggcacaaccgtgatcgtctcctctgccagcactaagggg

SEQ ID NO: 27416 - RNA, 396 nt, synthetic construct
  misc_feature 1..396: note = derived and/or modified sequence opt3 from anti-HIV_Chain
  source 1..396: mol_type = other RNA
caggtgcaactggtccagtggggcgccgggctccttaagcccctggagaccttgagcttaacatgcgctgtttacggaggttccttcaacggctatttttggtcttggatcagacagactcctgggaaaggactggaatggattggcgagataaatcacggtgggtcagcaaacttcaatccaagtctaaagagcagggtgacgatgtccgtagacacctctaaaaaccagttttcgctcaagctggcctcagtgacagcggctgatactgccatctactattgtgcacggggacgcattaccatggtccgaggcgacccgcaacgtggcggggtgagaatggatgtttggggacagggtacaagcgtgaccgtcagttccgcctctactaaaggc

SEQ ID NO: 27417 - RNA, 396 nt, synthetic construct
  misc_feature 1..396: note = derived and/or modified sequence opt3 from anti-HIV_Chain
  source 1..396: mol_type = other RNA
ctggtgcagctcgtccaaagcggcgccgaggttaagaaacccggggcttccgtgaaggtatcttgcaaagtgtcaggacacacccttagtgaactgagcatcaactgggtcagacatgtgcctggtaagggcttggagtggatgggagggttagacccagaagatggcgaggcaattcacgaaccgaaattccagggtaggctgacaatgactgaggacacgtccaccgatacagcctactctactctatcggtttgggcgcccgtggctgccgcaatgtattactgtgccaccgctgacccttttaaggtcgcacaggatgaggggctctatgtgatattcgactactggggacagggcacactggtaaccgtttcaagcgccagtactaagggc

SEQ ID NO: 27418 - RNA, 396 nt, synthetic construct
  misc_feature 1..396: note = derived and/or modified sequence opt3 from anti-HIV_Chain
  source 1..396: mol_type = other RNA
caggtgcaactgctccagagcggcggggaggtcaagaaacccggagcctccgttaaggtgtcttgcaaagtatcaggttacacccttacagaactgagtatccactgggtgagacaggctcctggcaaggggttggagtggatgggaggcttcgacccagaagatgacgaggcaatttatgaaccgaaatttcagggtaggttaactatgacggaggataccagcacagacactgcctacatggagctgtcctctctacggtcggaagataccgcggtctattactgtgctacagccgaccccttcaaggtggcacaagatgaggggctctatgttatatttgactactggggacagggcaccctggtgactgtctcaagcgccagtacaaagggc

SEQ ID NO: 27419 - RNA, 396 nt, synthetic construct
  misc_feature 1..396: note = derived and/or modified sequence opt3 from anti-HIV_Chain
  source 1..396: mol_type = other RNA
caggtgcaactggtccagagcggcgccgaggttaagaaacccggggcttccgtgaaggtatcttgcaaagtgtcaggatacaccctcacagaacttagtatccactgggtcagacaggcacctggtaagggcctggagtggatgggagggttcgacagcgaagatggcgaggccttttataaacagaacttccaaggtagggtgactatgacggaagacacctccacagatactgcgtacatggagttgcggcgcttacgatctgaggacaccgctgtttattactgtgccacagcagatcgttttaaggtggcccaggacgaagggctgttcgtcatttttgattattggggacagggcaccctagtgactgtatcgtcagctagcacaaagggc

SEQ ID NO: 27420 - RNA, 396 nt, synthetic construct
  misc_feature 1..396: note = derived and/or modified sequence opt3 from anti-HIV_Chain
  source 1..396: mol_type = other RNA
caggtgcacctggtccaaagcggcgccgaggttaagaaacccggggcttccgtgagagtatcttgcaaggcatcaggatacaccttcacaacttatggtatcagttgggtgaggcaggcccctggccaggggctcgaatggatgggatggattagcgcgcattccggcgacacgaactacgctcagaaacttcaagcccgggtcaccatgacaactgatacctctacaaataccgcatatatggagctgcgctcgttgacttcagacgatacagccgtgtactattgtgctcgagaccgtccaagacactactatgataggggtgggtactacagcccgtttgactattggggacagggcaccttagttacggtgagttccgcatctactaagggc

SEQ ID NO: 27421 - RNA, 396 nt, synthetic construct
  misc_feature 1..396: note = derived and/or modified sequence opt3 from anti-HIV_Chain
  source 1..396: mol_type = other RNA
ctggtgcagctccttcaaagcggcgccgaggtcaagaaacccggggcttccgttaaggtgtcttgcaaagtatcaggatacaccctgacagaattgagtatccactgggtgagacaggcacctggtaagggcttagagtggatgggagggttcgacccagaagatgacgaggccatttatgaaccgaaatttcagggcaggctgactatgacggaggataccagcacagacactgcgtacatggagctatcctctctccggtcggaagataccgctgtctattactgtgccacagcagaccccttcaaggtggcccaggatgagggtctgtatgttatatttgactactgggggcaaggaacccttgtgactgtctcaagcgctagtacaaagggc

SEQ ID NO: 27422 - RNA, 396 nt, synthetic construct
  misc_feature 1..396: note = derived and/or modified sequence opt3 from anti-HIV_Chain
  source 1..396: mol_type = other RNA
caggtgcaactggtccagagcggcgccgaggttaagaaacccggggcttccgtgaaggtatcttgcaaagtgtcaggacacaccctcagtgaacttagcatcaactgggtcagacatgtgcctggtaagggcctggagtggatgggagggttggacccagaagatggcgaggcaattcacgaaccgaaattccagggtaggttaacaatgactgaggacacgtccaccgatacagcctacgttgagctgtcttcgctacggtcagaagacactgcgatgtattactgtgctaccgccgatccctttaaggtggcacaggacgaggggctctatgtcatattcgattactggggacaaggcacactggtgaccgtaagcagtgcctccactaagggc

SEQ ID NO: 27423 - RNA, 396 nt, synthetic construct
  misc_feature 1..396: note = derived and/or modified sequence opt3 from anti-HIV_Chain
  source 1..396: mol_type = other RNA
caggtgcaactgctccagagcggcgccgaggtcaagaaacccggggcttccgttaaggtgtcttgcaaagtatcaggatacacccttacagaactgagtatcaactgggtgagacaggcacctggtaagggcttggagtggatgggagggttcgacccagaagatgacgaggccatttatgaaccgaaatttcagggcaggttaactatgacggaggataccagcacagacactgcgtacatggagctgtcctctctacggtcggaagataccgctgtctattactgtgccacagcagaccccttcaaggtggcccaagatgagggtctctatgttatatttgactactgggggcagggaaccctggtgactgtctcaagcgctagtacaaagggc

SEQ ID NO: 27424 - RNA, 396 nt, synthetic construct
  misc_feature 1..396: note = derived and/or modified sequence opt3 from anti-HIV_Chain
  source 1..396: mol_type = other RNA
cagccccaactggtgcagagcggctccggggccgaggtcaagaaacctggagcttctgttagaatctcatgcgaagcaagtgagtacaacgtgttcgaccactttatgcagtgggtaaggcaggccccaggtcaaggcctcgaatggatggggtggattaatccgcggggaggctatcccagctactcccctaccttccagggtcgccttacatttactcgacagccatcttgggatgactcgacgataaccttccatatggagctgcgtgggttgggacacgatgacacagcggtgtattactgtgctagaccccattcacctgatgacgcctggagcttagatgtctggggcaggggcactctggtgaccgttagttccgcatctacaaagggg

SEQ ID NO: 27425 - RNA, 396 nt, synthetic construct
  misc_feature 1..396: note = derived and/or modified sequence opt3 from anti-HIV_Chain
  source 1..396: mol_type = other RNA
cagccccaactggtgcagagcggctccggggccgaggtcaagaaacctggagcttctgttagaatctcatgcgaagcaagtgagtacaacgtgttcgaccactttatgcagtgggtaaggcaggccccaggtcaaggcctcgaatggatggggtggattaatccgcggggaggctatcccagctactcccctcgcttccagggtcgacttacctttacacgtcagccatcttgggatgactcgtcagtgactttccatatggagctgagagggttgaggcacgatgacacggcggtctattactgtgctcggccccatagccctgatgacgcctggagtttagatgtgtggggacgcggcaccctggttacagtgtcctctgcaagcactaagggc

SEQ ID NO: 27426 - RNA, 396 nt, synthetic construct
  misc_feature 1..396: note = derived and/or modified sequence opt3 from anti-HIV_Chain
  source 1..396: mol_type = other RNA
gaggtgcagctggtcgaaagcggcgggggagttgtggagcccggtgaatccctcagactttcttgcgccgcttcaggcttcacctttaggagttacgacatgttctgggtacggcaagcaacaggaaagagcctggagtgggtgtccgccatcgggattgcgggcgatacttattactctggttcggtcaaagggcgctttacgatatcacgagaaaacgctcgtaccagcttgtatttacagctgagtggactaagagtggaggactccgccgtttacttctgtgtgaggggctctcctccacggatcgcagccacagagtataattactattacggcctcgatgtctgggggcagggaactaccgtgagcgtattttccgcttcaacaaagggt

SEQ ID NO: 27427 - RNA, 396 nt, synthetic construct
  misc_feature 1..396: note = derived and/or modified sequence opt3 from anti-HIV_Chain
  source 1..396: mol_type = other RNA
caggtgcaactggtccagagcggcgccgaggttaagaaacccgggtcctctgtgaaggtatcatgcaaagctagtggaggtaccttcacaacttacgacatcagctgggtgagacaggcacctggccaggggctcgaatggatgggaggcattcttccagattttggtgccccgtcctatgcgcaaaagttccaggacagggtcacgataaccacagatgagtcttcgtcaactgcttacatggaactgaacagcttgcggagtgaggacaccgccatctattactgtgcacgcgggcgaggagatgacttttggtccggcgaatctcccagctggtatttcgattactggggccaggggacattagtgaccgtttcctcagccagtactaaagga

SEQ ID NO: 27428 - RNA, 396 nt, synthetic construct
  misc_feature 1..396: note = derived and/or modified sequence opt3 from anti-HIV_Chain
  source 1..396: mol_type = other RNA
cagccccaactggtgcagagcggctccggggccgaggtcaagaaacctggagcttctgttagaatctcatgcgaagcaagtgagtacaacgtgttcgaccactttatgcagtgggtaaggcaggccccaatggaaggtctcgagtggatgggctggattaatccgcgcgggggatatcccagctactcccctaccttccaaggccggcttacatttactcgacagccatcttgggatgactcgacgataaccttccatatggaactgcgtggtttgagacacgatgacacagcggtgtattactgtgctaggccccattcacctgatgacgcctggagcttagatgtctgggggcggggaactctggtgaccgttagttccgcatctacaaagggc

SEQ ID NO: 27429 - RNA, 396 nt, synthetic construct
  misc_feature 1..396: note = derived and/or modified sequence opt3 from anti-HIV_Chain
  source 1..396: mol_type = other RNA
gaggtgagactgctcgaaagcggcgggggacttgtccagcccggtggctccctgaggttgtcttgctcagccagtgggttcacctttagcaactccgctttatcttgggttcggcaagcacctggaaagggcctggagtgggtgtcgtcagtagtgagcagtggtggggacacattctacgccgattccgtcaaaggacgctttactatctctcgagacaatagccgtaacacgctatatctccagatgaagtccctgagagcggaagataccgctctttactattgtgccaaagtgcagattcagcaactgaatttcggcgttataacagacgcaggcatggatgtgtgggggaagggaactaccgtcatcgtgtcaagtgccagcacaaaaggt

SEQ ID NO: 27430 - RNA, 396 nt, synthetic construct
  misc_feature 1..396: note = derived and/or modified sequence opt3 from anti-HIV_Chain
  source 1..396: mol_type = other RNA
caggtgcaactggtcgagagcggcgggggagttgtgcagcccggtagatccctcaggctttcttgcgtaggctcagggttcacctttagtagctccggaatgcactgggtgcggcaggcccctggcaagggtctggaatgggtcgctgtgatctcttcggacgggtcagatgagtactatggagacagcgttgaaggccgcttcacaattagtcgagataactccaaaaatactttgtttttacagctggactctctagaggcagaagatagcgccgtgtactattgtgcgaagacgccaccgcattacgacgctctcaccggctatccctcctcagtcctggagttctgggggcttggaacactggtgactgtaagtagcgcctctaccaaaggt

SEQ ID NO: 27431 - RNA, 396 nt, synthetic construct
  misc_feature 1..396: note = derived and/or modified sequence opt3 from anti-HIV_Chain
  source 1..396: mol_type = other RNA
gaggtgcagctggtccaaagcggcgccgaagttaagaaacccgggtcctctgtgaaggtatcatgcaaagctagtggaggtaccttcacaacttacgacatcagctgggtgagacaggcacctggccaggggctcgagtggattggaggcatacttccagattttggtgccccgtcctatgcgcagaagttccaagacagggtcacgatcaccacagatgaatcttcgcggactgcttacatggagctgaactcattgcgcagcgaagacaccgccatttattactgtgcacgagggcgtggagatgacttttggagtggcgagtccccctcttggtatttcgattactggggccaggggacacaggtgaccgttagctccgcctcaactaaagga

SEQ ID NO: 27432 - RNA, 396 nt, synthetic construct
  misc_feature 1..396: note = derived and/or modified sequence opt3 from anti-HIV_Chain
  source 1..396: mol_type = other RNA
caggtgcaactgctccagagcggcaccgaggtcaagaaacccgggtcctctgttaaggtgtcatgcagagccagtggatggacacttggtaacagccctaattccgctatcggctgggtaaggcaggcaccagggcagggactggaatggattggccggataatcccgattttggacgtgactaactacgcccaaaaattccagggtcgcgtcacgatctctgcggataagtcgaccaatattgcttatatggagatcagctcattagggagtgaagacacagccttttactattgtgcacgagtgataactggaatgacctccccctggtacttctatatggatgtttggggcgagggcacaaccgtgatcgtctctagcgcctccactaaaggg

SEQ ID NO: 27433 - RNA, 396 nt, synthetic construct
  misc_feature 1..396: note = derived and/or modified sequence opt3 from anti-HIV_Chain
  source 1..396: mol_type = other RNA
caggtgcacctggtccaaagcggcgccgaggttaagaaacccgggtcctctgtgagagtatcatgcaaggctagtggatggaccttcggtgacagcgtgaactccgcaatcacatgggtcaggcaggcccctggccaggggctcgaatggatgggacggtttattccaatacttggcctgtctaattacgcgcagaaattccaagatcgcgtgactatcaacgttgaccgatcgacgaataccgcttatatggagttgtcaggtttacgtagcgaagatacagccgtgtactattgtgcaagactgattactgggatgaacgccccgtggttttactatatggacgtctggggaaagggcaccacaatcaccgtgagttccgcttctactaaaggc

SEQ ID NO: 27434 - RNA, 396 nt, synthetic construct
  misc_feature 1..396: note = derived and/or modified sequence opt3 from anti-HIV_Chain
  source 1..396: mol_type = other RNA
caggtgcacctggtccaaagcggcgccgaggctaagagacccgggtcctctgttagggtgtcatgccgggcaagtggaggtgacttcagctcctacaccctctcttgggtacgccaggcccctggccaggggcttgaacgaatgggaggcgtggtcccaatgctggatacagtgcattatgcgcagaaatttcaaggtcgtttgactttatcggttgacgaggggacgtcaaccgcttacatggaactgagcagtctaagatccgaggatacagccatgtattactgtactaggggacggcagaccttccgcgcaatctggtctggcccgcccgtggtctttgacatttggggccaggggacactcgtgagcgtatcctcagccagtaccaaggga

SEQ ID NO: 27435 - RNA, 396 nt, synthetic construct
  misc_feature 1..396: note = derived and/or modified sequence opt3 from anti-HIV_Chain
  source 1..396: mol_type = other RNA
caggtgcacctggtccaaagcggcgccgaggctaagagacccgggtcctctgttagggtgtcatgccgggcaagtggaggtgacttcagctcctacaccctctcttgggtacgccaggcccctggccaggggatcgaatggatgggaggcgtggtcccaatgcttgatacagtgcattatgcgcagaaatttcaaggtcgactgactttgtcggttgacgaggggacgtcaaccgcttacatggaattaagcagtctgcgttccgaggatacagccatgtattactgtactagaggaaggcagaccttccgggcaatttggtctggcccgcccgccgtgtttgacatatggggccaggggaccctagtcatcgtgagctccgcttcaacaaaggga

SEQ ID NO: 27436 - RNA, 396 nt, synthetic construct
  misc_feature 1..396: note = derived and/or modified sequence opt3 from anti-HIV_Chain
  source 1..396: mol_type = other RNA
caggtgcaactggtccagagcggcgccgagctcaagaaacccgggtcctctgttaaggtgtcatgcaaagctagtggaggtaccttcaacaatcacacatttaactgggtaagacaggcacctggccaggggcttgaatggatgggaaggactatcccaattctgggcagccgggactacgccaagacgttccaagatcgcgtgaccataatcgcggacaaatccacatctactgtctatttggagttacgacgtctgaagtcggaagataccggtgtgtactattgtgctacatcaatgtactattttgacagcgggggatactatagaaataccgatctagacaagtggggccagggcagtctcgttactgtgtcctctgccagcacaaaaggg

SEQ ID NO: 27437 - RNA, 396 nt, synthetic construct
  misc_feature 1..396: note = derived and/or modified sequence opt3 from anti-HIV_Chain
  source 1..396: mol_type = other RNA
caggtgtacctggtccaaagcggccccgagctcaagaaacctggggcctccgttaagatctcttgcaaggcttcaggatataacttcccaaaatacgcaattcactgggtgagacaggccccgggtcagggccttcagtggatggggtggataaatggagacaacggcgatgcgaggtatagtcaaaaactgcagggtcgggtaacccccagcacagacacttccgcttctgtggtctacatggaattgaagcgcttacgatcggaggatacggccgtgtattactgtgcacgtgccctgtatccttgggaaatcgggggagttccatcaaccatgggcgacgattactggggccaggggacactaattactgtgagcagtgcttccaccaaggga

SEQ ID NO: 27438 - RNA, 396 nt, synthetic construct
  misc_feature 1..396: note = derived and/or modified sequence opt3 from anti-HIV_Chain
  source 1..396: mol_type = other RNA
caggtgcaactggtccagagcggccccgagctcatgaagcctgggtcctctgttaaagtgtcatgcagagccagtggagacaacttccttaccagcacatttaattggctgaggcaggctccaggtcagcggttggaatggatgggccgcttcatcccgtccttagggctgattacttctgcacccaagttttcggatcgactaacgataaccgccgaccaagcgacactcactgcttacatggagctgaccggacttacatcagaagataccgccctgtattactgtgcacgtggcttgtgcagaggtgggaactgtaggctcggacctagcggctggctggacccatggggccgggggactcaggtaacagtgagttccgcctctaccaaagga

SEQ ID NO: 27439 - RNA, 396 nt, synthetic construct
  misc_feature 1..396: note = derived and/or modified sequence opt3 from anti-HIV_Chain
  source 1..396: mol_type = other RNA
ggcgtgcacttccaggggcatctggtccaaagcggaggtggcgttaagaaacccgggtcctctgtgaccatctcatgcctcgccagtgagtacacatttactgagttcacgattcactggataagacaggctcctggacagggcccactttggctgggtttgatcaagaggagcgggcggttaatgacctcctatcgctttcaggaccgactgtctctacgtagagataggtcgacaggaactgtattcatggaactccggggcctgcgcattgacgataccgcagtgtactattgtgccagagacggccttggggaagtcgcgccggcttacctgtatggaatcgatgtgtggggtcaaggctcaacagttattgtgaccagcgccagtacttcc

SEQ ID NO: 27440 - RNA, 396 nt, synthetic construct
  misc_feature 1..396: note = derived and/or modified sequence opt3 from anti-HIV_Chain
  source 1..396: mol_type = other RNA
caggtgcaactgctccagagcggcgccgaggtcaagaaacccggggcttccgttaaggtgtcttgcaaagtatcaggatacacccttacagaactgagtatccactgggtgagacaggcacctggtaagggcttggagtggatgggagggttcgacccagaagatgacgaggccatttatgaaccgaaatttcagggcaggttaactatgacggaggataccagcacagacactgcgtacatggagctgtcctctctacggtcggaagataccgctgtctattactgtgccacagcagaccccttcaaggtggcccaagatgagggtctctatgttatatttgactactgggggcagggaaccctggtgactgtctcaagcgctagtacaaagggc

SEQ ID NO: 27441 - RNA, 396 nt, synthetic construct
  misc_feature 1..396: note = derived and/or modified sequence opt3 from anti-HIV_Chain
  source 1..396: mol_type = other RNA
caggtgcaactggtccagagcggcgccgaggttaagaaacccggggcttccgtgaaggtatcttgcaaagtgtcaggatacaccctcacagaacttagtatccactgggtcagacaggcacctggtaagggcctggagtggatgggagggttcgacccagaagatggcgaggccagctttgaaccgaaattccagggtaggttgactatgacggaggacacctccacagatactgcgtatatggagttatcttcgctgcggtcagaagacaccgctgtgtactattgtgccacagcagatccctttaaggttgcccaagacgaggggctatacgtgattttcgattattggggacagggcaccctcgtcactgtgagcagtgcttccacaaagggc

SEQ ID NO: 27442 - RNA, 396 nt, synthetic construct
  misc_feature 1..396: note = derived and/or modified sequence opt3 from anti-HIV_Chain
  source 1..396: mol_type = other RNA
ggcgtgcacttccaggggcatctggtccaaagcggaggtggcgttaagaaacccgggtcctctgtgaccatctcatgcctcgccagtgagtacacatttactgagttcacgattcactggataagacaggctcctggacagggcccactttggctgggtttgatcaagaggagcgggcggttaatgacctcctatcgctttcaggaccgactgtctctacgtagagataggtcgacaggaactgtattcatggaactccggggcctgcgcattgacgataccgcagtgtactattgtgccagagacggccttggggaagtcgcgccggcttacctgtatggaatcgatgtgtggggtcaaggcacaaccgttattgtgacttcagccagcacaagt

SEQ ID NO: 27443 - RNA, 396 nt, synthetic construct
  misc_feature 1..396: note = derived and/or modified sequence opt3 from anti-HIV_Chain
  source 1..396: mol_type = other RNA
caggtgcaactgggcgagagcgggggaggtctcgtcgaacccggcgggtcccttagactgtcttgcgccgcttcaggattcttgtttagtgactaccagatgagctggatcaggttagcacctggcaagggtctggagtggatttccttcatatctgggtttggatcggtttattacgccgattcagtggaaggccggttcaccatcagccgcgacaacgcgcgaaatagtctatatctccagatgaacaatctgcgtgctgaggatacagccgtatactattgtgcaagagcctacggcactgggaactggaggggactttattactactattacggtatggacgtgtggggccacgggacgaccgtcacagtgtcctctgctagcactaaagga

SEQ ID NO: 27444 - RNA, 399 nt, synthetic construct
  misc_feature 1..399: note = derived and/or modified sequence opt3 from anti-HIV_Chain
  source 1..399: mol_type = other RNA
caggtgcaactggtccagagcggcaccgccctcaagtcccccgggtcttcagctaaacttagttgcacagttctgggagacgagttcggtacttactttatcagctggattagacaggcacctggccaggggttggaatgggtgggaggcatagtaccacactcccaattacagtcttcggcccagaagttccatggtaggatcattatctcagcgggggctggagtgacgccgcccgtcgtgagcctgcagctaaccaacctcacatttgaggatactggcacctatttctgtgcccgggaacgcggccgacaccgtgaccctaaaacaggggatgcactgagaggaaggtactttgacttctggggtcggggcaccgggcttcgcgttagtacttcc

SEQ ID NO: 27445 - RNA, 399 nt, synthetic construct
  misc_feature 1..399: note = derived and/or modified sequence opt3 from anti-HIV_Chain
  source 1..399: mol_type = other RNA
gaggtgcagctggtccaaagcggcgggggactcgttaagcccggtggctcccttagactgtcttgcgccgcttcagggttcacctttaaaaacgcatggatgagttgggtgaggcaggcccctggaaagggcttggaatgggtaggtcacatcaaaagcaagacagacgggggaactattgattacgcggctccagtgaaaggccggttcacgatatcccgcgacgattctaagaataccttatatctgcagatgaactcgctaaagatcgaggacacagccgtctactattgtactaccgatattggctcagggcgaggatgggactttcattactatgatagcaatgactggggtcagggcacactcgtgaccgttagttccgcatctactaaaggg

SEQ ID NO: 27446 - RNA, 399 nt, synthetic construct
  misc_feature 1..399: note = derived and/or modified sequence opt3 from anti-HIV_Chain
  source 1..399: mol_type = other RNA
caggtgcaactggtcgagagcggcgggggagttgtgcagcccggtagatccctcaggcttttctgcgccgcttctggctttgcattcaatacctacgggatgcactgggtacggcaggcccctggaaagggcctggaatgggtggcggtcacatggcatgacggttcacagaaatattacgctgatagtgtgaaggggcgctttactatcagccgagacaattccaaaaacacgttgtatttacaaatgaactctctgcgtgccgaggataccgcaatttactattgtgcctcggaccagggaggcttcgatgactcaagcggctactttgctccagggggaatggatgtttggggtagaggcacaactgtgatagtcagttccgcaccgaccaagggg

SEQ ID NO: 27447 - RNA, 399 nt, synthetic construct
  misc_feature 1..399: note = derived and/or modified sequence opt3 from anti-HIV_Chain
  source 1..399: mol_type = other RNA
ggctacagcgaggtgcagctggtccaatccgggcccggactcgttaagccttctcagaccctttcactgacatgcactgtgagtggtggcagcatctccaacgggggacactattggaattggattagacagcatccaggcaaaggtttggaatggatagggcacatctacaacattgccacgacctattacaatccgtctttaaagtcgagggtatcaatcagcgtggacacaagtaaaaaccagttctccctgaagctatctagcgtcactgctgcagataccgccgtgtattactgtgcgcggggatccggccgctggacaattggcgctcgaatctattttgacaattgggggcaaggagccctcgttgcagtgtcaagtgccagcaccaaaggt

SEQ ID NO: 27448 - RNA, 399 nt, synthetic construct
  misc_feature 1..399: note = derived and/or modified sequence opt3 from anti-HIV_Chain
  source 1..399: mol_type = other RNA
cagctgcaactcaaggagagcggccccgggatggtgaaaccttccgaaaccctttctctgacatgctcagtcagtggagccagcgttgtgtccgctaacgactactggggttggatcagacaggcaccaggcaaggggttggagtgtattggaataatcttatatactggctctacgttctacaatccgtcgctgcagtcaagggtaaccattagccgggatcccagtaaaaaccacgtgtccctaacactcacttctgtcaccgccgcggacagcgctgtgtattactgcgcccgcatcccttatcattccgaatcatactataatgttgtgattggtgggtttgatgtctggggacagggcacacgagtgaccgtaagtagcgcatctactaagggc

SEQ ID NO: 27449 - RNA, 399 nt, synthetic construct
  misc_feature 1..399: note = derived and/or modified sequence opt3 from anti-HIV_Chain
  source 1..399: mol_type = other RNA
tgccaggtgcaactggtcgagagcggcgggggagttgtgcagcccggtagatccctcaggctttcttgtgtaggctcagggttcacctttagtagctccggaatgcactgggtgcggcaggcccctggcaagggtctggaatgggtcgctgtgatctcttcggacgggtcagatgagtactatggagacagcgttgaaggccgcttcacaattagtcgagataactccaaaaatactttgtttttacagctggactctctagaggcagaagatagcgccgtgtactattgcgcgaagacgccaccgcattacgacgctctcaccggctatccctcctcagtcctggagttctgggggcttggaacactggtgactgtaagtagcgcctctaccaaaggt

SEQ ID NO: 27450 - RNA, 399 nt, synthetic construct
  misc_feature 1..399: note = derived and/or modified sequence opt3 from anti-HIV_Chain
  source 1..399: mol_type = other RNA
caggtgcaactggtccagagcggcgccgacgttaagaaacccggggcttccgtgaaggtatcttgcaaagtgtcaggatacaccgtcagtgagctcagcatccactgggtgagacaggcacctggtaagggccttgaatggatgggagggttcgatccagaggacggcaaaacagtttccgcccagaactttcaaggtagggtgactatgacggaagataagtctaccgggacagcgaatatggagctgcggtcgttgcgctcagaagacactgctgtctattactgtgccaccacagtgcagttaattgtagatttctgcaacggaggcccgtgttataattttgacgattggggccaggggaccctggttactgtgagcagtgcatccacaaaggga

SEQ ID NO: 27451 - RNA, 399 nt, synthetic construct
  misc_feature 1..399: note = derived and/or modified sequence opt3 from anti-HIV_Chain
  source 1..399: mol_type = other RNA
ggcctggacctcgagcacgatgggcatcacaaggaagaacccagagccagcgtgaccgtctcctgcgaggcttctggatacaacttcgttaattatatcattcattgggtgaggcttacacctggtcggggctttgagtggatggggatgatagacccacgccgaggacgtccgtggtcagcacagaaattccaaggcagactgactttgacgagggatatcgacagtgaacggttatacatgcagctgagcggtctacgcggggatgacaccgccgtatatttttgtgcgagacaggagcccgatttccacgacggacatggccacacactcaggggcatgtttgattcctgggggcagggatctcctgtgtcggtctcaagcgctagtactaagggt

SEQ ID NO: 27452 - RNA, 399 nt, synthetic construct
  misc_feature 1..399: note = derived and/or modified sequence opt3 from anti-HIV_Chain
  source 1..399: mol_type = other RNA
caggtgagactggtccaaagcggcgcccagctcaagaaacccggggcttccgttaccgtgtcttgcgaggcatcaggatacaacttcgtaaattatatcattaactgggtgaggcagacacctggtcggagttttgaatgggtcggcatgatagacccacgccgagggcgtccgtggagcgcccagaagttccaaggaagacttactctgacgagggatatcgactccgagaaattgtacatgcacttatctggcctgcggggtgatgacaccgcggtgtattactgtgctcgccaggattcggactttcatgatgggcacggacatacactaagaggcatgttcgactcatggggccaggggagccccgttactgtgagttccgcctctaccaaggga

SEQ ID NO: 27453 - RNA, 399 nt, synthetic construct
  misc_feature 1..399: note = derived and/or modified sequence opt3 from anti-HIV_Chain
  source 1..399: mol_type = other RNA
caggtgagactgagccaatccggcgccgctgtcgttaagaccggggcatctgtgacaatctcatgcgagactgaaggatacacgttcgtaaactatattatacactgggtgaggcagccccctggtcggggctttgagtggctcgggatgatcgacccacgcaatggacatccgtggttcggccagcgatttcgtggtagacttagtctgaggcgggatcgcagcaccgaaacagtcttcatgactttgtccgggttaacctctgacgataacggaatttacttttgtgccagaaatgagccccagtattacgacggctcgggccactcactgcctgggatgttcgattattggggacaaggtacaagggtggttgtgagcagtgcgtccaccaaaggc

SEQ ID NO: 27454 - RNA, 399 nt, synthetic construct
  misc_feature 1..399: note = derived and/or modified sequence opt3 from anti-HIV_Chain
  source 1..399: mol_type = other RNA
caggtgagactgagccaatccggcgccgctgtcatgaagaccggggcatctgttacaatctcatgcgagactgaaggatacaacttcgtgaattatattatacactgggtaaggcggccccctggtcgcggctttgagtggctcgggatgatcgacccgaaaaacggacatccatggttcgcccaggcggtgcgaggccgtcttagtctgagaagggatacgtttaatgaagtcgtgtacatgaccttgagcggtttaacatccgacgatactgggctgtatttctgtgctcggaacgagccccagtaccacgacggaaatggccattctctacctggcatgtttgatttctgggggcagggaaccctcgttacagtgtcgtcagccagcaccaagggt

SEQ ID NO: 27455 - RNA, 399 nt, synthetic construct
  misc_feature 1..399: note = derived and/or modified sequence opt3 from anti-HIV_Chain
  source 1..399: mol_type = other RNA
caggtgagactgagccaatccggcgccgctgtcgttaagaccggggcatctgtgacaatctcatgcgagactgaaggatacacgttcgtaaactatattatacactgggtgaggcagccccctggtcggggctttgagtggctcgggatgatcgacccacgcaatggacatccgtggttcggccagcgacttcagggtcgtctgagtttgagaagggatcggagcaccgaaacagtctttatgactttatccgggctgacctctgacgatacaggaatttacttctgtgcccgcaacgagccccaatattacgacggctcgggccactcactacctgggatgtttgattattggggacagggtaccagagtggttgtgagcagtgcgtccactaaaggc

SEQ ID NO: 27456 - RNA, 399 nt, synthetic construct
  misc_feature 1..399: note = derived and/or modified sequence opt3 from anti-HIV_Chain
  source 1..399: mol_type = other RNA
caggtgagactgagccaatccggcgccgctgtcgttaagaccggggcatctgtgacaatctcatgcgagactgaaggatacacgttcgtaaaccacattatacattgggtgaggcagccccctggtcggggctttgagtggctcgggatgatcgacccacgcaatggacacccgtggttcggccagcgacttcgtggtagactgagtttgaggcgggatcgcagcaccgaaacagtctttatgactttatccgggctgacctctgacgatattggaatctatttctgtgccagaaacgagccccagtactttgacggctcgggccattcactacctgggatgttcgattattggggacaaggtacaagggtggttgtgagcagtgcgtccaccaaaggc

SEQ ID NO: 27457 - RNA, 399 nt, synthetic construct
  misc_feature 1..399: note = derived and/or modified sequence opt3 from anti-HIV_Chain
  source 1..399: mol_type = other RNA
caggtgcaattctttcagagcggctcctctatgaagaaatcaggggccagtgtcaccatcagctgcgaggctacaggatacaacattaagaatcacatactgcattgggttagacagaaacccggtaggggcttcgaatgggtggggatgatcgaccctattaacggacggccatggtttggccaggcattccgcggtcgactcactcttacgcgtgatctgtccaccgagacattttatatgtctttgtcggggttaacttcagacgataccgccacatacttctgtgcgagaagggaagctgactatcacgatggaaatggccataccctgccgggcatgtttgacttctgggggcccggaactctagtaacagtgagcagtgcctccaccaagggt

SEQ ID NO: 27458 - RNA, 399 nt, synthetic construct
  misc_feature 1..399: note = derived and/or modified sequence opt3 from anti-HIV_Chain
  source 1..399: mol_type = other RNA
caggtgagactgagccaatccggcgccgctgtcgttaagaccggggcatctgtgacaatctcatgcgagactgaaggatacacgttcgtaaactatattatacactgggtgaggcagagtcccggtcggggctttgagtggctcgggatgatcgaccctcgcaatggacatccatggttcggccagcgacttcgtggtagactgagcttgaggcgggatcgctccaccgaaacagtctttatgactttatctgggctgacctcggacgatacagccatttacttctgtgcgagaaacgagccgcagtattacgacggatcaggccacagcctacccggcatgtttgattattgggggcaaggaaccagggtggttgtgagttccgcttctactaaaggt

SEQ ID NO: 27459 - RNA, 399 nt, synthetic construct
  misc_feature 1..399: note = derived and/or modified sequence opt3 from anti-HIV_Chain
  source 1..399: mol_type = other RNA
caggtgagactgagccaatccggcgccgctatgaagaaacccggggcatctgtcaccatctcatgcgagacagaaggatacactttcattaactatataatccactgggttaggcagcctccaggtcggggctttgagtggctcgggatgattgacccgcgcaatggacgaccctggttcggccagagtgtgcagggtcgtcttagcctgagaagggatacgtacaccgaagtagtgtatatgacattgtccgggttaacttctgacgatgccggactgtacttttgtgcgcggaacgagcctcaatatcatgacggcaatggccactcgctaccagggatgttcgattactggggacagggtaccctcgtcgctgtgtcaagcgccagtacaaagggc

SEQ ID NO: 27460 - RNA, 399 nt, synthetic construct
  misc_feature 1..399: note = derived and/or modified sequence opt3 from anti-HIV_Chain
  source 1..399: mol_type = other RNA
caggtgagactggtccaaagcggcgcccagctcaagaaacccggggcttccgttaccgtgtcttgcgaggcatcaggatacaacttcgtaaattatatcattaactgggtgaggcagacacctggtcggggctttgaatgggtcgggatgatagacccacgccgaggacgtccgtggagtgcccagaagttccaaggcagacttactctgacgagggatatcgacagcgagaaattgtacatgcacttatccggtctgcgcggggatgacaccgcggtgtattactgtgctcggcaggattctgactttcatgatggacacggccatacactaagaggcatgttcgactcgtgggggcagggatcacccgttactgtgagcagtgcctccaccaagggt

SEQ ID NO: 27461 - RNA, 399 nt, synthetic construct
  misc_feature 1..399: note = derived and/or modified sequence opt3 from anti-HIV_Chain
  source 1..399: mol_type = other RNA
caggtgcacaccttccaaagcggctcctctatgaagaaatcaggggccagtgtcacaatcagctgcgaggctactggatacaacattaagaattatatactgcattgggttagacagaaacccggtaggggctttgaatgggtggggatgatcgaccctattaacggacggccatggttcggccagccgtttcgcggtcgactcacgcttacccgtgatctgtccacagagactttctacatgtctttgtcggggttaacctcagacgatacagcaacctatttttgtgccagaagggaagcggactaccacgatggaaatggccatactctgcccggcatgttcgacttttgggggcctggaacactaatcaccgtaagcagtgcttccacgaagggt

SEQ ID NO: 27462 - RNA, 399 nt, synthetic construct
  misc_feature 1..399: note = derived and/or modified sequence opt3 from anti-HIV_Chain
  source 1..399: mol_type = other RNA
caggtgagactgttccaaagcggcgccgctatgaagaaacccggggcatccgtcaccatctcttgcgaggcctcaggatacaactttatgaattatttcgttcactgggtgaggcagcggcctggtcgcggctttgaatggctcgggatgattaacccacgaggaggccgtccgtggagtgcgcagagcgtacagggtagacttacactgactagggacatatccacggagatgttctacatgcggttggatgggttacgctctgacgataccgctacatatttttgtgccagaaatgaagcagactaccatgatggaaacggccactcgctgaggggcatgttcgactattgggggcaaggatcactaatcactgtgagcagtgcctccaccaagggt

SEQ ID NO: 27463 - RNA, 399 nt, synthetic construct
  misc_feature 1..399: note = derived and/or modified sequence opt3 from anti-HIV_Chain
  source 1..399: mol_type = other RNA
caggtgcaactgttccagagcggcgccgctatgagaaagcccggggcatccgtcaccatctcttgcgaggcctcaggatacaactttatgaattatttcgttcactgggtgaggcagcggcctggtcgcggctttgaatggctcgggatgattaacccacgaggaggccgtccgtggagtgcgcagagcgtacaaggtagacttacactgactagggacacgtccaccgagatgttctacatgcggttggatgggttacgctctgacgatacagctacttatttttgtgccagaaatgaagcagactaccatgatggaaacggccactcgctgaggggcatgttcgactattgggggcagggatcactaataaccgtgagcagtgcctccacaaaaggt

SEQ ID NO: 27464 - RNA, 399 nt, synthetic construct
  misc_feature 1..399: note = derived and/or modified sequence opt3 from anti-HIV_Chain
  source 1..399: mol_type = other RNA
caggtgagactgagccaatccggcgccgctatcaagaaacccggggcatctgtcaccatttcatgcgagacagaaggatacactttcataaactatatcattcactgggttaggcagcctccaggtcggggctttgagtggctcgggatgatcgacccgcgcaatggacgaccctggttcggccagagtgtgcagggtcgtcttagcctgagaagggatacgtacaccgaagtagtgtatatgacattgtccgggttaacttctgacgataccggactgtacttttgtgcccggaacgagcctcaatatcatgacggcaatggccactcgctaccagggatgttcgattcatggggacagggtacactcgtcgcggtgagcagtgcttccaccaagggc

SEQ ID NO: 27465 - RNA, 399 nt, synthetic construct
  misc_feature 1..399: note = derived and/or modified sequence opt3 from anti-HIV_Chain
  source 1..399: mol_type = other RNA
caggtgagactgttccaaagcggcgccgctatgaggaagcccggggcatccgtcaccatctcttgcgaggcctcaggatacaactttctcaattatttcgttcactgggtgcggcagcgccctggtcgaggctttgaatggcttgggatgattaacccacgtggaggcagaccgtggagtgcgcagagcgtacagggtaggctgacattgactcgggacacgtccaccgagatgttctacatgcgcttagatgggctgagatctgacgatacagctacttatttttgtgccaggaatgaagcagactaccatgatggaaacggccactcgctacggggcatgttcgactattgggggcaaggatcactcataaccgtgagcagtgcctccacaaaaggt

SEQ ID NO: 27466 - RNA, 399 nt, synthetic construct
  misc_feature 1..399: note = derived and/or modified sequence opt3 from anti-HIV_Chain
  source 1..399: mol_type = other RNA
caggtgagactgagccaatccggcgccgctgtcaagaaacccggggcatctgttaccatcgtgtgcgagacagaaggatacaacttcattgactatataatccactgggtaaggcagcctccaggtcggggctttgagtggctcgggatgattgatccgcgcaatggacgaccctggtcaggccagaaggtgcatggtcgtcttagtctgtggagagacactagcacggaaaaagtctacatgaccttgacagggttaacttccgatgacaccggactgtatttctgtggcaggaacgagcctcagtaccacgatgacaatggccattctctaccagggatgatcgattattggggacaaggtacaatggtgaccgtttcgtcagccagcactaagggc

SEQ ID NO: 27467 - RNA, 399 nt, synthetic construct
  misc_feature 1..399: note = derived and/or modified sequence opt3 from anti-HIV_Chain
  source 1..399: mol_type = other RNA
caggtgagactgagccaatccggcgccgctatcaagaaacccggggcatctgtcaccatttcatgcgagacagaaggatacactttcataaactatatcattcactgggttaggcagcctccaggtcggggctttgagtggctcgggatgatcgacccgcgcaatggacgaccctggttcggccagagtgtgcagggtcgtcttagcctgagaagggatacgtacaccgaagtagtgtatatgacattgtccgggttaacttctgacgatgccggacattacttttgtgcgcggaacgagcctcaatatcacgacggcaatggccattcgctgccagggatgttcgattactggggacagggtaccctagtcgctgtgtcaagcgccagtacaaagggc

SEQ ID NO: 27468 - RNA, 399 nt, synthetic construct
  misc_feature 1..399: note = derived and/or modified sequence opt3 from anti-HIV_Chain
  source 1..399: mol_type = other RNA
caggtgagactgttccaaagcggcgccgctatgaggaagcccggggcatccgtcaccatctcttgcgaggcctcaggatacaactttatgaattatttcgttcactgggtgcggcagcgccctggtcgaggctttgaatggctcgggatgattaacccacgtggaggcagaccgtggagtgcgcagagcgtacagggtaggcttacactgactcgggacacgtccaccgagatgttctacatgcgcttggatgggttaagatctgacgatacagctacttatttttgtgccaggaatgaagcagactaccatgatggaaacggccactcgctgcggggcatgttcgactattgggggcaaggatcactaataaccgtgagcagtgcctccacaaaaggt

SEQ ID NO: 27469 - RNA, 399 nt, synthetic construct
  misc_feature 1..399: note = derived and/or modified sequence opt3 from anti-HIV_LightChain
  source 1..399: mol_type = other RNA
atgaagctgcccgtgagactccttgtcctgatgttctggatccctgccagctcctctgacattgttatgacccagtcaccattgagtttaccggtgacacccggcgagcctgctagcatatcctgcaggtcttcgcaacggctgctatcaagctacgggcacacttatctccattggtacctgcagaaaccaggacagagtccccagcttctgatctatgaagtatccaaccgcttttctggtgtgcctgatcgattcagcggctccgggtcaggaacggactttaccttgaagattagtcgtgtcgaggcagaagatgtgggcgtttactattgtagccaatctacacacgtgccactcactttcggtcaggggaccaaagtcgagatcaagagaaaa

SEQ ID NO: 27470 - RNA, 402 nt, synthetic construct
  misc_feature 1..402: note = derived and/or modified sequence opt3 from anti-HIV_Chain
  source 1..402: mol_type = other RNA
cagccctacatcgtgcaaagcggccctgccgtcaagggggctggatcctctgttaccgtgacatgcaaagtagacggtgatgacgatggcattttctcatttgggacttatttcatggtgtgggtcagacaggcaccaggacagggcctgcagtacatgggtgggctcgtgccgagttatgcccccacgtacgcgcacaagtttgagggaaggataaccatcagcgctgccggcacacctccagttgtgtcccttactctgttgaacttaaccaatgacgatgcagccacatatttctgtgctcgggaacgcggccgacattacgactctaaaacccgtgagaacagaagggggcggtattttgatatgtggggacgcggtactagaattacagtctcgccc

SEQ ID NO: 27471 - RNA, 402 nt, synthetic construct
  misc_feature 1..402: note = derived and/or modified sequence opt3 from anti-HIV_Chain
  source 1..402: mol_type = other RNA
cagccctacatcgtgcaaagcggccctgccgtcaagggggctggatcctctgttaccgtgacatgcagagtagacggtgatgacgatggcattttcaactttgggacttatttcatggtgtgggtcaggcaggcaccaggacagggcctgcagtacatgggtgggctcgtgccgtcatatgcccccacgtacgcgcacaaatttgagggacggataaccatcagtgctgccggcacacctccagttgtgagccttactctgattaatttgaccaacgcagacgccgctacatatttctgtgcacgcgaacgaggccgtcattacgattccaagaccagagagaataggcgggggcgctattttgacatgtggggaagaggtactaggatcacagtctctccc

SEQ ID NO: 27472 - RNA, 402 nt, synthetic construct
  misc_feature 1..402: note = derived and/or modified sequence opt3 from anti-HIV_Chain
  source 1..402: mol_type = other RNA
agagtgcacagccaggtccaactggttgagtccggccccgggctcgtgaagccttctcagaccctttcactgacatgcactgtaagtggaggtagcatctccaacggcgggcattactggaattggattaggcagcacccaggaaaaggcttggaatggataggtcatatctataacattgccacgacctactataatccgtctttaaagtcgcgggtgtcaatcagcgtcgacacaagtaaaaaccagttctccctgaagctatctagcgtgactgctgcagataccgccgtttactattgtgcgcgcgggtccggacgatggacaattggcgctcgtatctactttgacaattggggccaaggggccctcgtggcagtctcaagtgccagcaccaaagga

SEQ ID NO: 27473 - RNA, 402 nt, synthetic construct
  misc_feature 1..402: note = derived and/or modified sequence opt3 from anti-HIV_Chain
  source 1..402: mol_type = other RNA
agcgtggacgagagactgctcgagttcggcgggaggcttgtccagcccggaggttccctgcggttgtcttgctcagccagtggctttaccttcagcaactccgctatgtcttgggttcgccaagcacctgggaagggattagaatgggtgtcgtcaatcctgagcagtggcgtaggtacattttacgccgattccgtgaaagggcgattcactgtctctcgtgacaatagcagaaacacgctatatctccagatgaagtccctgagggcggaagataccgctctttactattgtgccaaagtgcagattcagcaactgaattttggagttataacagacgcaggcttggatgtgtggggcaaggggactaccctcatcgtctcaagtgccagcacaaaagga

SEQ ID NO: 27474 - RNA, 402 nt, synthetic construct
  misc_feature 1..402: note = derived and/or modified sequence opt3 from anti-HIV_Chain
  source 1..402: mol_type = other RNA
gtgcagagccaagtctacctggttcagtccggcggggaggtgaagaaacccggatcttcagtaaaggtgagttgcaaagccagcggtgactccttctcttcgtcagtcatcacctgggtgagacaggctcctggccaggggccagaatggatgggaaggattataccggttctcggcgtggcagcctatgcgcaaaacttttacggtcgggtcacaatcagcgctgatacgagttccaatactgcctatatggagctttctagcctgcgcttcgaagacaccgcagtgttttactgtgcccgagagacagggcgtggaggcaacttggctttaagacagtatttctttgattcctggggccaggggactctggtaaccgtttcaagtcccagcacaaaggga

SEQ ID NO: 27475 - RNA, 402 nt, synthetic construct
  misc_feature 1..402: note = derived and/or modified sequence opt3 from anti-HIV_Chain
  source 1..402: mol_type = other RNA
cagctgcaactccaggagagcggccccgggcttgtgaagccttccgaaaccctgtctttgacatgctcagtcagtgacggaagcatcaactccaattcttactattgggcctggattagacagtcgccaggtaaaggcttagagtggatagggtcagtttactatttcggaggcacttactatagcccgagtctgaagtccagggtgacgatgtctgtagatcggagcaaaaaccagttttccctaaatgtgtcaagtgtcaccgctgcagacacagccatctactattgtgcgcgccacgtgcgaccctacgatcgtagcggttaccctgaaagaccaaactggttcgacccctgggggaggggaactctcgttaccgtgtcttccgcttcaacaaagggc

SEQ ID NO: 27476 - RNA, 402 nt, synthetic construct
  misc_feature 1..402: note = derived and/or modified sequence opt3 from anti-HIV_Chain
  source 1..402: mol_type = other RNA
caggtgcaactgcaccagtggggcgccgggctccttaagcccagcgacaccctgtccttgacatgcggaatcttaggtgtctctcctccaggctcactgactgggtactattggacgtggattagacagccgcccggaaaaggcctagagtggataggtgaagtttaccatagtgggagcaccaactataatccttccctcgcttctagggtgacaatctcgatgggaactaccaagacacagttctcactgcggcttaccagcgtaactgcagccgatagtgcggtgtactattgtgcttccggcaaagtctggggcattacagcccgcccacgagacgcagggctggatgtgtggggacaaggtaccacggttactgtgacctctgccagcacaaagggc

SEQ ID NO: 27477 - RNA, 402 nt, synthetic construct
  misc_feature 1..402: note = derived and/or modified sequence opt3 from anti-HIV_Chain
  source 1..402: mol_type = other RNA
caggtgcaactggtccagagcggcgccgaggttaagaaacccgggtcctctgtgaaggtatcatgcagagctagtggaggtagcttcggcaactacgcaatcaattgggtgaggcaggcccctatgcaggggctcgaatggatgggaggcattataccaatctttggtaccacaaactatgcgcaaaatttccgggggcgcgtcactattaacgctgacacgtttaccaatacagtgaacatggatctttcctctctgcgatcggaggacactgccgtttactattgtggacgttcaatcaatgcagccgtgccgggcttggaaggcgtctactattactatgggatggctgtgtggggacagggtaccacagtaaccgttagcagtgcatccactaaaggc

SEQ ID NO: 27478 - RNA, 402 nt, synthetic construct
  misc_feature 1..402: note = derived and/or modified sequence opt3 from anti-HIV_Chain
  source 1..402: mol_type = other RNA
ttcgtgcagctggtcgagagcggcgggggactcgttcaacccggtggctcccttagactgtcttgcgccgcttcagggtttaacttcaatacctactggatgaactgggtgaggcaggcacctggaaagggcttggaatgggtagccaatatgaaagaggacggtagtgaaaagtattacgtggatagcgtcaaagggcggtttacaatctcccgcgacaacgcgaaaaattctttatatctgcagatgaactcgctacgagctgaggatactgccgtgtactattgtgcacgtaatccagaatcaagatgcattgttggaaggaaccggggctggtgtcgctacttcgacctctggggcagagggagcctggtgacggtcagtccggcctccaccaaggga

SEQ ID NO: 27479 - RNA, 405 nt, synthetic construct
  misc_feature 1..405: note = derived and/or modified sequence opt3 from anti-HIV_Chain
  source 1..405: mol_type = other RNA
cagctgcaactcgaccagcccggcgccgctatgaaaagccttgggtcctctctgaccatcacatgcagagtgtcaggagatgacttgggtagtttccactttggcacttacttcatgatttgggtcaggcaggggcctggacagggcttagagtatatgggtgggatactgccaagcacgaagaccccgacatacgcacataagtttcggggacgcgtttccatctctgcccccggcgtgcctccagtactatcgctcgcgctgactaaccttacctatgatgacacagctacctacttctgtgcccgagaacgtggcagacactttgagcccaaaaatagggatcatctggaagggaagttcttggacctctggggacggggtacttttgtgcgcgtctcacct

SEQ ID NO: 27480 - RNA, 405 nt, synthetic construct
  misc_feature 1..405: note = derived and/or modified sequence opt3 from anti-HIV_Chain
  source 1..405: mol_type = other RNA
caggtgcaactggtccagcccggcaccgccatgaaaagcctcgggtcctctcttacaatcacttgcagagtttcaggagacgatctgggtagtttccactttggcacgtacttcatgatttgggtgaggcaggctcctgggcagggattggagtatatgggcggtatattaccaagcaccaagacaccgacttacgcacataagtttcgggggcgcgtatccatctctgcccccggagtgcctccagtcctgtcgctagcgctcaccaacctgacatatgacgataccgctacttacttctgtgcccgagaacgtggcagacactttgagcccaaaaatagggacaaccttgaaggcaagttctttgatctgtgggggcggggaacattcgtgcgcgtttcacct

SEQ ID NO: 27481 - RNA, 405 nt, synthetic construct
  misc_feature 1..405: note = derived and/or modified sequence opt3 from anti-HIV_Chain
  source 1..405: mol_type = other RNA
caggtgcaactggtccagcccggcaccgccatgaagacactcgggagctcccttactatctcttgcagagtttcaggagacgatggtaacttccactttggcacgtacttcatggcttgggtgaggcaggtacctgggcagggactggagtatatgggcggtattttgccaagtaccaaaagcccgacatacgcacataagtttcgggggcgcgtgtccatatctactgccggagtgccccctgtcgtttcgttagcgctgaccaatctaacatatgacgataccgctacttacttctgtgcccgagaacgtggcagacactatgacagcaaaaagcaagagaactacaggggcaaatttttcgatctctgggggcggggaacatgggtgcgcgtctcaccaacc

SEQ ID NO: 27482 - RNA, 405 nt, synthetic construct
  misc_feature 1..405: note = derived and/or modified sequence opt3 from anti-HIV_Chain
  source 1..405: mol_type = other RNA
cacctggtgcagagcggcaccgaggtcaagaaacccgggtcctctgttacagtgtcatgcaaggcctacggagtaaacactttcggtctctatgctgtgaattgggtcagacaagcacctggccagagtcttgaatacatcgggcagatttggaggtggaaaagctccgcctctcatcactttcggggacgcgtgctgatatcggcggttgacttgacgggctcaagcccaccgatcagttccttagagattaagaacctgacctctgatgacacagctgtgtatttctgtactaccacaagcacctacgatcagtggtccggtctacatcacgacggggtcatggccttttcaagttggggacaaggcactctcatcagcgtgtctgcagcctccacaaaaggc

SEQ ID NO: 27483 - RNA, 405 nt, synthetic construct
  misc_feature 1..405: note = derived and/or modified sequence opt3 from anti-HIV_Chain
  source 1..405: mol_type = other RNA
caggtgcaactggtccagagcggcgccgaggttaagaaacccgggtcctctgtgaaggtatcatgcaaagctagtggaggtaccttcagcacatacgcattttcctgggtgagacaggcccctatcgaaggcctcgagtggatgggagggattataccaatcttcggcactgaaaactatgcgcagaagtttcaaggtagggtcacgattaccgctgacaaatctacatcgactgcctacatggagctttcaagcctgcggagtgaagataccgcagtgtattactgtgcccgcgaccgatcctctgctatcgggtattgcagctccatttcatgttacaagggaagtttcgatatctggggccagggcacaatggttaccgtgagctctgcatccactaagggg

SEQ ID NO: 27484 - RNA, 405 nt, synthetic construct
  misc_feature 1..405: note = derived and/or modified sequence opt3 from anti-HIV_Chain
  source 1..405: mol_type = other RNA
caggtgcaactggtccagagcggcgccgaggttaagaaacccgggtcctctgtgaaggtatcatgcaaagctagtggaggtaccttcagcacatacgcattttcctgggtgagacaggcccctggccaggggctcgaatggatgggaggcatcattccaatattcggtactgagaactatgcgcaaaagtttcaggggagggtcacgatcaccgctgacaaatctacatcgactgcctacatggaactttcaagcctgcggagtgaggataccgcagtgtattactgtgcccgcgaccgatcctctgctattggatattgcagctccatctcatgttacaagggcagtttcgatatttggggccaggggacaatggttaccgtgagctctgcatccactaaggga

SEQ ID NO: 27485 - RNA, 405 nt, synthetic construct
  misc_feature 1..405: note = derived and/or modified sequence opt3 from anti-HIV_Chain
  source 1..405: mol_type = other RNA
gaggtgcagctggtcgaaagcggcgggggactcgttcaacccggtggctcccttagactgtcttgcgccgcttcagggttcacctttagtagctactccatgaactgggtgaggcaggcacctggaaagggcttggagtgggtatcttatatctcgggttcaagctacacaatttattacgccgacagtgtgcgggggcgcttcactatatcccgagataatgcgaaaaactctttatatctgcagatgaatagcctacgtgacgaagatacggctgtctacttttgtgccagagcaaccccaccgaaccccctcaatctgtataactacgactcctcaggaagtagcttcgattactggggccagggcacacttgtgactgtttcttccgcctcaaccaagggg

SEQ ID NO: 27486 - RNA, 405 nt, synthetic construct
  misc_feature 1..405: note = derived and/or modified sequence opt3 from anti-HIV_Chain
  source 1..405: mol_type = other RNA
gaggtgcagctggtccaaagcggcgccgaagttaagaaacccgggtcctctgtgaaggtatcatgcaaagctagtggaggtaccttcagcacatacgcattttcctgggtgagacaggcccctggccaggggctcgagtggatgggaggcatcattccaatattcggtactgaaaactatgcgcagaagtttcaagggagggtcacgatcaccgctgacaaatctacatcgactgcctacatggagctttcaagcctgcggagtgaagataccgcagtgtattactgtgcccgcgaccgatcctctgctattggatattgcagctccatctcatgttacaagggcagtttcgatatttggggccaggggacaatggttaccgtgagctctgcatccactaaggga

SEQ ID NO: 27487 - RNA, 405 nt, synthetic construct
  misc_feature 1..405: note = derived and/or modified sequence opt3 from anti-HIV_Chain
  source 1..405: mol_type = other RNA
gaggtgcagctggtcgaaagcggcgccgaggttaagaaacccgggtcctctgtgaaggtatcatgcaaagctagtggaggtaccttcagcacatacgcattttcctgggtgagacaagcccctggccaggggctcgaatggatgggaggcatcattccaatattcggtactgagaactatgcgcagaagtttcaggggagggtcacgatcaccgctgacaaatctacatcgactgcctacatggaactttcaagcctgcggagtgaggataccgcagtgtattactgtgcccgcgaccgatcctctgctattggatattgcagctccatctcatgttacaagggcagtttcgatatttggggccaagggacaatggttaccgtgagctctgcatccactaaggga

SEQ ID NO: 27488 - RNA, 405 nt, synthetic construct
  misc_feature 1..405: note = derived and/or modified sequence opt3 from anti-HIV_Chain
  source 1..405: mol_type = other RNA
cccctggtgcagctcgagcctagcggcgtcgaagttaagaaaagaggggcctccgtgaaggtatcttgcaaagtgtcaggatacagtcttaccgagctgagcatgcactgggtcaggcaagctccaggtaagggcttggaatggatggggtccttcgacccgttagatggagacacaatctatgcacagaaatttcagggccgggtgactatgacggttgatacctctacagacactgcctacatggatctgtcgtcactacgcttcgaggacaccgcggtgtattactgtgctacacccagcaaggcctattactatgatagtcctaactacgaaggtgacttttacatggatgtctgggggaagggaaccactgtgattgtatcctctgcaagcacaaaaggc

SEQ ID NO: 27489 - RNA, 408 nt, synthetic construct
  misc_feature 1..408: note = derived and/or modified sequence opt3 from anti-HIV_HeavyChain
  source 1..408: mol_type = other RNA
cagatccacctggtgcaaagcggcaccgaggtcaagaaacccgggtcctctgttacagtgtcatgcaaggcctacggagtaaacactttcggtctctatgctgtgaattgggtcagacaggcacctggccagagtcttgaatacattgggcagatatggaggtggaaaagctccgcctctcatcactttcggggacgcgtgctgatctcggcggttgacttgacgggctcaagcccaccgattagttccttagagatcaagctgacctctgatgacacagctgtgtatttctgtactaccacaagcacctacgataaatggtccggtctacatcacgacggggtcatggccttttcaagtcgaggacaaggcactctcattagcgtgtctgcagcctccacaaagggc

SEQ ID NO: 27490 - RNA, 408 nt, synthetic construct
  misc_feature 1..408: note = derived and/or modified sequence opt3 from anti-HIV_HeavyChain
  source 1..408: mol_type = other RNA
cagatccacctggtgcaaagcggcaccgaggtcaagaaacccgggtcctctgttacagtgtcatgcaaggcctacggagtaaacactttcggtctctatgctgtgaattgggtcagacaggcacctggccaggggcttgaatacattggacagatatggaggtggaaaagtagcgcctcccatcactttcggggccgcgtgctgatctctgcggttgacttgacgggttcgtcaccaccgattagcagtttagagatcaaggtgacctccgatgacacagctgtctatttctgtactaccacatctacctacgatgaatggagcgacctgcatcacgatggggtgatggccttttcctcatggggacaaggcactctaattagtgtaagcgcagcctctacaaaaggc

SEQ ID NO: 27491 - RNA, 408 nt, synthetic construct
  misc_feature 1..408: note = derived and/or modified sequence opt3 from anti-HIV_HeavyChain
  source 1..408: mol_type = other RNA
cagatccacctggtgcaaagcggcaccgaggtcaagaaacccgggtcctctgttacagtgtcatgcaaggcctacggagtaaacactttcggtctctatgctgtgaattgggtcagacaggcacctggccagagtcttgaatacattgggcagatatggaggtggaaaagctccgcctctcatcactttcggggacgcgtgctgatctcggcggttgacttgacgggctcaagcccaccgattagttccttagagatcaagctgacctctgatgacacagctgtgtatttctgtactaccacaagcacctacgatcgatggtccggtctacatcacgacggggtcatggccttttcaagttggggacaaggcactctcattagcgtgtctgcagcctccacaaaaggc

SEQ ID NO: 27492 - RNA, 408 nt, synthetic construct
  misc_feature 1..408: note = derived and/or modified sequence opt3 from anti-HIV_Chain
  source 1..408: mol_type = other RNA
tgcaaccccagagtgcacagcgaggtccagctggttgaatccggcgccgaggtgaagaaacctggggcttctgtaaaggtggcatgtaaagtctcaggaaagaaactcagtgaccttagcatccattgggtgaggcaagccccaggtaagggcctggaatggatgggagggttcgatgaggaagacggcaagatttcctacgagcggaaatttcagggtcgcgtttctatgaccgaggatacagcgcgagacactgctttcatggaaatgtcgtcattgcgtagcgatgacacggccgtgtatttttgcgcagccgctccgagattagatctgggggagctaagttccggattccacttttggggcctcggcaccctggtcacagtgtctagcgcatccactaagggg

SEQ ID NO: 27493 - RNA, 408 nt, synthetic construct
  misc_feature 1..408: note = derived and/or modified sequence opt3 from anti-HIV_Chain
  source 1..408: mol_type = other RNA
atctgggctcccctgattgccgtgaccttcctcgtccttcactgcgagagcctgggcacatgttgctgttgccaggcatccgggggaacttttaacacgttcgccataaattgggttagacaagcgcctggtcagggcttggaatgggtagggggaatcattccagtgtttggcaccgcttcttacgcccagaagttccagggtagggtgacagtcactaccgacgagtcacgggggacagcatatatggaattaaacagtctgcgcagcgaggataccgccgtgtactattgtgctcgaggacaaactgacctaaatgatgacctctggtccgattactctacaccgggctttgactattggggccaggggaccctggttacggtgtcgtcagcaagcactaaagga

SEQ ID NO: 27494 - RNA, 408 nt, synthetic construct
  misc_feature 1..408: note = derived and/or modified sequence opt3 from anti-HIV_Chain
  source 1..408: mol_type = other RNA
ctgcagcccagagtgcacagcgaggtccaactcgttgaatccggcgccgaggtgaagaaacctggggcttctgtaaaggtgtcatgcaaagtcagtggatacacccttagcgacctgtccatgcattgggtgaggcaggcaccaggtaagggcttggaatggatgggagggttcgatgaggaagacggcgagatcacatatgcccagaaatttcagggtcgggtttctatgactgaggatacgtcgcgcgacaccgcgtacatggaattatcaagcctgcgaagtgaggatacagctgtgtattactgtgccactgcaccgcgtctagaactcggggagctgtcctctggattccactattggggccttggcaccctggtcacagtgagctccgcctcaaccaagggg

SEQ ID NO: 27495 - RNA, 408 nt, synthetic construct
  misc_feature 1..408: note = derived and/or modified sequence opt3 from anti-HIV_Chain
  source 1..408: mol_type = other RNA
cagagccaagtgcacctggtccagtccggcgccgaggttaagaaacccgggtcttcagtgaaggtaagttgccaggctagcggaggtaccttcaacacatttgcaatcaattgggtgagacaggcccctggccaagggctcgaatgggtcggaggcattataccagtgttcggtactgcgtcctacgctcagaaatttcaggggagggttacggtgaccacagacgagtctcggggaactgcctatatggaacttaactcgctgcgctcagaggataccgcagtctactattgtgcccgaggccagacagacttgaatgatgacttatggagcgattacagtaccccgggcttcgactattgggggcaaggaactctggtgacagtatcctctgctagcaccaagggt

SEQ ID NO: 27496 - RNA, 408 nt, synthetic construct
  misc_feature 1..408: note = derived and/or modified sequence opt3 from anti-HIV_Chain
  source 1..408: mol_type = other RNA
ggcagcgaggtgcagctggtcgaatccggggccgaggttaagaaaagaggagcttctgtgaaggtatcatgcaaagtgagtggttacagcctcaccgaactttccatgcactgggtcaggcaagcacccggcaaggggctggagtggatgggatctttcgaccctttggatggcgacacaatctatgcccagaaatttcagggtcgggtgactatgacggttgatacctcgacagacactgcgtacatggatttatcaagcctgcgcttcgaagacaccgctgtgtattactgtgccacaccaagtaaggcatattactatgattccccgaactacgagggggacttttacatggatgtctggggaaagggcaccactgtgattgtatctagcgcctccacaaaaggc

SEQ ID NO: 27497 - RNA, 408 nt, synthetic construct
  misc_feature 1..408: note = derived and/or modified sequence opt3 from anti-HIV_Chain
  source 1..408: mol_type = other RNA
caggtgcaactggtccagagcggcggggaggttaagaaacccggagcctccgtgaaggtatcttgcaaagtgtcaggttacagtctcaccgaacttagcatgcactgggtcagacaggctcctggcaaggggctggagtggatgggagtgttcgacccattggaaggcgatggtgtttatgtgcagaaatttagggggcgggtcatcatgacagaggacacttccacggataccgcatacatggaattaacatctctgcgctcggaggacactgccatttattactgtgcgaccaaggctaaggattattactatgagtcaagcgactacagtccgtactattactattacatggatgtgtggggaaaaggcacaaccgtaactgtttcctctgccagcacaaagggc

SEQ ID NO: 27498 - RNA, 408 nt, synthetic construct
  misc_feature 1..408: note = derived and/or modified sequence opt3 from anti-HIV_Chain
  source 1..408: mol_type = other RNA
gaggtgcagctggtccaaagcggcgccgaagttaagaaacccggggcttccgtgaaggtatcttgcaaagtgtcaggatacaccctcacagagcttagtatgcactgggtcagacaggcacctggtaagggcctggaatggatgggggtgttcgacccattggagggagatggcgtttatgccgaaaaatttaggggtcgggtgatcatgactgaggacacgagcaccgatacagggtacatggagttaacttccctgcgctctgaagacaccgcgatttattactgtgctacaaaggccaaggattattactatgagtcgtcagactacagcccgtactattactattacatggatgtctggggaaaaggcaccactgtgacagtaagttccgcatctaccaagggc

SEQ ID NO: 27499 - RNA, 408 nt, synthetic construct
  misc_feature 1..408: note = derived and/or modified sequence opt3 from anti-HIV_Chain
  source 1..408: mol_type = other RNA
caggtgcaactggtccagagcggcgccgaggttaagaaacccggggcttccgtgaaggtatcttgcaaagcatcaggatacaccttcacaagatatcacatccattgggtgaggcacgcccctggtcagggcctcgaatggatggggaagattaacccaagtcgggcgagcactaaatacgctaagaagtttcaggaccgcgtcacgatgacccgagatacatccacttctaccgtgtatatggagctttcgtcactgcgtggagacgatacagccgtttactattgtggcagagaaatgggtaccttcactttgttaggggtggtcatagaccattacgatttttatccgatggacgtgtggggacaaggcacacccgtaaccgttagcagtgcatccacgaaaggc

SEQ ID NO: 27500 - RNA, 408 nt, synthetic construct
  misc_feature 1..408: note = derived and/or modified sequence opt3 from anti-HIV_Chain
  source 1..408: mol_type = other RNA
agcagacccccttcctgcctgctcggctgttggtgctgttctgggttccttctgccagccgtgatcttgccgaacttacactcaccctgcctgagtctactcgagagccagcctccatccctggctgaccttgtctctgcatttgccgttatggatattcccatatacatcggaacctataggtcgcaagcgtcactgcatagcagttccacaaagttccctactgactttttgggttctcagacgggcagcgtggctgtagggcagggacagatttcccacctccggtcagtggaatggcgcctgcgaatgtgggagttcatcaccgccctgaaagtccatatgtttctcagtcgtagcgatagaggcccaaggtggaagaatgtgtcttccttactgaactcacgg

SEQ ID NO: 27501 - RNA, 411 nt, synthetic construct
  misc_feature 1..411: note = derived and/or modified sequence opt3 from anti-HIV_HeavyChain
  source 1..411: mol_type = other RNA
cagatccacctggtgcaaagcggcaccgaggtcaagaaacccgggtcctctgttacagtgtcatgcaaggcctacggagtaaacactttcggtctctatgctgtgaattgggtcagacaggcacctggccagagtcttgaatacattgggcagatatggaggtggaaaagctccgcctctcatcactttcggggacgcgtgatcatttcggcggttgacctgacgggctcaagcccaccgatcagtcccttggagattaagaacttaacctccgatgacacagctgtgtatttctgtactaccacatctaccagcgatcgatggtccggtctgcatcacgacggggtcatggccttttcaagttggggacaaggcactctaatcagcgtgtctgcagcctccacaaaaggc

SEQ ID NO: 27502 - RNA, 411 nt, synthetic construct
  misc_feature 1..411: note = derived and/or modified sequence opt3 from anti-HIV_HeavyChain
  source 1..411: mol_type = other RNA
cagatccacctggtgcaaagcggcaccgaggtcaagaaacccgggtcctctgttacagtgtcatgcaaggcctacggagtaaacactttcggtctctatgctgtgaattgggtcagacaggcacctggccagagtcttgaatacattgggcagatatggaggtggaaaagctccgcctctcatcactttcggggacgcgtgatcatttcggcggttgacctgacgggctcaagcccaccgatcagttccttggagattaagaacttaacctctgatgacacagctgtgtatttctgtactaccgccagcacatacgataaatggtccggtctgcatcacgacggggtcatggcattttcaagttggggacaaggcaccctaatcagcgtgtctgccgcttccactaagggc

SEQ ID NO: 27503 - RNA, 411 nt, synthetic construct
  misc_feature 1..411: note = derived and/or modified sequence opt3 from anti-HIV_HeavyChain
  source 1..411: mol_type = other RNA
cagatccacctggtgcaaagcggcaccgaggtcaagaaacccgggtcctctgttacagtgtcatgcaaggcctacggagtaaacactttcggtctctatgctgtgaattgggtcagacaggcacctggccagagtcttgaatacattgggcagatatggaggtggaaaagctccgcctctcatcactttcggggacgcgtgctgatctcggcggttgacttgacgggcccatcaccgcccattagcagtttagagatcaagaacctgacctccgatgacacagctgtgtatttctgtactaccacatctacctacgataaatggagcggtctacatcacgacggggtcatggccttttcctcatggggacaaggcactctcattagtgtgagcgcagcctctacaaagggc

SEQ ID NO: 27504 - RNA, 411 nt, synthetic construct
  misc_feature 1..411: note = derived and/or modified sequence opt3 from anti-HIV_HeavyChain
  source 1..411: mol_type = other RNA
cagatccacctggtgcaaagcggcaccgaggtcaagaaacccgggtcctctgttgccgtgtcatgcaaggcttacggagtaaacacattcggtctctatgcagtgaattgggtcagacaggcccctggccagagtcttgaatacattgggcagatatggaggtggaaaagctccgcgtctcatgactttcggggacgcgtgatcatttcggctgttgatctgactggctcaagcccaccgatcagttccttggagattaagaacttaacgtctgacgataccgccgtgtatttctgtacagcaactagcacccccgactactggtccggtctgcaccatgatggggtcatggccttttcaagttggggacaaggcacactaatcagcgtgtctgctgcatccaccaaaggc

SEQ ID NO: 27505 - RNA, 411 nt, synthetic construct
  misc_feature 1..411: note = derived and/or modified sequence opt3 from anti-HIV_HeavyChain
  source 1..411: mol_type = other RNA
cagatccacctggtgcaaagcggcaccggggtcaagaaacccggatcctctgttacagtgtcatgcaaggcctacggtgtaaacactttcggcctctatgctgtgaattgggtcagacaggcacctgggcagggacttgagtacattggccagatatggaggtggaaaagtagcgcctcccatcactttcggggtcgcgtgctgatctctgcggttgacttgacggggtcgtcaccaccgattaccagcttagaaatcaagaacgtgacaagtgatgacactgctgtctatttctgtaccacaacctccacttacgataaatggtctggactgtatcatgacggcgtgatggcctttagctcctggggccaagggacactaatttcagtaagtgcagccagcaccaaggga

SEQ ID NO: 27506 - RNA, 411 nt, synthetic construct
  misc_feature 1..411: note = derived and/or modified sequence opt3 from anti-HIV_HeavyChain
  source 1..411: mol_type = other RNA
cagatccacctggtgcaaagcggcaccgaggtcaagaaacccgggtcctctgttacagtgtcatgcaaggcctacggagtaaacactttcggtctctatgctgtgaattgggtcagacaggcacctggccagagtcttgaatacattgggcagatatggaggtggaaaagctccgcctctcatcactttcggggacgcgtgatcatttcggcggttgacctgacgggctcaagcccaccgatcagttccttggagattaagaacttaacctctgatgacacagctgtgtatttctgtactaccacaagcacctccgattactggtcaggtctgcatcacgacggggtcatggcctttagtagctggggacaaggcactctaatctctgtgtccgcagcctcaacaaaaggc

SEQ ID NO: 27507 - RNA, 411 nt, synthetic construct
  misc_feature 1..411: note = derived and/or modified sequence opt3 from anti-HIV_HeavyChain
  source 1..411: mol_type = other RNA
cagatccacctggtgcaaagcggcaccgaggtcaagaaacccgggtcctctgttacagtgtcatgcaaggcctacggagtaaacactttcggtctctatgctgtgaattgggtcagacaggcacctggccagagtcttgaatacattgggcagatatggaggtggaaaagctccgcctctcatcactttcggggacgcgtgctgatctcggcggttgacttgacgggctcaagcccaccgattagttccttagagatcaagaacctgacctctgatgacacagctgtgtatttctgtactaccacaagcacctacgatcgatggtccggtctacatcacgacggggtcatggccttttcaagttggggacaaggcactctcattagcgtgtctgcagcctccacaaaaggc

SEQ ID NO: 27508 - RNA, 411 nt, synthetic construct
  misc_feature 1..411: note = derived and/or modified sequence opt3 from anti-HIV_HeavyChain
  source 1..411: mol_type = other RNA
cagatccacctggtgcaaagcggcaccgaggtcagaaagcccgggtcctctgttacagtgtcatgcaaagcctacggagtaaacactttcggtctctatgctgtgaattgggtcaggcaggcacctggccagagtcttgaatacattgggcagatatggcggtggaaaagctccgcctctcatcactttcgcggacgagtgctgatctcggcggttgacttgacgggctcaagcccaccgattagttccttagagatcaagaacctgacctctgatgacacagctgtgtatttctgtactaccacaagcacctacgataagtggtccggtctacatcacgacggggtcatggccttttcaagttggggacaaggcactctcattagcgtgtctgcagcctccacaaaaggc

SEQ ID NO: 27509 - RNA, 411 nt, synthetic construct
  misc_feature 1..411: note = derived and/or modified sequence opt3 from anti-HIV_HeavyChain
  source 1..411: mol_type = other RNA
cagatccacctggtgcaaagcggcaccgaggtcaagaaacccgggtcctctgttacagtgtcatgcaaggcctacggagtaaacactttcggtctctatgctgtgaattgggtcagacaggcacctggccagagtcttgaatacattgggcagatatggaggtggaaaagctccgcctctcatcactttcggggacgcgtgctgatctcggcggttgacttgacgggctcaagcccaccgattagttccttagagatcaagaacctgacctctgatgacacagctgtgtatttctgtactaccacaagcacctacgatcaatggtccggtctacatcacgacggggtcatggccttttcaagttggggacagggcactctcattagcgtgtctgcagcctccacaaaaggc

SEQ ID NO: 27510 - RNA, 411 nt, synthetic construct
  misc_feature 1..411: note = derived and/or modified sequence opt3 from anti-HIV_HeavyChain
  source 1..411: mol_type = other RNA
cagatccacctggtgcaaagcggcaccgaggtcaagaaacccgggtcctctgttacagtgtcatgcaaggcctacggagtaaacactttcggtctctatgctgtgagttgggtcagacaggcacctggccagaggcttgaatacattgggcagatacggcgctggaaaagctccgcctctcatcactttcgaggacgtgtgacggtttcggcggtggacccaaccggctcaagcccgcccatcagttccctggagattagagatttgacaactgacgataccgctgtctatttctgtacaaccacttctacaagcgactactggtccggtttacataatgaaagggggaccgccttttcaagttggggacaaggcacgctgatcagcgtgtctgcagcctccactaagggc

SEQ ID NO: 27511 - RNA, 411 nt, synthetic construct
  misc_feature 1..411: note = derived and/or modified sequence opt3 from anti-HIV_HeavyChain
  source 1..411: mol_type = other RNA
cagatccacctggtgcaaagcggcaccgaggtcaagaaacccgggtcctctgttacagtgtcatgcaaggcctacggagtaaacactttcggtctctatgctgtgaattgggtcagacaggcacctggccaggggcttgaatacattggacagatatggaggtggaaaagtagcgcctcccatcactttcggggccgcgtgctgatctctgcgattgacttgacgggttcgtcaccaccgatcagcagtttagagattaagaacgttacctccgatgacacagctgtgtatttctgtactaccatgtctacatacgataaatggagcgggctgcatcacgacggagtcatggccttttcctcatggggccaaggcaccctaatcagtgtgagcgcagcctctactaagggg

SEQ ID NO: 27512 - RNA, 411 nt, synthetic construct
  misc_feature 1..411: note = derived and/or modified sequence opt3 from anti-HIV_HeavyChain
  source 1..411: mol_type = other RNA
cagatccacctggtgcaaagcggcaccgaggtcaagaaacccgggtcctctgttacagtgtcatgcaaggcctacgaagtaaacactttcggactctatgctgtgaattgggtcagacaggcacctggtcagagtcttgagtacattggccagatatggaggtggaaaagctccgcctctcatcactttcgggggcgcgtgctgatctcggcggttgacttgacgggatcaagcccaccgattagttccttagaaatcaagaacgtgacctctgatgacacagctgtctatttctgtactaccacaagcacccatgataaatggtccggcctgcaccatgacggtgtgatggccttttcaagttgggggcaaggaactctaattagcgtatctgcagcctccacaaagggc

SEQ ID NO: 27513 - RNA, 411 nt, synthetic construct
  misc_feature 1..411: note = derived and/or modified sequence opt3 from anti-HIV_HeavyChain
  source 1..411: mol_type = other RNA
cagatccacctggtgcaaagcggcaccgaggtcaagaaacccgggtcctctgttacagtgtcatgcaaggcctacggagtaaacactttcggtctctatgctgtgaattgggtcagacaggcacctggccaggggcttgaatacattggacagatatggaggtggaaaagtagcgcctcccatcactttcggggccgcgtgctgatctctgcggttgacttgacgggttcgtcaccaccgattagcagtttagagatcaagaacgtgacctccgatgacacagctgtctatttctgtactaccacatctacctacgataaatggagcgggctgcatcacgacggagtggtagccttttcctcatggggccaaggcactctaattagtgttagcgcagcctctacaaagggg

SEQ ID NO: 27514 - RNA, 411 nt, synthetic construct
  misc_feature 1..411: note = derived and/or modified sequence opt3 from anti-HIV_Chain
  source 1..411: mol_type = other RNA
caggtgaccctggtccaaagcggcgccgaggttaagaaacccggggcttccgtgagaatctcttgcagggcatcaggattcacatttgacgattacagtgactatagcttcattcctactacgtacctcatacactggtttcggcaggccccaggtcagggccttgaatggatggcgtggatcaactccgtaaatgggggacgcaacattgctcgacagttccaaggccgtgtgaccgtcgccagagataggtctaattcgatcgcatttctggagttctcaggtttgcggcatgacgatacagccgtgtatttttgtgctcgcgacagaagggatgacgatcgggcatggttactggacccgtgggggcagggaactcgcgttaccgtgagcagtgcctccacaaagggc

SEQ ID NO: 27515 - RNA, 411 nt, synthetic construct
  misc_feature 1..411: note = derived and/or modified sequence opt3 from anti-HIV_Chain
  source 1..411: mol_type = other RNA
cagatccacctggtgcaaagcggcaccgaggtcaagaaacccgggtcctctgttacagtgtcatgcaaggcctacggagtaaacactttcggtctctatgctgtgaattgggtcagacaggcacctggccagagtcttgaatacattgggcagatatggaggtggaaaagctccgcctctcatcactttcggggacgcgtgctgatctcggcggttgacttgacgggctcaagcccaccgattagttccttagagatcaagaacctgacctctgatgacacagctgtgtatttctgtactaccacaagcacctacgataaatggtccggtctacatcacgacggggtcatggccttttcaagttggggacaaggcactctcattagcgtgtctgcagcctccacaaagggc

SEQ ID NO: 27516 - RNA, 414 nt, synthetic construct
  misc_feature 1..414: note = derived and/or modified sequence opt3 from anti-HIV_Chain
  source 1..414: mol_type = other RNA
gtggtccagctggttcaaagcggcgccgaggtgagaaagcccgggtcctctctcaaagtatcatgcaagagtagcggaggtaccttctccaggtttgtggtcaactgggtgcggcaggctcctggccaggggcttgaatggatgggaggcatgatcccaattttcggtatagcaaaatacgcccagaagtttcaagaccgcgttacaatgactgcggatgagtctaaaaatacggtgtatctggacttctcgtcattgcgaagcgatgacaccgctgtctactattgtgcccgtgatagaggggacacaaggttactggattacggagactatgaagatgagcggtactattacggcatggacgtgtggggccaggggactaccgtaatcgttagttccgcatctacaaaggga

SEQ ID NO: 27517 - RNA, 414 nt, synthetic construct
  misc_feature 1..414: note = derived and/or modified sequence opt3 from anti-HIV_Chain
  source 1..414: mol_type = other RNA
caggtgcaactggtccagagcggcgccgaggttagaaagcccgggtcctctctcaaagtgtcatgcaagagtagcggaggtaccttctccaggtttgtagtgaactgggtccggcaggctcctggccaggggcttgaatggatgggaggcatgatcccaattttcggtatagcaaaatacgcccaaaagtttcaggaccgcgtgacaatgactgcggatgagtctaaaaatacggtttatctggacttctcgtcattgcgaagcgatgacaccgctgtgtactattgtgcccgtgatagaggggacacaaggttactggattacggagactatgaagatgagcggtactattacggcatggacgtctggggccaggggactaccgtgatcgtaagttccgcatctacaaaggga

SEQ ID NO: 27518 - RNA, 414 nt, synthetic construct
  misc_feature 1..414: note = derived and/or modified sequence opt3 from anti-HIV_Chain
  source 1..414: mol_type = other RNA
gaggtgcagctggtcgaaagcggcgccgaggttagaaagcccgggtcctctctcaaagtgtcatgcaagagtagcggaggtaccttctccaggtttgtagtgaactgggtccggcaagctcctggccaggggcttgaatggatgggaggcatgatcccaattttcggtatagcaaaatacgcccagaagtttcaggaccgcgtgacaatgactgcggatgagtctaaaaatacggtttatctggacttctcgtcattgcgaagcgatgacaccgctgtgtactattgtgcccgtgatagaggggacacaaggttactggattacggagactatgaagatgagcggtactattacggcatggacgtctggggccaagggactaccgtgatcgtaagttccgcatctacaaaggga

SEQ ID NO: 27519 - RNA, 414 nt, synthetic construct
  misc_feature 1..414: note = derived and/or modified sequence opt3 from anti-HIV_Chain
  source 1..414: mol_type = other RNA
caggtgcaactggtcgagagcggcgccgaagttagaaagcccgggtcctctctcaaagtgtcatgcaagagtagcggaggtaccttctccaggtacgtagtgaactgggtccggcaggctcctggccaggggcttgagtggatgggaggcatcattccaatatttggtatcgcaaaatatgcccagaagttccaagaccgcgtgacaatgactgcggatgaaccgaaaaatacggtttacctggactttaactctttgcgatcggatgacaccgctgtgtattactgtgcccgtgatagaggggacacaaggttactggattatggagactacgaggatgaacggtattactacggcatggacgtctggggccaggggactaccgtgattgtatcaagcgcaagtacaaaggga

SEQ ID NO: 27520 - RNA, 414 nt, synthetic construct
  misc_feature 1..414: note = derived and/or modified sequence opt3 from anti-HIV_Chain
  source 1..414: mol_type = other RNA
caggtgcaactggtccagagcggcgccgaggttagaaagcccgggtcctctctcaaagtgtcatgcaagagtagcggaggtaccttctccaggtacgtagtgaactgggtccggcaggctcctggccaggggcttgaatggatgggaggcatgatcccaatttttggtatagcaaaatatgcccaaaagttccaggaccgcgtgacaatgactgcggatgagtctaaaaatacggtttacctggacttttcgtcattgcgaagcgatgacaccgctgtgtattactgtgcccgtgatagaggggacacaaggttactggattatggagactacgaagatgagcggtattactacggcatggacgtctggggccaggggactaccgtgatcgtaagttccgcatctacaaaggga

SEQ ID NO: 27521 - RNA, 414 nt, synthetic construct
  misc_feature 1..414: note = derived and/or modified sequence opt3 from anti-HIV_Chain
  source 1..414: mol_type = other RNA
caggtgcaactggtccagagcggcgccgaggttagaaagcccgggtcctctctcaaagtgtcatgcaagagtagcggaggtaccttctccaggtacgtagtgaactgggtccggcaggctcctggccaggggcttgaatggatgggaggcatcattccaatatttggtatcgcaaaatatgcccaaaagttccaggaccgcgtgacaatgactgcggatgagtctaaaaatacggtttacctggacttttcgtcattgcgaagcgatgacaccgctgtgtattactgtgcccgtgatagaggggacacaaggttactggattatggagactacgaagatgagcggtattactacggcatggacgtctggggccaggggactaccgtgattgtaagttccgcatctacaaaggga

SEQ ID NO: 27522 - RNA, 414 nt, synthetic construct
  misc_feature 1..414: note = derived and/or modified sequence opt3 from anti-HIV_Chain
  source 1..414: mol_type = other RNA
caggtgcaactggtcgagagcggcgccgaagttagaaagcccgggtcctctctcaaagtgtcatgcaagagtagcggaggtaccttctccaggtacgtagtgaactgggtccggcaggctcctggccaggggcttgagtggatgggaggcatcattccaatatttggtatcgcaaaatatgcccagaagttccaagaccgcgtgacaatgactgcggatgaatctaaaaatacggtttacctggacttttcgtcattgcgaagcgatgacaccgctgtgtattactgtgcccgtgatagaggggacacaaggttactggattatggagactacgaggatgaacggtattactacggcatggacgtctggggccaggggactaccgtgattgtaagttccgcatctacaaaggga

SEQ ID NO: 27523 - RNA, 414 nt, synthetic construct
  misc_feature 1..414: note = derived and/or modified sequence opt3 from anti-HIV_Chain
  source 1..414: mol_type = other RNA
caggtgcaactggtccagagcggcgccgaggttagaaagcccgggtcctctctcaaagtgtcatgcaagagtagcggaggtaccttctccaggtacgtagtgaactgggtccggcaggctcctggccaggggcttgaatggatgggaggcatcattccaatatttggtatcgcaaaatatgcccaaaagttccaggaccgcgtgacaatgactgcggatgagccgaaaaatacggtttacctggactttaactctttgcgatcggatgacaccgctgtgtattactgtgcccgtgatagaggggacacaaggttactggattatggagactacgaagatgagcggtattactacggcatggacgtctggggccaggggactaccgtgattgtatcaagcgcaagtacaaaggga

SEQ ID NO: 27524 - RNA, 414 nt, synthetic construct
  misc_feature 1..414: note = derived and/or modified sequence opt3 from anti-HIV_Chain
  source 1..414: mol_type = other RNA
gtggtccagctggttcaaagcggcgccgaggtgagaaagcccgggtcctctctcaaagtatcatgcaagagtagcggaggtaccttctccaggtacgtggtcaactgggtgcggcaggctcctggccaggggcttgaatggatgggaggcatgatcccaatttttggtatagcaaaatatgcccagaagttccaagaccgcgttacaatgactgcggatgagtctaaaaatacggtgtacctggacttttcgtcattgcgaagcgatgacaccgctgtctattactgtgcccgtgatagaggggacacaaggttactggattatggagactacgaagatgagcggtattactacggcatggacgtgtggggccaggggactaccgtaatcgttagttccgcatctacaaaggga

SEQ ID NO: 27525 - RNA, 414 nt, synthetic construct
  misc_feature 1..414: note = derived and/or modified sequence opt3 from anti-HIV_Chain
  source 1..414: mol_type = other RNA
ttcatctgctttagcgtggtcgttagactgctcgagttcggcgggaggcttgtgcagcccggaggttccctgcggttgtcttgttcagccagtggctttaccttcagcaactccgctatgtcttgggtacgccaagcacctgggaagggattagaatgggtgtcgtcaattctgagcagtggcgtcggtacattttacgccgactccgtgaaagggcgattcactgtttctcgtgataatagcagaaacacgctatatctccagatgaagtccctgagggcggaggacaccgctctttactattgcgccaaagtgcagatacagcaactgaattttggagtcatcacagatgcaggcttggacgtgtggggcaaggggactaccctcattgtatcaagtgccagcacaaaagga

SEQ ID NO: 27526 - RNA, 414 nt, synthetic construct
  misc_feature 1..414: note = derived and/or modified sequence opt3 from anti-HIV_Chain
  source 1..414: mol_type = other RNA
caggtgcaactggtccagagcggcgccgaggttagaaagcccgggtcctctctcaaagtgtcatgcaagagtagcggaggtaccttctccaggtacgtagtgaactgggtccggcaggctcctggccaggggcttgaatggatgggaggcatcattccaatatttggtatcgcaaaatatgcccaaaagttccaggaccgcgtgacaatgactgcggatgagtctaaaaatacggtttacctggacttttcgtcattgcgaagcggggataccgctgtgtattactgtgcccgtgacagaggagatacaaggttactggactatggcgattacgaagacgagcggtattactacggcatggatgtctgggggcagggaactaccgtgacagtaagttccgcatctaccaagggt

SEQ ID NO: 27527 - RNA, 417 nt, synthetic construct
  misc_feature 1..417: note = derived and/or modified sequence opt3 from anti-HIV_Chain
  source 1..417: mol_type = other RNA
caggtgcaactggtcgagagcggcgccgaagttaagaaacccgggtcctctgtgaaggtatcatgcaaagctagtggaggtaccttcaacatctttgcattcagctgggtgagacaggcccctggccaggggctcgagtggatgggaggcattataccaatctttgcgtccccgaattacgctcagaggttccaaggtcgggtcacaattactgccgacgaatctacgtcgaccgtgcacatggagctttcaagcctgcgcagtgaagatacagcaatctattactgtgccaaggacgctcatatgcacattgaggagccccgagattatgactacatctgggggacttccccttattactttgattattggggacagggcaccttggttacagtgtctagcgcatccaccaaaggc

SEQ ID NO: 27528 - RNA, 417 nt, synthetic construct
  misc_feature 1..417: note = derived and/or modified sequence opt3 from anti-HIV_Chain
  source 1..417: mol_type = other RNA
caggtgcaactggtcgagagcggcgccgaagttaagaaacccggggcttccgtgaaggtatcttgcaaagcatcaggatacaccttcacaagtcacgacatcaactgggtgagacaggccactggtcagggcctcgagtggatggggtggatgaatcctaacagcggagatacgggctatgcgcataagtttcagggtagggtcaccatgacacggaatactccaatttccaccgcttacatggaactttcttcgctgcgctcagaggacacagccgtgtattactgtgcacgagggcgtgccaccagcagaaacactccgtgggctcactattacgatagttccggatattacggcgcaggcgactactgggggcaaggaacattggttaccgtgtctagcgcctccacgaaaggt

SEQ ID NO: 27529 - RNA, 417 nt, synthetic construct
  misc_feature 1..417: note = derived and/or modified sequence opt3 from anti-HIV_Chain
  source 1..417: mol_type = other RNA
caggtgcaaatcagacagagcggccccgggctggtcaagcctctcgagaccctttccctgtcttgcattgttttcggaggttcatttatagcctaccactggacatggatcaggcaggctccattgaaaggcttagaatggattggggacatcgatcagggaggcgacattacttatagtccgagcctgaagtcccgggtgacgatgtctgtagatcgctcgaaatcacaattcagcctaaagctcagttccgtgaccgcagccgacgcggctgtctactattgtgtgcgaggtccccctaaccgttacgccgttacatcttttactagcgggacccatagagagaggtcctcatattacttcgattattggggaccaggcacactggtgaccgtcagtagcgcatctactaaaggc

SEQ ID NO: 27530 - RNA, 423 nt, synthetic construct
  misc_feature 1..423: note = derived and/or modified sequence opt3 from anti-HIV_Chain
  source 1..423: mol_type = other RNA
aacggcgggagcctgagactctcctgcagggtgtctggattcggttttcacctttacgagatgaattgggtccggcaggcccccggcaaggggctggaatggatctcaagtattagcggatccggcgagtctacccattattcggactcaataacaggtcgcttcagcatgagtcgagatgaagctaaagactccttgtacttacaaatgaacaatctgcgtgttgaggatactgcagtgtattactgtacgagagggttttctatgggagacggcaccggcttcagctttgatacatgggggaggggaactatggtaaccgtgtcctcaggtctagacacagtcagtctcgccagcaccaagggcccttctgtgttcccactggcgccgtgctcccggtcaactagcgatgctcgccttagt

SEQ ID NO: 27531 - RNA, 423 nt, synthetic construct
  misc_feature 1..423: note = derived and/or modified sequence opt3 from anti-HIV_Chain
  source 1..423: mol_type = other RNA
caggtgcaactggtccagagcggcgccgaggttaagaaacccgggtcctctgtgaaggtatcatgcaaagctagtggaggtaccttcagcacatacgcaatctcctgggtgagacaggcccctggccaggggctcgaatggatgggaggcattataccatctttttcgatgtcaaactatgcgcaagacttccagggtaggcttactatcacggctgatgagagcaccagttccgtctacatggaactgaactctttgcggagcgaggacacagccgtgtattactgtgcacgcgattttccgcgattccaccgtttagttgggaattatgacttttggagaggaactctggataggttctcctacatggacctatggggccggggcaccgccgtgacagtctcaagtgctagcaccaagggg

SEQ ID NO: 27532 - RNA, 423 nt, synthetic construct
  misc_feature 1..423: note = derived and/or modified sequence opt3 from anti-HIV_Chain
  source 1..423: mol_type = other RNA
ctggtgcagctcgtcgagagcggcgggggagttgtgcaacccggtagatcccttaggctgtcttgcgccgcttcaggcttcacctttagtacatacgcaatgcactgggtacggcaggcccctgggaagggattggaatgggtggcggtcatcagctatgacggctccaacaaattctacgctgattctgtgaagggtcgctttactatttcgcgagacaattcaaagaacacgttatatctgcagatgaatagcctacgtgccgaggataccgcagtttactattgtgccagaccaaaattcctcccgggggctgacatagtggtcgtggtagcagccacaccctttgattactggggacagggcaaccctggccataggctgcttagtttccaccaagggccaatcggactgccccctggt

SEQ ID NO: 27533 - RNA, 423 nt, synthetic construct
  misc_feature 1..423: note = derived and/or modified sequence opt3 from anti-HIV_HeavyChain
  source 1..423: mol_type = other RNA
atggagtggagcggcgtgttcatctttctgctctccgtcaccgccggggttcactctgaagtgcagcttgtagagtcaggaggtggcctggtgaagcccgggggaagtttgagattaagctgcgctgcatccggctacacattctctaactattggattggttgggtcaggcaagcccctgggaaaggactggaatggataggcgacatctacccaggcgggaattatattcggaacaatgagaagtttaaagataagactacgctatcggcggacacctcaaagaacacagcttacctccagatgaatagcctgaaaactgaagataccgccgtgtattactgtggaagttccttcggttctaactatgtttttgcatggttcacatactggggccaggggacccttgtgactgtcagctcc

SEQ ID NO: 27534 - RNA, 423 nt, synthetic construct
  misc_feature 1..423: note = derived and/or modified sequence opt3 from anti-HIV_HeavyChain
  source 1..423: mol_type = other RNA
atggagtggagcggcgtgttcatctttctgctctccgtcaccgccggggttcactctcaggtgcaacttgtacagtcaggaccggacgtgaagaaacctggtacaagtatgaagatgagctgcaaaacttccggctacacgttctctaactattggattgggtgggtcagacaggctccaggacagggcctggaatggataggtgatatctaccccgggggaaattatattaggaacaatgagaagtttaaagacaagaccacattgactgcagatacctcgacatcaaccgcctacatgcaattaggcagcctgcggagtgaagacactgcggtgtattactgtggctcctctttcgggagcaactatgtttttgcttggttcacatactggggacagggtaccctagtgacggtctcctca

SEQ ID NO: 27535 - RNA, 429 nt, synthetic construct
  misc_feature 1..429: note = derived and/or modified sequence opt3 from anti-HIV_Chain
  source 1..429: mol_type = other RNA
caggtgttcgtccaactggttcagagcggcgggggactcgtgcagcccggtggctccgtaagactttcttgcaccgcctcagggtttctgttcagtacatacagcatgaactgggtgaggcaggctcctggaaagggcttggagtgggtctcctctatctcgactacgtcaaattatatttactatgcagacagcgtgaaaggtcggtttaccataagtcgctccaacgggcaaggatctttatacctgcagctaaatagcctccgagttgaagatacagccgtgtattactgtgcgcgtgacactaaggtcggcgctccaagacaggattgctatgccatggacctgtggggccagagggatcacgggcatcggcttctgtccttccaccaaggaccgatcggtttgccccctggcgcactcctgcag

SEQ ID NO: 27536 - RNA, 432 nt, synthetic construct
  misc_feature 1..432: note = derived and/or modified sequence opt3 from anti-HIV_Chain
  source 1..432: mol_type = other RNA
atcattctgttcctcgtggccaccgctacaggcgtccacagcgacatacagatgactcaatccccctcttcacttagtgcaagcgttggggatagagtgacgattacctgcagggcctcccagtctatcgaccggtacctgaactggtatcagcataagcctggaaaagcgccaaagttgttaatctacgctgcctcgaatctgcacacagatgtaccgtcacgctttagcggtagtggcgcagggacttatttcaccctaacaattacctccctccagcccgaggactttgccacttactattgtcaacagtctcatagcccttccttcggacaggaatcatacagtatcgcttttggccagggtacacgactggagataaaacgtaccgtggcagccccaagcgtcttcatctttcccccttctgatgaa

SEQ ID NO: 27537 - RNA, 432 nt, synthetic construct
  misc_feature 1..432: note = derived and/or modified sequence opt3 from anti-HIV_Chain
  source 1..432: mol_type = other RNA
ctgcagcaactccaggtgcccagacttagcatgtggagggtcttcaaggttgccgctgcaaccggcgcccagacactgactgtggaggaacctgggtcctctgtaaaagtgtcatgcaaggcgagtggaggtagctccacggcttacggctattcttgggtccggcaggccccagggcaaggatttgagtggatgggccgcatcattccgttctacggtataatcacctatgcacccaaatttcaggggcgagtgacaattactgccgaccgttcgacctcaacagtttacatggaattgaccagcttaactttcgctgatacagcactgtttttctgtgccagagactttggagatcctaggaacggctattacttcgacagttgggatcagggcctatggctcaccgtgtcctctgctagcacgaagggg

SEQ ID NO: 27538 - RNA, 432 nt, synthetic construct
  misc_feature 1..432: note = derived and/or modified sequence opt3 from anti-HIV_Chain
  source 1..432: mol_type = other RNA
caggtgagactggagcaaagcggcgtcgccatgaggaagcccggggcttccgttaccctctcttgccaggcatcaggatacaacttcgtgaaatatatcattcactgggtacggcagaagcctggtcttggctttgaatgggtggggatgatagacccataccgcggacgaccgtggagtgcccataaattccagggccgtctgagcttgtccagagatacatctatggagatcttatatatgactctgacgtcgctaaagtcagacgataccgcgacatacttttgtgctagggccgaagcagccagcgacattcacagtcggcccatcattctcactggtcctggggagtatggactggatcttgaacatatggactggacctggcgcatcctgtgcttgctcgctgtcgcaccaggctgtcactcccaa

SEQ ID NO: 27539 - RNA, 435 nt, synthetic construct
  misc_feature 1..435: note = derived and/or modified sequence opt3 from anti-HIV_Chain
  source 1..435: mol_type = other RNA
atgttcctgtttctcgtggccggcgctaccggggtccagagccaagtttaccttgtgcccttcggacctgaggtaaagaaaccaggttcctctgtgaaggtctcatgcaaagcaagtggcgacagctttacatcctctgtgatcacttgggttagacaggccccggggcagggacccgaatggatgggcagggtgattcctgtcctgggtgtggcggcttatgcccagaagttctacgggcgggtaacgataaccgcagatacatcgtcaaacactgcctatatggaggttaatagcttgcgctttgaagacaccgctgtgtactattgtgcacgagagacaggacgtggcggcaacttagccctgagacaatacttctttgatagttgggggcagggaaccctagtcactgtgtcctctccaagcacaaaaggt

SEQ ID NO: 27540 - RNA, 438 nt, synthetic construct
  misc_feature 1..438: note = derived and/or modified sequence opt3 from anti-HIV_Chain
  source 1..438: mol_type = other RNA
caggtgcaactgcaggagagcggccccgggctcgtcaagccttccggaaccctttctctgacatgcgccgtttcaggtgctagtatcagctccagaaactggtggacttgggtgaggcagccaccgggcaaagggttggaatggattggagagatatacgaatctggcgcaacgaattataacccctcgttaaagtcacgggtaaccatcagcgtggacaaaagtaagaatcagttctccctgcgcctaacatctgtcactgccgcggataccgctgtgtacttttgtgcccgactcatgacattcggtgggctgattggaacccttgactattggggccaaggcactctggttacagtgttgcagcctccaccccgtgcacacagataccatcctaggaacctcctgcaggagcacctgtgcgcccgggtcatgcca

SEQ ID NO: 27541 - RNA, 444 nt, synthetic construct
  misc_feature 1..444: note = derived and/or modified sequence opt3 from anti-HIV_HeavyChain
  source 1..444: mol_type = other RNA
atggagtggagcggcgtgttcatctttctgctctccgtcaccgccggggttcactctgaagtgcagcttgtagagtcaggaggtggcctggtgaagcccgggggaagtttgagattaagctgcgctgcatccggctacacattctctaactattggattggttgggtcaggcaagcccctgggaaaggactggaatggataggcgacatctacccaggcgggaattatattcggaacaatgagaagtttaaagataagactacgctatcggcggacacctcaaagaacacagcttacctccagatgaatagcctgaaaactgaagataccgccgtgtattactgtggaagttccttcggttctaactatgtttttgcatggttcacatactggggccaggggacccttgtgactgtcagctccggagagtcactgaagccgttg

SEQ ID NO: 27542 - RNA, 444 nt, synthetic construct
  misc_feature 1..444: note = derived and/or modified sequence opt3 from anti-HIV_HeavyChain
  source 1..444: mol_type = other RNA
atggagtggagcggcgtgttcatctttctgctctccgtcaccgccggggttcactctcaggtgcaacttgtacagtcaggacccgacgtgaagaaacctggtacaagtatgaagatgagctgcaaaacttccggctacacgttctctaactattggattgggtgggtcagacaggctccaggacagggcctggaatggataggtgatatctaccccgggggaaattatattaggaacaatgagaagtttaaagacaagaccacattgactgcagatacctcgacatcaaccgcctacatgcaattaggcagcctgcggagtgaagacactgcggtgtattactgtggctcctctttcgggagcaactatgtttttgcttggttcacatactggggacagggtaccctagtgacggtctcctcaggcgagagtctcaagccgctg

SEQ ID NO: 27543 - RNA, 447 nt, synthetic construct
  misc_feature 1..447: note = derived and/or modified sequence opt3 from anti-HIV_Chain
  source 1..447: mol_type = other RNA
caggccagactggaccaatggggcaccgggctccttaagcccagcgagacactgtccttgaaatgcgctgtgttcggagtcttatttactgattacaactggacgtgggttaggcagtctcctggtaagggcctggaatggatcgggcacctagaccatcggggaggcggtaattataacccatcactcgagagtcgcgtgaccattagcctggattactccaaagcacagttctctcttcacctgaagtcggtaacagtggccgacactgcgttgtattactgtgctggggccgtcaaaggattttggttcgatgaagtgtataattggtttggcccgggcgttcgagagccctggctcccttcaccacagccccctccacgtgcacatagaagcagtccctggcaccctccaccgagggctcccctggtgaccgccacagtccct

SEQ ID NO: 27544 - RNA, 447 nt, synthetic construct
  misc_feature 1..447: note = derived and/or modified sequence opt3 from anti-HIV_Chain
  source 1..447: mol_type = other RNA
caggccagactggaccaatggggcaccgggctccttaagcccagcgagacactgtccttgaaatgcgctgtgttcggagtcttatttactgattacaactggacgtgggttaggcagtctcctggtaagggcctggaatggatcgggcacctagaccatcggggaggcggtaattataacccatcactcgagagtcgcgtgaccattagcctggattactccaaagcacagttctctcttcacctgaagtcggtaacagtggccgacactgcgttgtattactgtgctggggccgtcaaaggactctggtttgatgaaacctatacatggttcggcccgtggtcacagggcacccgagtgactgttgcaagcgccagtacaaaggggccctccgtgtttcctctggctccatctagcaagtccacctcaggaacgcgtgacctgagt

SEQ ID NO: 27545 - RNA, 447 nt, synthetic construct
  misc_feature 1..447: note = derived and/or modified sequence opt3 from anti-HIV_Chain
  source 1..447: mol_type = other RNA
gccgctagactggaccagtggggcaccgggctcgtgaagcccagcgagacactttccctgaaatgcgcagtcttcggagttgattttcctgactacacttggacgtgggccaggcaagcgccaggtaagggcttggaatggatcgggcaccgggatcatcgcggaggttcttcatataacccgagtttaagcggccgagctaccatttccctggacacatctaaagcccagttctcgctacacataaagtcagtgactgtagcagataccgccacatactattgtgctggggcagtggccggactctggtttgaggacgcttacaattggttcggcccctggagccagggcaccctggtcactgtggccgcggcaagtacaaaagggccttccgtttttccacttgccccctctagcaagtccacctcaggacatgctagtgtgctg

SEQ ID NO: 27546 - RNA, 450 nt, synthetic construct
  misc_feature 1..450: note = derived and/or modified sequence opt3 from anti-HIV_Chain
  source 1..450: mol_type = other RNA
ctggcccagctcgagcaaagcggcgggggagtggtcaagcccggtggctcccttagactgccttgcgctgcatctgggttcacctttatcgactactatatggcctggattaggttggcgccaggaaaaggcttagaatggctgtcatacataagtaagaacggtgattatacaaaatacagcgagtccctaaaggggcggttcactatctctcgcgacaatgctaaaaacctcgttattctgcagcttaatcgactgcgtgccgatgacacggcaatctatttttgtgccagagctgatggattgacctacttcggcgaactcctgcagtatatttttgacctgtggggccagggggcaagggtgatcgtatcgtcagccagcacaaagggaccgagtgtgttccccctcgctccttcctctaagagcacttccggtcacgcctcagtc

SEQ ID NO: 27547 - RNA, 459 nt, synthetic construct
  misc_feature 1..459: note = derived and/or modified sequence opt3 from anti-HIV_Chain
  source 1..459: mol_type = other RNA
caggtgcaactggtccagagcggcgccgaggttaagaaacccggggcttccgtgaaggtatcttgcaaagtgtcaggatacaccctcacagaacttagtatccactgggtcagacaggcacctggtaagggcctggagtggatgggagggttcgacagcgaagatggcgaggccatttataaacagaactttcaaggtagggtgactatgacggaagacacctccacagatactgcgtacatggagttgtctcggttacgctcggaggacaccgctgtttattactgtgccacagcagatcgattcaaggtggcccaggacgaagggctgtttgtcatattcgattattggggacagggcaatccaggccatcgtctactctcactgcaccaggggccgatcggacttccccctggtaccctgccacccaaggctactagcggccatgcagccagaagg

SEQ ID NO: 27548 - RNA, 462 nt, synthetic construct
  misc_feature 1..462: note = derived and/or modified sequence opt3 from anti-HIV_Chain
  source 1..462: mol_type = other RNA
ctggtgcagctcgtccaaagcggcgccgaggttaagaaacccggggcttccgtgaaggtatcttgcaaagtgtcaggatacagtcttaccgaactgagcatccactgggtcagacaggcacctggtaagggcttggagtggatgggagggttcgactccgaagatggcgaggccatttataaacagaactttcagggtagggtgacaatgactgaagacacgtctaccgatacagcgtacatggagttatcgcggctgcgctcagaggacactgctgtttattactgtgccaccgcagatccattcaaggtggcccaagacgaagggctatttgtcatattcgattattggggacagggcacaaccggccatcgactcctgagccttcaccaggggccgcatcgtctgtacagtttgggaactctcctgtccagagctcccatcgtgcagacacacatggca

SEQ ID NO: 27549 - RNA, 471 nt, synthetic construct
  misc_feature 1..471: note = derived and/or modified sequence opt3 from anti-HIV_Chain
  source 1..471: mol_type = other RNA
cagatccacctggtgcaaagcggcaccgacgtcaagaaacccgggtcctctgttacagtgtcatgcaaggcctacggagtaaacactttcggtctctatgctgtgaattgggtcagacaggcacctggccagagtcttgagtacattgggcagatatggaggtggaaaagctccgcctctcatcactttcggggacgcgtgctgatctcggcggttgatttgacgggctcaagcccaccgattagttccttagaaatcaagaacctgacctctgacgatacagctgtgtatttctgtactaccacaagcacctacgaccaatggtccggtctacatcacgatggggtcatggccttttcaagtcgaggacagggcactctcattagcgtgtctgcagcctccacaaaaggcccctcagtattccctctggctccaagcagtaagtctacctatgggcttgcacatgttctg

SEQ ID NO: 27550 - RNA, 477 nt, synthetic construct
  misc_feature 1..477: note = derived and/or modified sequence opt3 from anti-HIV_Chain
  source 1..477: mol_type = other RNA
cagcaccaactggtgccctgcgtcgccgaggttagaaagcctggcgctagcgtgaaagtatcctgtaaggtgtctgggtacaccctcacagaaatctcaatgcattgggtcaggcaggcaccaggaaaaggtcttgagtggatgggcgggttcgaccgggaagatggagagactatttatgcccagaagtttcagggccgcgtgacgatgaccgaagacacaagtactgataccgcgtacatggagctgagctccttgcgatctgaggacacagctgtttattactgcgccaccacttatttagcagtggtcccggatggtttcgacgggtactcgtcaagctggtattggtttgatccctggggacaaggcacactggtgaccgtaagttccgcctctatgcagggccctatgctactcagcccaacggggactctgcttccccgtgctcctctggttcagaccagaccaggaccc

SEQ ID NO: 27551 - RNA, 642 nt, synthetic construct
  misc_feature 1..642: note = derived and/or modified sequence opt3 from anti-HIV_LightChain
  source 1..642: mol_type = other RNA
gacatcgtgattacccagagcacaaagttcatgtccacttctgtcggcgatagagtttcaataacgtgcaaagccagtcaagacgtgagcaccgctgtagcatggtaccagcagaagcccgggcagtcccctaaactgctcatctattgggcctctacaaggcacactggagtgccagatcggtttaccggttcgggctcagggacagactacacccttactattagccgcgtccaagcggaggatctggctttgtattactgtcagcagcattatacaaccccgtggacgttcggaggcggtactaagttagaaatcaaacgaaccgtggccgcacccagttttgttattttccctccatccgacgagcagctgaagtctgggacagccagcgtggtctgcctactcaacaatttttacccccgtgaagctaaggtgcaatggaaagtagataacgcactgcagtccggaaattcacaggagagtgttactgaacaggacagcaaggattctacctattccctttcaagcacactgaccttgagtaaagccgactacgagaagcacaaagtgtacgcttgtgaggtcacgcatcaaggcctctcttcccctgtgactaagagcttcaacagaggcgaatgc

SEQ ID NO: 27552 - RNA, 651 nt, synthetic construct
  misc_feature 1..651: note = derived and/or modified sequence opt3 from anti-HIV_Chain
  source 1..651: mol_type = other RNA
cagagcgtgctgacccaacccccttccgtctctgccgctccaggccagaaggttacaatctcatgcagtgggagctcctctaacattggaaataactacgtgctctggtatcagcagttcccgggtactgcacccaaacttctgatatacggcaataacaagagaccttcggggatcccagacaggttttcaggaagcaaaagtggcacgtccgccaccttgggtattacagggttacaaactggagatgaggcggactatttctgtgctacctgggattctggcctgagcgccgactgggtatttggcgggggaacaaagctaaccgtgctctcccagcccaaagcagccccttcagtcactctgttcccacccagtagcgaggaacttcaggctaataaggcaacactggtgtgcttgatctctgatttttaccctggtgccgttaccgtggcttggaaggccgactcctcaccagtcaaagcgggcgtggaaacgactaccccgagcaagcagagtaacaataaatatgcagcctcttcctacctcagcctgacacccgagcaatggaagtcgcaccggtcttattcctgtcaggtaactcatgaagggtcaaccgttgagaaaacagtggctcctaccgagtgcagt

SEQ ID NO: 27553 - RNA, 657 nt, synthetic construct
  misc_feature 1..657: note = derived and/or modified sequence opt3 from anti-HIV_Chain
  source 1..657: mol_type = other RNA
gacatcgtgatgacccagagccccgattccctggccgtctctctcggcgagagagttacaatgaactgcaagtcaagtcaaagccttctgtactccactaatcagaaaaactatttggcttggtaccagcagaagcctgggcaatctccaaaattactgatttattgggcaaattcgacggaatcaggagtgccggacaggttcagcggtagtggctccgggaccgattttacactaactatatctagcgtacaggccgaggacgtggcggtctactattgtcagcagtactattcctaccggaccttcggaggcggtacaaagctcgaaatcaaacgcaccgtggctgccccctcagtttttattttccctccaagtgatgagcaacttaagagcgggactgcatctgtggtctgcctgctgaacaatttttacccccgagaagccaaggtgcagtggaaagtagacaacgctttgcagtccggaaattcacaggagagcgttacagagcaagatagtaaggactctacctattccctcagctcgacgctgactctgtctaaagcagattacgaaaagcacaaagtgtatgcctgtgaggtcacccatcagggcctctcctcacctgtgacaaagagtttcaaccgtggcgaatgc

SEQ ID NO: 27554 - RNA, 753 nt, synthetic construct
  misc_feature 1..753: note = derived and/or modified sequence opt3 from anti-HIV_SingleChain
  source 1..753: mol_type = other RNA
atgcaagtgcagctggagcagagcggcgccgaagtcaagaaacccggggcttccgttaaggtgtcttgccaggcatcaggatacagattcagtaactttaccgtacactgggtgaggcaggcccctggtcaacggttcgagtggatgggctggatcaatccatataacgggaataaagaatttagcgcgaagttccaggaccgcgtcacatttactgctgatacgtccgccaacaccgcatacatggagctccgatctcttcgttcggccgacacagctgtgtattactgtgcaagagttggagaatggggctgggatgactcaccgcaggataattattacatggacgtgtggggtaaagggactaccgtcattgtgagcagtggaggcggcgggtccggaggtggcgggtctggaggcggtgggagcgatatagagctgacacagtcccccggaaccttgtcattaagtcctggcgagagggccactttcagctgccggtcttcccattcaatccgcagcagaagggtagcttggtatcaacacaagccaggccaggcgccccggctggttattcatggggtgagtaaccgcgcctctggaatctccgaccgatttagcggttcgggctctgggacagatttcaccctaacgattactagagtcgaacctgaggactttgcactctactactgtcaggtgtatggagcctcctcatacaccttcggccagggtacaaagctggaaaggaaa

SEQ ID NO: 27555 - RNA, 1338 nt, synthetic construct
  misc_feature 1..1338: note = derived and/or modified sequence opt3 from anti-HIV_LightChain
  source 1..1338: mol_type = other RNA
gaggtgaagctggaagagagcggcgggggactcgtccagcccggtggctccagaaaactttcttgcgccgcttcagggttcacctttagtagcttcggaatgcactgggttaggcaagcacctgaaaagggcctggagtgggtggcctacatctcctctggttcgtcaacattgcattatgcggacactgtaaaagggcggtttacgattagccgcgataacccaaagaataccttattcctgcagatgaaactaccgagtctctgttacggactgcttggctcccgaaacctgtctcaccgtttgctcagccagaatgacacacccatatgcctgactgtgtcctcagctagtaccaagggccctagcgtctttccactggccccctcttccaagtcaacaagcgggggaaccgcagccctcggttgtttagtgaaagattatttccctgaaccagttactgtgagttggaactctggcgctctgacatccggggtccatacctttcccgcagtgcttcagagctcgggattgtactctctgtcctcagtagttacggtgcctagtagctccctaggcactcaaacctatatctgcaatgtcaaccacaagccatctaatacaaaagtggacaagaaagtggagcccaagagctgtgataagactcatacctgcccgccttgtccagcccccgagctcctgggtgggccttcagtcttcctttttccacccaaaccgaaggacacactgatgattagtagaacccctgaagttacgtgcgtggtagtggatgtctcccacgaggaccccgaagtgaaattcaactggtacgttgatggagtggaggtccacaatgctaagactaaaccaagggaggaacagtataacagcacataccgggtggtatctgttttgaccgtgctccatcaggactggctgaatggcaaggagtacaaatgtaaggtctcaaacaaggccttacctgcgcccatcgagaaaactattagtaaggcaaaaggccagccacgcgaaccccaagtgtatacactgcctccaagcagagaagagatgaccaagaatcaggtctccctcacgtgccttgtgaaagggttttacccgtctgatatcgccgttgagtgggaatcgaacggacagcccgagaataactataagaccacacctccagtgctggacagcgatggttccttctttttgtactcaaagctaactgtagacaaaagtaggtggcagcaaggcaacgtcttctcttgtagcgtgatgcacgaagctctgcataatcactatacccagaagtccctctcactgagccccgggaaa

SEQ ID NO: 27556 - RNA, 1380 nt, synthetic construct
  misc_feature 1..1380: note = derived and/or modified sequence opt3 from anti-HIV_Chain
  source 1..1380: mol_type = other RNA
gaggtgcagctggtcgaaagcggcgggggactcgttaagcccggtggctcccttagactgacctgcgtggcctctgggttcacattttcagacgtatggttgaactgggtgaggcaagctcctggaaaaggcttagagtgggtcggtcggatcaagagtcgcactgatgggggaacgaccgactacgcagccagcgtgaaaggccgattcacaatttcccgtgatgactctaagaatactctgtatctacagatgaactcgctcaaaaccgaagatacagcggtttactcatgtaccactgacggctttataatgatcagaggggtgagcgaggattattactattactatatggacgtctggggaaagggtacaaccgtgacggtaagttccgcttctactaagggcccaagcgttttcccgctggccccctcctcaaaaagtaccagcgggggaacagcagcccttggctgcctggtgaaggattactttcctgaaccagtcactgtgtcttggaactccggtgctttgacctcaggggtgcacacattccccgcagtcctccagagcagtggactgtactctctgtccagcgttgtgaccgtaccttcgtcttccctcggcacgcagacttatatttgtaatgtgaatcataaaccatcaaacacaaaggtcgacaaaaaggtggagcccaagagttgcgataaaacccacacttgtcctccatgcccggcccccgagttactgggcgggcctagcgtttttcttttcccacccaagcctaaagacacattgatgatctccaggaccccagaagtgacgtgtgtcgtggtagatgtttctcatgaggaccccgaagtgaagtttaattggtacgtcgacggagtggaggtccacaacgctaaaaccaagccgcgggaggaacaatataatagcacataccgcgtggtttcagtgctgactgtactacatcaggattggctcaacggtaaagagtataagtgcaaggtcagtaataaagccctgcctgcgcccattgaaaagaccatctccaaagcaaagggccagccaagagagcctcaggtgtacacacttcccccaagcagggacgaactgactaaaaaccaagtttctttgacctgtctcgtgaaggggttctatccctcagatatagccgtcgagtgggagagtaatggacagcctgaaaacaattacaagacaaccccaccggtgctggacagcgatggctcctttttcttatactctaaactgactgtagacaagtcgcggtggcagcagggtaacgtgtttagctgctccgttatgcacgaggctctccacaaccattatacgcaaaaatcacttagtctgtctcccggg

SEQ ID NO: 27557 - RNA, 1413 nt, synthetic construct
  misc_feature 1..1413: note = derived and/or modified sequence opt3 from anti-HIV_Chain
  source 1..1413: mol_type = other RNA
atggagtggagcggcgtgttcatgtttctgctctccgtcaccgccggggttcactctcaggtgcaacttcagcagtcaggacccgaagtagtgaagcctggtgctagtgtcaaaatgagctgcaaggcatccggctacacattcacttcttatgtgatccattgggttagacagaaaccagggcaaggactggactggattggctacataaacccgtataatgatggtacggactacgatgagaagtttaaagggaaggccaccttgacatcggacacttcaaccagcacagcgtatatggaattaagttccctgaggtctgaggataccgctgtgtactattgtgcccgggaaaaggacaactacgcaactggagcctggttcgcttactggggccagggcaccctagtcacagtgagctccgcatcaacgaaagggcccagtgtatttcctctcgccccaagctctaagtccacttcaggaggtaccgctgccctgggctgccttgttaaagattatttccccgagcctgtgacagtcagctggaatagtggggcgctgacttctggagtgcacacctttccagcagtgttgcagtccagcggcctctactcgctgtcttccgtcgttacagtgccctcaagtagcctgggtacccagacgtatatctgtaacgtaaatcataagccttccaacactaaagtggacaagaaggtcgagccaaaatcttgcgataagacacacacctgtccgccctgccctgccccagagttcgaagggggacccagcgtgtttctcttccctccaaaacccaaggacactttaatgatttcacgcacaccggaagttacctgtgtggtcgtggatgtaagtcatgaggaccctgaggttaaatttaattggtacgtggatggcgtcgaagtgcacaacgctaagacgaaaccccgagaggaacaatataattccacctaccgtgtcgtgagcgttctgacagtgcttcaccaggactggttgaacggcaaggagtataagtgcaaagtatctaataaggccctgccagcatcaatcgagaaaactattagtaaggctaaagggcagcctagagaaccccaggtctacaccctaccacccagcagggacgagctcacaaagaaccaagtgtccctgacttgtcttgttaagggattctacccttctgatatcgccgtggaatgggagtcgaatggtcagccagaaaacaattataaaaccacaccgcccgtcctggacagcgatggctcctttttcttgtactcaaagctcaccgtggacaaaagtcggtggcagcaagggaacgtattctcttgcagcgtgatgcatgaggcgctgcacaaccattatactcagaagtccttatcactgagccctggaaaa

SEQ ID NO: 27558 - RNA, 645 nt, synthetic construct
  misc_feature 1..645: note = derived and/or modified sequence opt3 from anti-influenza_Fab
  source 1..645: mol_type = other RNA
atcgtgctgacccagagccccgccacactctccgtctctcctggcgagcgggctactctttcatgcagggcaagtcaagttattagccacaacctggcctggtaccagcagaagccagggcaggcgccgcggttgttaatatatggagcttccacgcgcgcctctggtatccccgcacgattctcgggctcagggagcggaaccgactacacactgactattaccagtctacaacctgaagattttgccgtgtattactgtcagcattattccaattggccaccccgtctcacattcggcggtgggaccaaagtagagatcaagagaactgtggctgcaccttctgtctttattttcccacccagcgacgaacagctgaaatccggaacagcctcagtggtttgccttctgaacaatttttaccctagggaggctaaggtgcagtggaaagtcgataacgccttgcaaagtggcaatagccaggaatctgtgaccgagcaggactccaaggattcaacgtatagcctcagttctactctgaccctgtccaaggcggactacgagaaacacaaggtatacgcatgtgaagttacacatcagggcctcagctcgccagtgactaaatctttcaacagaggggagtgc

SEQ ID NO: 27559 - RNA, 681 nt, synthetic construct
  misc_feature 1..681: note = derived and/or modified sequence opt3 from anti-influenza_Fab
  source 1..681: mol_type = other RNA
gtgcagctggtcgagagcggcgggggagttgtgcaacccggtaagtcccctagactctcttgcgccgcttcaggcccaaccttcagtagctacgcagtacactgggtgaggcaggccccggggaaaggacttgaatgggtcacactgatctcctatgacggcgcgaaccagtactatgctgattctgtgaagggtcggtttactatttcgcgcgacaattcaaagaacacggtttacttgcagatgaatagcttacgacccgaggataccgccgtgtattactgtgcagtccctgggccagtgttcggaatatttcccccttggagttatttcgacaactggggccaaggcatcctggtaacagtttcctctgccagcactaaagggccatccgtgtttcccctagctccttcaagtaaaagcacctctggaggtacagcagccctcggctgcctggtcaaggattacttcccagaaccggtgaccgtgtcctggaactcaggggctcttactagcggagtccatacatttcccgccgttctgcagagttctggcttgtactccctcagctcggtggtaaccgtgccttcttcctcactgggtacgcagacttatatttgtaatgtcaatcacaagccaagtaacaccaaagtggacaagaaagttgagcccaagagctgc

SEQ ID NO: 27560 - RNA, 1515 nt, synthetic construct
  misc_feature 1..1515: note = derived and/or modified sequence opt3 from anti-influenza_Fab
  source 1..1515: mol_type = other RNA
gccggcagcaccgctacactgtgcctcgggcaccatgcagtgcccaacggaactatcgtcaagacgattaccaatgaccagatagaggttacaaacgccactgaacttgtgcaatcctcttcaaccggtgagatctgtgatagtcctcaccagattctggacggcaaaaattgcacattgatcgatgcgttactgggggacccacagtgtgatggattccagaacaagaaatgggacctatttgtagaaagaagcaaggcttactccaattgctatccgtacgatgtgcccgactatgcctctctcaggtcgctggtcgcatcaagcggcacccttgagttcaacaatgaaagttttaactggactggtgtgacacaaaatgggacctcctctgcctgtattcggcgcagcaaaaactccttcttttcacgactgaattggttgacgcatctcaacttcaagtaccctgctctgaatgttactatgccaaacaatgagcagtttgataagctgtatatctggggagtgcaccatcccggcaccgacaaagatcagatattcctctacgcacaggccagtggccgtatcacagtcagcactaagagatctcaacagaccgtgtcccctaacattgggtcaaggccacgggtacgcaacatccccagcagaattagtatctattggacaatagttaaacctggagacattttactgatcaattctaccggtaaccttattgctccaaggggctactttaagatccggtccgggaaaagctcgatcatgcgctctgatgccccgattggaaagtgcaattccgagtgtataacgcccaacggctcaatccctaatgacaagccattccagaacgtgaatcgaattacttacggtgcgtgccccagatatgtcaaacagaacacattgaagctggcaaccgggatgaggaatgtgcctgaaaaacaaactcggggaatctttggcgccatagctggcttcattgagaacgggtgggaaggaatggtggacggttggtacggctttcgtcaccagaatagtgaggggcgcggacaggccgcagatctaaagagcacacaagctgccatcgaccagatcaacggcaaactcaatagactgattggtaagaccaacgagaaattccaccagatcgaaaaggagttctccgaagtcgaggggaggattcaggatcttgaaaagtatgttgaggacacgaaaatagatctgtggtcttacaatgcggagttgctcgtggccctggaaaaccaacataccatcgacttaacagatagcgagatgaacaagctgtttgagaaaactaagaaacagctccgggaaaatgcagaagacatgggcaacggatgtttcaagatttatcacaagtgcgataatgcttgtatcggctcaatccgaaacgggacctacgaccatgatgtatatcgcgacgaggcccttaataacagatttcagattaaaggaagtggtaggctggtgccacgg

SEQ ID NO: 27561 - RNA, 657 nt, synthetic construct
  misc_feature 1..657: note = derived and/or modified sequence opt3 from anti-influenza_Fab
  source 1..657: mol_type = other RNA
caggtgcaactggtccagagcggcgggggagttgtgcagcccggtagatccctcaggctttcttgcgccgcttcagagttcacctttcggatgtacgcaacacactgggtacgccaggcccctggcaaggggctggaatgggtggcgttgatcagttatgacggaagcaacaaatactatgctgattccgtcaagggccgattcactatttctcgtgacaattcgatgaacacggtgtacttacaaatgaataccctgagaccagaggatacagccgtttattactgtgcaagggacctaggtgggtattttatacggggaatcatggatgtgtggggccagggcactctcgtcaccgtgtcaagcgccagtacaaaagggccgtccgtattccccctggctccttctagcggaggtaccgcagcccttggctgcctggttaaggactactttccagaacccgtgactgtctcctggaactcaggggctttgacaagtggagtgcataccttccctgccgtgctccagagctctggcctgtactccctgtcaagcgtcgttacggtgccaagttcttccctcggtactcagacctatatttgtaatgtaaaccacaaacccagcaatacaaaggtggataagcgcgtcgagcctaaa

SEQ ID NO: 27562 - RNA, 642 nt, synthetic construct
  misc_feature 1..642: note = derived and/or modified sequence opt3 from anti-influenza_Fab
  source 1..642: mol_type = other RNA
gagctgcagatgacccaaagcccctcctctgtgtcagccagtgtcggcgacagagttacaatcacttgcagggctagccaggggatttcctcttggctcgcatggtaccagcagaagcctggaaaagccccaaaacttctgatatatgcggcttcgtcattgcaaagcggtgtgccgagtcggttctccggctctgggagcggaacggattttaccttaacaatctcctcactgcagcccgaagacttcgccacttactattgtcagcaggcaaacagttttcctctaaccttcggcggtgggacaaaggtagagattaagcgcaccgtggccgctccaagcgtctttatctttcccccttctgatgaacaactcaaatccggaactgcatcagtggtttgcctgcttaataacttctacccacgagaggccaaggtgcagtggaaggtcgacaatgctctgcagagcggcaacagtcaggaatctgtgacagagcaagattccaaagacagcacctattcgttgtcttccacgctcactctgtcaaaggccgattacgagaaacacaaggtatatgcgtgtgaagttacccatcagggcctgagtagccccgtgacaaaatccttcaatcgtggggagtgc

SEQ ID NO: 27563 - RNA, 993 nt, synthetic construct
  misc_feature 1..993: note = derived and/or modified sequence opt3 from anti-influenza_Fab
  source 1..993: mol_type = other RNA
gccgaccccggcgataccatctgcattgggtaccacgctaacaatagcacagacactgtggatacggtcctggagaagaacgttaccgtgacacattccgtaaatctccttgaagactctcacaacggaaaactgtgtaagttgaaaggtatagcacctttacagctgggcaagtgcaatatcgccgggtggctactcggaaacccagagtgtgatctgcttctgactgcgtcaagttggagctatattgtggaaacctccaattctgagaacggcacatgctacccgggtgacttcatcgattatgaagagttgagagagcaactctcgtcagtcagcagttttgaaaaattcgagatttttcccaagacctcctcttggcctaatcatgaaactacaaagggggtgaccgctgcctgtagctacgcaggagcctcctcattctataggaacctgctgtggctcacgaaaaagggcagtagctacccaaaattatctaagtcctatgttaataacaaaggcaaggaggtgctggtcctttggggagtgcaccatccccctactgggaccgaccagcagtcattgtaccagaatgctgatgcatacgtaagcgttggtagttctaagtataaccggcgctttacaccagagatcgccgctcgacccaaagtgcgtgaccaagccggcagaatgaattactattggactctgctagaacctggggataccataacattcgaggcgaccggaaacctcatcgcaccatggtacgcctttgctctgaacaggggctccggtagcgggattatcacgtcggacgccccggtccacgattgcaatactaagtgtcagacaccccacggagcaattaactcttcccttcctttccagaatatccatccagtgaccataggcgaatgccccaaatatgtgcggtcaactaagctgcgcatggctacaggcttgagaaacattcctagtatccagagcagg

SEQ ID NO: 27564 - RNA, 537 nt, synthetic construct
  misc_feature 1..537: note = derived and/or modified sequence opt3 from anti-influenza_Fab
  source 1..537: mol_type = other RNA
ggcctgttcggggccatcgctggatttattgagggtggctggaccgggatgatagacggatggtacggctatcaccatcagaacgaacaaggtagcgggtacgcagccgatcagaagtccacacagaatgcgatcgacggaattactaacaaagtcaattctgtgatcgagaagatgaacacgcagttcaccgctgttggcaaagaatttaataacctcgagagaaggattgaaaatcttaacaagaaagtggatgacggcttcctggatatctggacatataatgccgagttgttagtactgctagagaacgaacggactctcgactttcacgattcaaatgtgcgcaacctgtacgagaaggtcaagagtcaacttaaaaataacgcaaaggaaatagggaatggatgcttcgagttttatcataaatgtgacgatgcctgcatggagagcgtgcgaaacggtacctacgactatcccaagtactccgaagagtctaaactgaaccgtgaagagatcgatggcgtttcggggaga

SEQ ID NO: 27565 - RNA, 642 nt, synthetic construct
  misc_feature 1..642: note = derived and/or modified sequence opt3 from anti-influenza_Apo
  source 1..642: mol_type = other RNA
cagagcgtgctgacccaacccccttccgtctctgttgccccaggccagacagctagaatcacttgcgggggaaacgacattggtaggaagtcagtgcactggaatcagcagaaaccgggccaagcacccgtactcgtggtctgttacgatagtgaccggcctagcgggataccagagcgcttctccggatctaactcgggcaatacggccacccttacaatctcacgagtggaagcgggtgatgaggctgactattactgccaggtttgggatagcagttccgaccatgtgatttttgggggaggcactaagctgaccgtcttgggccagcccaaagccgcaccttctgtgacattattcccacccagctccgaagaactgcaggccaacaaggctaccctagtatgtctcatctcagatttttatcctggggcagttactgtggcctggaaagctgacagtagcccagtcaaggccggagtggaaacaaccacgccgtctaagcaatccaataacaaatacgcggcatcaagctatctgagtcttactcccgagcagtggaagtctcaccgttcctacagctgccaggtgacccatgagggttcgacagtcgagaaaactgttgcccctaccgagtgttct

SEQ ID NO: 27566 - RNA, 687 nt, synthetic construct
  misc_feature 1..687: note = derived and/or modified sequence opt3 from anti-influenza_Apo
  source 1..687: mol_type = other RNA
gaggtgcagctggtccaaagcggcgccgaagttaagaaacccggggcttccgtgaaggtatcttgcaaagcatcaggatacaccttcacagactatcacatcaactgggtgagacaggcccctggtcagggcctcgagtggatggggtggattcatccaaatagtggagatactaactacgcgcagaagtttcaaggctgggtcacgatgaccagggacacagctataagcactgcctatatggaagtgaatggtcttaaatccgatgacaccgcagtttactattgtgcccgcgggggactggagccgcggtctgtggattactattactacggcatggacgtctggggccaggggacaaccgtgactgtatcgtcagctagcacaaagggacccagtgttttccctttggcaccatcctctaagagcacctccggtggcacggccgctttagggtgcctggtgaaagattattttcccgaacctgtcactgtgtcatggaacagtggagccctaaccagcggcgtgcacacattcccagcggtcctccagtcttccggtctgtactcacttagcagtgttgtgactgtaccctcttccagcctggggacccagacatatatctgtaatgtgaaccataagccttcgaataccaaagtcgacaagcgagtggagccaaaatcttgc

SEQ ID NO: 27567 - RNA, 333 nt, synthetic construct
  misc_feature 1..333: note = derived and/or modified sequence opt3 from anti-influenza-A_kappa_LightChain_V-Region
  source 1..333: mol_type = other RNA
gacatcgtgatgacccagagccccgattccctggccgtctctctcggcgctagagcaacaattaactgcaagtcaagtcaaagcgttactttcaattacaaaaactatcttgcctggtaccagcagaagcctgggcagccaccgaaagtgctgatatattgggcgtccgctagggagtctggagtacccgaccggttttcgggttcaggcagcgggacggatttcaccttgacaatcagttccttacaagccgaagacgtggcagtctactattgtcagcagcactaccgcactcctccaacctttggacagggcacaaaggtggagattaaa

SEQ ID NO: 27568 - RNA, 333 nt, synthetic construct
  misc_feature 1..333: note = derived and/or modified sequence opt3 from anti-influenza-A_kappa_LightChain_V-Region
  source 1..333: mol_type = other RNA
gacatcgtgatgacccagagccccgattccctggccgtctctctcggcgagagagctacaattaactgcaagtcaagtcaaagcgtttcctctaataacaaaaattaccttgcatggtatcagcagaagcctgggcagccaccgaaagtgctgatatactgggcctcggcgagggaatcaggagtacccgaccggttcagcggtagtggctccgggactgattttacgttgaccatctctagcttacaagctgaggacgtggccgtctattactgtcagcagcactatcgcacacctccaactttcggacagggcaccaaggtggaaattaaa

SEQ ID NO: 27569 - RNA, 333 nt, synthetic construct
  misc_feature 1..333: note = derived and/or modified sequence opt3 from anti-influenza-A_kappa_LightChain_V-Region
  source 1..333: mol_type = other RNA
gacatcgtgatgacccagagccccgattccctggccgtctctctcggcgagagagctacaattaactgcaggtcaagtcaaagcgtttcctctaataacaagaatttccttgcatggtaccaggaaaaacctgggcagccaccgaaggtgctgatatattgggcctcggcgcgggagtcaggagtacccgaccgctttagcggtagtggctccgggactgatttcacgttgaccatctctggattacaggctgaagacgtggccgtctactattgtcaacagcactaccgaacacctccaacttttggccagggtaccaaagtggagattaag

SEQ ID NO: 27570 - RNA, 333 nt, synthetic construct
  misc_feature 1..333: note = derived and/or modified sequence opt3 from anti-influenza-A_kappa_LightChain_V-Region
  source 1..333: mol_type = other RNA
gacatcgtgatgacccagagccccgattccctggccgtctctctcggcgagagagctacaattaactgcaagtcaagtcaaagcgttactttcaattacaaaaactatcttgcatggtaccagcagaagcctgggcagccaccgaaactgttgatatattgggcctccacgagggaatctggagtgcccgaccggttttcgggttcaggcagcgggaccgatttcacattaactatcagttccctgcaagcggaggacgtagctgtgtactattgtcagcagcactaccgcacccctccaacatttggacagggcaccaaggtcgaaattaaa

SEQ ID NO: 27571 - RNA, 339 nt, synthetic construct
  misc_feature 1..339: note = derived and/or modified sequence opt3 from anti-influenza-A_kappa_LightChain_V-Region
  source 1..339: mol_type = other RNA
gacatcgtgatgacccagagccccgattccctggccgtctctctcggcgagagagctacaattaactgcaagtcaagtcaaagcgttctttactcctctaataacaaaaattatctggcatggtaccagcagaagcctgggcagccaccgaaattgttaatatattgggcctcgactagggaatcaggagtgcccgaccggttcagcggtagtggctccgggacggattttaccctgacaatctctagcctacaagcggaggacgtagctgtgtactattgtcagcagtactattccactcctccaaccttcggacagggcacaaaggtcgaaattaaa

SEQ ID NO: 27572 - RNA, 333 nt, synthetic construct
  misc_feature 1..333: note = derived and/or modified sequence opt3 from anti-influenza-A_kappa_LightChain_V-Region
  source 1..333: mol_type = other RNA
gacatccagatgacccaaagccccgattccctggccgtgtctctcggcgctagagcaacaattaactgcaagtcaagtcagagcgtcactttcaattacaaaaactatcttgcctggtaccagcagaagcctgggcaaccaccgaaagttctgatatattgggcgtccgctagggagtctggagtgcccgaccggttttcgggttcaggcagcgggacggatttcaccttgacaatcagttccttacaggccgaagacgtagcagtgtactattgtcagcagcactaccgcactcctccaacctttggacaaggcacaaaggtcgagattaaa

SEQ ID NO: 27573 - RNA, 387 nt, synthetic construct
  misc_feature 1..387: note = derived and/or modified sequence opt3 from anti-influenza-A_HeavyChain_V-Region
  source 1..387: mol_type = other RNA
caggtgcaactggtcgagagcggcgggggagttgtgcagcccggtagatccctcaggctttcttgcgccgcttcaggcttcacctttagtagctacgggatgcactgggtacggcaggcacctggaaagggcctggaatgggtggccgtcatctcctatgacggttctaacaaatactatgcggattcggtgaaggggcgcttcacaatttcacgagacaatagcaaaaacactttgtacttacagatgaatagtctgcgtgctgaggatacggccgtttattactgtgcaaaggactcccaactaagatctctcctgtattttgattggcttagccagggatacttcgactactggggccagggcaccctggtgacagtctcctca

SEQ ID NO: 27574 - RNA, 387 nt, synthetic construct
  misc_feature 1..387: note = derived and/or modified sequence opt3 from anti-influenza-A_HeavyChain_V-Region
  source 1..387: mol_type = other RNA
caggtgcaactggtccagagcggcgggggagttgtgcagcccggtagatccctcaggctttcttgcgtagcctcaggcttcacctttagtacatacgctatgcactgggtgcggcaggcacctgggcgcggactggagtgggtcgccgtgatcagctatgacggcaactacaagtattacgcggattccgttaaaggtcgattctctatttcgcgtgacaattcaaacaatactttgcatttagaaatgaacacgctgagaaccgaggatacagctctatattactgtgccaaggacagccaactcaggagtctgctttattttgaatggctgtcccaggggtacttcgatccatggggacagggcactttggtgaccgtctctagc

SEQ ID NO: 27575 - RNA, 387 nt, synthetic construct
  misc_feature 1..387: note = derived and/or modified sequence opt3 from anti-influenza-A_HeavyChain_V-Region
  source 1..387: mol_type = other RNA
caggtgcaactggtccagagcggcgggggagttgtgcagcccggtagatccctcaggctttcttgcgccgcttcaggcttcacctttagtacatacgggatgcactgggtacggcaggcacctggaaagggcctggagtgggtggccgtcatcagctatgacggtaattacaaatattacgcggattccgtgaaggggcgcttcactatttctcgagacaattcgaaaaacacgttgtatttagaaatgaactcactgcgtaccgaggatacagctctatactattgtgccaaggacagccaactcagaagtctgctttactttgattggctgtcccagggatacttcgaccattggggccagggcactttggttaccgtgtctagc

SEQ ID NO: 27576 - RNA, 387 nt, synthetic construct
  misc_feature 1..387: note = derived and/or modified sequence opt3 from anti-influenza-A_HeavyChain_V-Region
  source 1..387: mol_type = other RNA
caggtgcaactggtccagagcggcgggggagttgtgccccctggtagatccctcaggctttcttgcgccgcttcaggcttcacctttagtacatacgggatgcactgggtacggcaggcaccaggaaagggcctggagtgggtggccgtcatcagctatgacggtaactacaaatattacgcggattccgtgcgcgggcgattcactatttctcgtgacaattcgaagaacacgttgaatttagatatgaactcactgagaaccgaagacacagctctatattactgtgccaaagatagccagctcaggagtctgctttattttgactggctgtcccaaggatacttcgatcattggggccagggcactttggttaccgtgtctagc

SEQ ID NO: 27577 - RNA, 387 nt, synthetic construct
  misc_feature 1..387: note = derived and/or modified sequence opt3 from anti-influenza-A_HeavyChain_V-Region
  source 1..387: mol_type = other RNA
caggtgcaactggtcgagagcggcgggggagttgtgcagcccggtagatccctcaggctttcttgcgccgcttcaggcttcacctttagtacatacgcaatgcactgggtacggcaggcccctgggaagggactggaatgggtggcggtcatcagctatgacgctaattacaaatattacgccgattccgtgaagggccgcttcactatttctcgagacaattcgaaaaacacgttgtatttacagatgaactcactgcgtgcagaggataccgccgtttactattgtgctaaggacagccaactaagaagtctcctgtactttgaatggctttcccagggttacttcgattattgggggcagggaacactggtgactgtctctagc

SEQ ID NO: 27578 - RNA, 387 nt, synthetic construct
  misc_feature 1..387: note = derived and/or modified sequence opt3 from anti-influenza-A_HeavyChain_V-Region
  source 1..387: mol_type = other RNA
caggtgcaactggtcgagagcggcgggggagttgtgcagcccggtagatccctcaggctttcttgcgccgcttcaggcttcacctttagtacatacgcaatgcactgggtacggcaggcccctgggaagggactggaatgggtggcggtcatcagctatgacggcaattacaaatattacgctgattccgtgaagggtcgcttcactatttctcgagacaattcgaaaaacacgttgtatttacagatgaactcactgcgtgccgaggataccgcagtttactattgtgccaaggacagccaactaagaagtctcctgtactttgaatggctttcccaggggtacttcgatccatggggacagggcacactggtgactgtctctagc

SEQ ID NO: 27579 - RNA, 387 nt, synthetic construct
  misc_feature 1..387: note = derived and/or modified sequence opt3 from anti-influenza-A_HeavyChain_V-Region
  source 1..387: mol_type = other RNA
caggtgcaactggtccagagcggcgggggagttgtgcagcccggtagatccctcaggctttcttgcgtagcctcaggcttcacctttagtacatacgctatgcactgggtgcggcaggcacctgggcgcggactggagtgggtcgccgtgatcagctatgacggcaactacaagtattacgcggattccgttaaaggtcgattctctatttcgcgtgacaattcaaacaatactttgcatttagaaatgaacacgctgagaaccgaggatacagctctatattactgtgccaaggacagccaactcaggagtctgctttattttgaatggctgtcccaggggtacttcgatccatggggacagggcactttggtgaccgtcacatct

SEQ ID NO: 27580 - RNA, 330 nt, synthetic construct
  misc_feature 1..330: note = derived and/or modified sequence opt3 from anti-influenza-A_LightChain_V-Region
  source 1..330: mol_type = other RNA
aacttcatgctgacccagccccctagcgcctccggcacaccagggcaaagagtgactatctcttgctcaggaagtagctccaatattggtggcaacacggtccactggtttcagcagctcccggggaccgctcccaaacttctgatatacacaaattctttgaggccttcgggagttccagaccggttctcaggcagcaagagtggtacttccgcatctttagccatcagcgggctgcagtccgaggatgaagcggactattactgtgctgcctgggatgactcactaaacggacaagtgtttggcggcgggaccaagctcacagtactg

SEQ ID NO: 27581 - RNA, 390 nt, synthetic construct
  misc_feature 1..390: note = derived and/or modified sequence opt3 from anti-influenza-A_HeavyChain_V-Region
  source 1..390: mol_type = other RNA
caggtgcaactgctcgagagcggcgggggagtcgttcagcccggtagatcccttaggctgtcttgcgccgcttcaggcttcacctttagtaactacgggatgcactgggtgcggcaggcacctggaaagggcttggaatgggtagccatcattagcttcgacggttccaaaaagtattacgctaattctgtgaaagggcgctcgacaatatcacgagataacagcaagaatactttaagtctgcagatgaactccctaggaccagaggacacggcgctctattactgtgccaaactgccgtctccctattactttgatagccgtttcgtctgggtggcagcctccgcttttcatttctggggccaaggcatccttgttaccgtgtcaagt

SEQ ID NO: 27582 - RNA, 132 nt, synthetic construct
  misc_feature 1..132: note = derived and/or modified sequence opt3 from anti-influenza_Chain
  source 1..132: mol_type = other RNA
aacgtgcccgagtggagctacatcgtcgaaaaggccaatcctgctaacgacctgtgctatccaggcaatttcaacgattacgaggaactcaaacaccttctgtccagaattaatcattttgagaagatacag

SEQ ID NO: 27583 - RNA, 162 nt, synthetic construct
  misc_feature 1..162: note = derived and/or modified sequence opt3 from anti-influenza_Chain
  source 1..162: mol_type = other RNA
agcggcagactggtgcccagggggtcccctggatctggttacatcccagaggccccgcgggacggccaggcttatgtccgcaaggatggggaatgggttctcctttcaaccttcctgggaaaacccattcctaacccattgttaggcctggacagtacaggt

SEQ ID NO: 27584 - RNA, 291 nt, synthetic construct
  misc_feature 1..291: note = derived and/or modified sequence opt3 from anti-influenza_Chain
  source 1..291: mol_type = other RNA
atgagcctgctcaccgaggtggaaacacccatcagaaacgagtggggctgtaggtgcaatgggtcctctgaccctcttgccattgctgcaaacataatcggtattctgcacttgatcttatggattctggatcggctattctttaagtgcatctaccgccgattcaaatatggactcaagggcgggccatcaactgaaggagtcccgaaaagtatgcgtgaggaatacagaaaggagcagcaaagcgccgttgacgcggatgacggccattttgtgtccatagagctggaa

SEQ ID NO: 27585 - RNA, 300 nt, synthetic construct
  misc_feature 1..300: note = derived and/or modified sequence opt3 from anti-influenza_Chain
  source 1..300: mol_type = other RNA
atgaacaatgccaccttcaactgcacaaatatcaaccccattactcacataagaggcagcatcattatcacgatttgtgtgtccctgatcgtcatactcatcgtttttgggtgcattgctaagatcttcattaataaaaacaattgtaccaacaatgtgatcagggtacataagcggataaaatgccctgactgtgagccattttgcaacaagcgcgatgacatttctacaccgcgagcaggagtggatatcccctcattcattcttcctggtctgaatttgagtgaaggcactccaaac

SEQ ID NO: 27586 - RNA, 300 nt, synthetic construct
  misc_feature 1..300: note = derived and/or modified sequence opt3 from anti-influenza_Chain
  source 1..300: mol_type = other RNA
gagctgacccagagcccctcctctctctcagccagtgtgggcgacagcgtcacaatcacttgcagaacgtccgaaaggatttctacctaccttaactggtatcaacagaagcctgggaaagctccacggctgttggtttcgggagcatcaacattacagggtggcgtgccgagccgcttcagtgggtccggatctggcactgcctttaccctgacaataaatagcctacagcccgaggatttcgcgacctactattgtcaacagtcctactcaactcctctcacatttggtgggggaacc

SEQ ID NO: 27587 - RNA, 300 nt, synthetic construct
  misc_feature 1..300: note = derived and/or modified sequence opt3 from anti-influenza_Chain
  source 1..300: mol_type = other RNA
atgacccagagcccctcctctatgtcagtgagtctgggcgacacagtcagcatcacttgccacgcctcccaagatatttctgggcatataggatggctccagcagaagcctggtaaatcgttcaagggccttatctaccacgggacgaacctggaggacggagttccatcaagatttagcggcagtggttccggggctgatttctctttgaccattagctccttagaatcagaggactttgcagattattactgtgtgcagtatgtacaattcccgtggacatttggaggcggcactaaa

SEQ ID NO: 27588 - RNA, 306 nt, synthetic construct
  misc_feature 1..306: note = derived and/or modified sequence opt3 from anti-influenza_Chain
  source 1..306: mol_type = other RNA
gacatccaggtgacccaaagcccctcctctctgtcagccagtgtcggcgatagagttacaattagctgcagggctcagtccctctcttcgtaccttcactggtatcagcagaagcctgggcaaccaccgaaactgttgatatacgcagccactacgttacagtcaggagtgcccagccggttcagtggttccggctctgggaccgactttacactgactatcagcaccttccaggcggaggatgtagctacatattactgtcagcaatcccgcacctttggacagggcactaaggtggaaattaaa

SEQ ID NO: 27589 - RNA, 306 nt, synthetic construct
  misc_feature 1..306: note = derived and/or modified sequence opt3 from anti-influenza_Chain
  source 1..306: mol_type = other RNA
gacatccagatgacccaaagcccctcctctctgtcagccagtgtgggcgatagagtcacaattagctgcagggctcagtccctctcttcgtaccttcactggtatcagcagaagcctgggcaaccaccgaaactgttgatatacgcagccactacgttacagtcaggagttcccagccggttcagtggttccggctctgggaccgactttacactgactatcagcaccttccaggcggaggatgtggctacatattactgtcagcaatcccgcacctttggacagggcactaaggtagaaattaaa

SEQ ID NO: 27590 - RNA, 309 nt, synthetic construct
  misc_feature 1..309: note = derived and/or modified sequence opt3 from anti-influenza_Chain
  source 1..309: mol_type = other RNA
gacatccagattacccaaagcccctcctctctgtcagccagtgtgggcgatagagtcacaataacttgcaggacgagccagtccctctcttcgtaccttcactggtatcagcagaagcctgggaaagctccaaagctgttgatctacgcagccagctcattacaaagtggagttccgtcccggttctctggtagcggctccgggaccgactttacactgactatttcaagtctacagcccgaggatttcgcgacctattactgtcagcagagccgcacatttggacaaggcaccaaagtggaaatcaag

SEQ ID NO: 27591 - RNA, 309 nt, synthetic construct
  misc_feature 1..309: note = derived and/or modified sequence opt3 from anti-influenza_Chain
  source 1..309: mol_type = other RNA
gacatccagatgacccaaagcccctcctctctgtcagccagtgtgggcgatagagtcacaattacttgcaggacgagccagtccctctcttcgtaccttcactggtatcagcagaagcctgggaaagctccaaagctgttgatatacgcagccagctcattacaaagtggagttccgtcccggttctctggtagcggctccgggaccgactttacactgactatctcaagtctacagcccgaggatttcgcgacctattactgtcagcagagccgcacatttggacaaggcaccaaagtggaaattaag

SEQ ID NO: 27592 - RNA, 309 nt, synthetic construct
  misc_feature 1..309: note = derived and/or modified sequence opt3 from anti-influenza_Chain
  source 1..309: mol_type = other RNA
gacatccaggtgacccaaagcccctcctctctgtcagccagtgtcggcgatagagttacaattagctgcagggcttcccagcggctcaactcttaccttcactggtatcagcagactcctgggcaagcaccaaagctgttgatatacgccacgtcgaccttacagtcaggagtgagcccgcgcttcagtggttccggctctgggacagactttactctgaccatcagctccctacagcccgaggatgtagcgacatattactgtcagctctcacgaaccttcggacatggcactaaagtggaaattaag

SEQ ID NO: 27593 - RNA, 309 nt, synthetic construct
  misc_feature 1..309: note = derived and/or modified sequence opt3 from anti-influenza_Chain
  source 1..309: mol_type = other RNA
gacatccagatgacccaaagcccctcctctctgtcagccagtgtgggcgatagagtcacaattagctgcagggcttcccagcggctcaactcttaccttcactggtatcagcagactcctgggcaagcaccaaagctgttgatatacgccacgtcgaccttacagtcaggagttagcccgcgcttcagtggttccggctctgggacagactttactctgaccatcagctccctacagcccgaggatgtggcgacatattactgtcagctctcacgaaccttcggacatggcactaaagtagaaattaag

SEQ ID NO: 27594 - RNA, 309 nt, synthetic construct
  misc_feature 1..309: note = derived and/or modified sequence opt3 from anti-influenza_Chain
  source 1..309: mol_type = other RNA
gacatccaggtgacccaaagcccctcctctctgtcagccagtgtcggcgatagaattacaataagctgcaggacttcccagtctctccggtcgtaccttcactggtatcagcagaagcctgggaaagctccaaagctgttgatctacgcatcaagcacgttacaaagtggagttccgtcccgcttctctggtagcggctccgggaccgactttacactgactatttcaaacctacagcccgaggatttcgccacctattactgtcagctcagtcgaacatttggacagggcaccaaagtggaaatcaag

SEQ ID NO: 27595 - RNA, 309 nt, synthetic construct
  misc_feature 1..309: note = derived and/or modified sequence opt3 from anti-influenza_Chain
  source 1..309: mol_type = other RNA
gacatccagatgacccaaagcccctcctctctgtcagccagtgtgggcgatagaattacaataagctgcaggacttcccagtctctccggtcgtaccttcactggtatcagcagaagcctgggaaagctccaaagctgttgatctacgcatcaagcacgttacaaagtggagtcccgtcccgcttctctggtagcggctccgggaccgactttacactgactatttcaaacctacagcccgaggatttcgccacctattactgtcagctcagtcgaacatttggacagggcaccaaagttgaaatcaag

SEQ ID NO: 27596 - RNA, 309 nt, synthetic construct
  misc_feature 1..309: note = derived and/or modified sequence opt3 from anti-influenza_Chain
  source 1..309: mol_type = other RNA
gacatccagatgacccaaagcccctcctctctgtcagccagtgtgggcgatagagtcacaattacttgcaggacgagccagtccctctcttcgtacacccactggtatcagcagaagcctgggaaagctccaaaacttctgatatacgcagcctcaagccggttgagtggagttccgtcccgcttctctggtagcggctccgggacagactttactttaaccatctcaagtctgcaacccgaggatttcgcgacatattactgtcagcagagccgaacctttggacagggcactaaggtggaaattaag

SEQ ID NO: 27597 - RNA, 309 nt, synthetic construct
  misc_feature 1..309: note = derived and/or modified sequence opt3 from anti-influenza_Chain
  source 1..309: mol_type = other RNA
gacatccagatgacccaaagcccctcctctctgtcagccagtgtgggcgatagagtcacaattacttgcaggacgagccagtccctctcttcgtacacccactggtatcagcagaagcctgggaaagctccaaaacttctgatatacgcagcctcaagccggggaagtggtgttccgtcccgcttctctggcagcgggtccggaacagactttactttgaccatctcaagtttacaacccgaggatttcgcgacatattactgtcagcagagccgaacctttggccagggtactaaggtggaaattaag

SEQ ID NO: 27598 - RNA, 309 nt, synthetic construct
  misc_feature 1..309: note = derived and/or modified sequence opt3 from anti-influenza_Chain
  source 1..309: mol_type = other RNA
gacatccagatgacccaaagcccctcctctctgtcagccagtgtgggcgatagagtcacaattacttgcaggacgagccagtccctctcttcgtacgaccactggtatcagcagaagcctgggaaagctccaaaacttctgatatacgcagcctcaagccggttgagtggagttccgtcccgcttctctggtagcggctccgggaccgattttacattaactatctcaagtctgcaacccgaggacttcgcgacctattactgtcagcagagccgaacatttggacagggcaccaaggtggaaattaag

SEQ ID NO: 27599 - RNA, 318 nt, synthetic construct
  misc_feature 1..318: note = derived and/or modified sequence opt3 from anti-influenza_Chain
  source 1..318: mol_type = other RNA
gagatcgtgatgacccagagccccgacacactgtccgtctctcctggcgaaagagccactctctcatgcagggctagtcaaagcgttaaccggcgccttgcatggtaccagcagaagccagggcaggccccgcgactgttgattcacgatgcgtccacgcgtgctaccggaatacccgccagattctctggttcgggctcagggacagagtttactttaaccatcagcagtctgcaatccgaagacttcgcagtgtattactgtcagcagtatgataattggctatcttttggacagggcacaaggctcgagattaaa

SEQ ID NO: 27600 - RNA, 318 nt, synthetic construct
  misc_feature 1..318: note = derived and/or modified sequence opt3 from anti-influenza_Chain
  source 1..318: mol_type = other RNA
gacatccagctgacccaaagcccctcctctctctcagccagtgtgggcgatagagtcacaattacttgcagggctagccaggggatacttaactgtctggcatggtaccagcagaagcctggaaaagttccaaatttgttaatgtatgccgcgtccacgctgcaatctggtgtgccgtcgcggttctcaggcagcgggtttggaaccgacttcacactaactatcagttccctccagcccgaggatgtagctacctactattgccagacatacggcggtgtgtctacctttgggggaggcactaaggtcgaaattcgc

SEQ ID NO: 27601 - RNA, 318 nt, synthetic construct
  misc_feature 1..318: note = derived and/or modified sequence opt3 from anti-influenza_Chain
  source 1..318: mol_type = other RNA
agctacgtgctgacccagcccccttccgtctctgttgccccaggccaaacagctagaatctcatgcgggggaagtaacattggtggcaagagcgtgcactggtatcagcagaaaccggggcaggcacccgtactcgtggtctacgacgattccggaaggccttctggcataccagagcggttctcgggttcaaatagcggggacactgccacgcttaccatcagtcgcgtggaagcgggagatgaggctgactatttttgtcaagtttgggataacttcggcggcgtgtttgggacaggaactaaggtcaccgtgctg

SEQ ID NO: 27602 - RNA, 318 nt, synthetic construct
  misc_feature 1..318: note = derived and/or modified sequence opt3 from anti-influenza_Chain
  source 1..318: mol_type = other RNA
gacatccagatgacccaaagcccctcctctctgtcagccagtgtgggcgatagagtcacaattacttgcaggacgagccagtccatatcttcgtacctcaactggtatcagcagaagcctgggaaagctccaaagttgctgatctacgcagcctcaagccttcaaagtggagttccgtcccggttctctggtagcggctccgggaccgactttacattaactatttcaggactgcagcccgaggatttcgcgacctattactgtcagcagagttatagcatgcctgcttttggccaaggtacaaaactagaaatcaag

SEQ ID NO: 27603 - RNA, 318 nt, synthetic construct
  misc_feature 1..318: note = derived and/or modified sequence opt3 from anti-influenza_Chain
  source 1..318: mol_type = other RNA
gacatccagatgacccaaagccccctgtccgtgtctgtctcagttggcgatagagtgacaattgcctgcagggctagtcagagcatagacaagttcctcaactggtaccagcagaaacctgggaaggcaccaaaacttctgatctatggagcctccaatttgcactctggtgcgccgtcgcggttttcagctagcggcagtgggactgatttcacgttaaccattacaaacatccaaactgaggactttgccacctacctgtgtcagcagtccttctctgtacccgcatttggaggcggtacaaaggtggaaattaaa

SEQ ID NO: 27604 - RNA, 318 nt, synthetic construct
  misc_feature 1..318: note = derived and/or modified sequence opt3 from anti-influenza_Chain
  source 1..318: mol_type = other RNA
gacatccagatgacccaaagcccctcctctctgtcagccagtgtgggcgatagagtcacaattacttgcagggctagccagtccatatctacgtacctcaactggtatcagaagcggcctgggaaagcaccaaaacttctggtttacggagcctcgaccttgcagtcaggtgtgccgagccgcttcagtggctccgggtctggaacagactttactttaaccatcgcgagcctgcaacccgaggattccgctacatattactgtcagcagacctattcaattcctctattcggccagggtactcgactcgaaatcaag

SEQ ID NO: 27605 - RNA, 318 nt, synthetic construct
  misc_feature 1..318: note = derived and/or modified sequence opt3 from anti-influenza_Chain
  source 1..318: mol_type = other RNA
gacatccagatgacccaaagcccctcctctctgtcagccagtgtgggcgatagagtcacaattacttgcagggctagccagtccatatctacgtacctcaactggtatcagaagcggcctgggaaagcaccaaaacttctggtttacggagcctcgtcattgcagagcggtgtgccgagtcgcttctccggctctgggagcggaaccgactttacattaactatcgcgtccctgcaacccgaggattcagctgtatattactgtcagcagacctatagtattcctctattcggccagggtacacgactcgaaatcaag

SEQ ID NO: 27606 - RNA, 318 nt, synthetic construct
  misc_feature 1..318: note = derived and/or modified sequence opt3 from anti-influenza_Chain
  source 1..318: mol_type = other RNA
gacatccagatgacccaaagcccctcctctctgtcagccagtgtgggcgatagagtcacaattacttgcagggctagccagtccatatctcggtacctcaactggtatcagcagaagcctgggaaagcaccaaaacttctgatctacggagcctcgacgttgcaaaatggtgcgccgtcacgcttcagcggcagtgggtccggaaccgactttacattaactatttctagcctgcagcccgaggattccgctacctatctatgtcagcagtcatacagtgttcctgccttcggcggtgggacaaaggtggaagtaaag

SEQ ID NO: 27607 - RNA, 318 nt, synthetic construct
  misc_feature 1..318: note = derived and/or modified sequence opt3 from anti-influenza_Chain
  source 1..318: mol_type = other RNA
ggcatccagatgacccaaagcccctcctctctgtcagccagtgtgggggacagagtcacaattacttgcagggctagccagtccatatctcggtacctcaactggtatcttcagaagcctggaaaagcaccaaagctgttgatctcgggtgccagctcattacagagtggcgttccgtcccgcttctctgggacgggaagcggcaccgagtttacactgactatttcctcactacaacccgaagatttcgcgacctactattgtcagcagacatttagtatccctctcttcggtcaggggaccaaagtggagattaag

SEQ ID NO: 27608 - RNA, 321 nt, synthetic construct
  misc_feature 1..321: note = derived and/or modified sequence opt3 from anti-influenza_Chain
  source 1..321: mol_type = other RNA
gacatccagatgacccaaagcccctcctctctgtcagccagtgtgggcgatagagtcagcattacatgccaggcttcccaggacatatctaggtacctcaactggtatcagcaaaagcctggggaggcaccaaaacttctgatctacgatgcctcgaatttggaaactggagttccgtcacggttcagcggtagtggctccgggacggactttaccttcacaatttctagcttacagcccgaggatatcgcgacttatttttgtcagcagtacggatatctgcctctaaccttcggcccaggtacaaaggtggactccaaa

SEQ ID NO: 27609 - RNA, 321 nt, synthetic construct
  misc_feature 1..321: note = derived and/or modified sequence opt3 from anti-influenza_Chain
  source 1..321: mol_type = other RNA
gacatccagatgacccaaagcccctcctctttctcagtgagtctgggcgatagagtcacaattacttgcaaggccagcgaggacatatacaacaggctcgcttggtatcagcagaaacctgggaatgcaccacggcttctgatctccgatacgaccaacttgtggattggagttccgtctcgcttttcgggttcaggcagcgggaaggactacacattaagtatcacttccctgcagtctgaagatgtggccacctattactgtcaacagtattggagctcccgaacattcggaggcggtaccaaactagagattaagcgt

SEQ ID NO: 27610 - RNA, 321 nt, synthetic construct
  misc_feature 1..321: note = derived and/or modified sequence opt3 from anti-influenza_Chain
  source 1..321: mol_type = other RNA
gacatccagatgacccaaagcccctcctctttctcagtgagtctgggcgatagagtcacaattacttgcaaggccagcgaggacatatacaacagggttgcttggtatcagcagaaacctgggaatgcaccacggctccttatgtccgatgccacgtctctgggagcgggtgtgccgtcgcgcttttcaggcagcgggagtggaaaggaccacaccttgtccatcacatctttacagactgaagatgtagctacctactattgtcaacagtactggaacacacgaaccttcggcggtgggactaaactggagattaagcgt

SEQ ID NO: 27611 - RNA, 321 nt, synthetic construct
  misc_feature 1..321: note = derived and/or modified sequence opt3 from anti-influenza_Chain
  source 1..321: mol_type = other RNA
gacatccagatgacccaaagcccctcctctctgtcagccagtgtgggcgatagagtcacaattacttgcagggctagccagtccatatctacgtacctcaactggtatcagcagaagcctgggatcccaccgaaacttctgattaatgttgcatcgtcattgcaaagcggagtgcccagtcggttctccggttctggcagcgggaccgactttacattaactatctcctcactgcagcctgaggatttcgccagttactattgtcagcagacctacagctctccacccacatttggacaaggcaccaaggtagaaattaaa

SEQ ID NO: 27612 - RNA, 321 nt, synthetic construct
  misc_feature 1..321: note = derived and/or modified sequence opt3 from anti-influenza_Chain
  source 1..321: mol_type = other RNA
gacatccagatgacccaaagcccctccacactgtctggctcagtgggggatagagtcactattacgtgcagggccagtcagaacataggaccttggctcgcttggtaccagcaggagagcggtaaggcaccaaaacttctgatctcccgggcctctattttggaatcgggcgttccgtcacgcttcagcgggaccggaacaggcactgagtttaccttaacaatcagttccctgcaacccgacgatttcgcgacctattactgtcagcactataatgcttactggggtacttttgggcagggaacaaaggtggaaattaac

SEQ ID NO: 27613 - RNA, 321 nt, synthetic construct
  misc_feature 1..321: note = derived and/or modified sequence opt3 from anti-influenza_Chain
  source 1..321: mol_type = other RNA
gtgatctggatgacccagagcccctccctgctctctgcctcaacaggcgacagagtcactattagttgcaggatgagccaagggatatcctcttaccttgcttggtatcagcagaagcctggaaaagcaccagagctgttgatccacacggcctacaccttaaagtcgggtgttccgtcacggttcagcggcagtgggtccggaaaagattttacactgactatttctggcctacagagcgaagacttcgcgacctattactgtcaacagtattactcctttccctatacattcggtcaggggaccaaggtggagatcaaa

SEQ ID NO: 27614 - RNA, 321 nt, synthetic construct
  misc_feature 1..321: note = derived and/or modified sequence opt3 from anti-influenza_Chain
  source 1..321: mol_type = other RNA
gacatccagatgacccaaagcccctcctctgtgtcagccagtgtcggcgatagagttacaattacttgcagggctagccaggacgtgtccacgtggctggcatggtaccagctcaagcctgggaaagccccaaaacttctgatatatgcggcttcttcgttgcagtcaggagtaccgagccggttcagtggttccggctctgggaccgattttacattaactgtgagctccctgcaacccgaggacttcgccacctactattgtcagcaggcaaactcatttcctttcacatttggaccaggcaccaaggtcgatatcaag

SEQ ID NO: 27615 - RNA, 321 nt, synthetic construct
  misc_feature 1..321: note = derived and/or modified sequence opt3 from anti-influenza_Chain
  source 1..321: mol_type = other RNA
gacatccagctgacccaaagcccctccttcctctctgcctcagtgggcgatggggtcacaattacttgcagagctagtcaggacatatacatctatcttgcatggtaccagcagaagcctggaaaagccccaaagctgttgatttatgcggctagcacgttacaaggtggcgttccgtccaggttttctgggtcgggatcaggcaccgagttcacactgactatcaacaatctacagcccgaagattttgccacctacttctgtcagcagctcaacggttatcctctgacatttgggggaggcaccaaagtggagattaag

SEQ ID NO: 27616 - RNA, 321 nt, synthetic construct
  misc_feature 1..321: note = derived and/or modified sequence opt3 from anti-influenza_Chain
  source 1..321: mol_type = other RNA
gacatccagctgacccaaagcccctcctctctctcagccagtgtgggcgatagagtcacacttacttgccaggctagccaggacattaggaagttcctgaactggtaccagcaaaaacctgggaagggaccaaaattgttaatatatgatgcatccaatctgcagcggggtgttccgtctcgcttttcgggcgggggatcaggcacggacttcaccctaatcattagcagtctccagcccgaggatgtgggtacatactattgtcagcaatacgacgggctgccttttactttcggaggcggcaccaaacttgaaatcaag

SEQ ID NO: 27617 - RNA, 321 nt, synthetic construct
  misc_feature 1..321: note = derived and/or modified sequence opt3 from anti-influenza_Chain
  source 1..321: mol_type = other RNA
gacatccagctgacccaaagcccctcctctctctcagccagtattggcgatagagtgacaataacttgccaggctagccaggacatcaggaactcccttaattggtacgagcacaagcctgggaaagcaccaaagctgttgattcatgatgcctctaacttagaaacgggagtcccgtcgcggttctcaggtggcgggagcggaaccgactttacactgactatcagttccctacagcccgaggatttcgcgacctattactgtcaacaggctaattcttttcctctcacattcggcggtgggaccaaagttgaaattaag

SEQ ID NO: 27618 - RNA, 321 nt, synthetic construct
  misc_feature 1..321: note = derived and/or modified sequence opt3 from anti-influenza_Chain
  source 1..321: mol_type = other RNA
gacatccagctgacccaaagcccctcctctctctcagccagtgtgggcgatagagtcacaattacttgcagggctagccaggggatacggaacgaccttggatggtaccagcagaagcctggtaatgcaccaaaacgcctgatcttcggcgcctcctctttgcaatcgggggttccgtcacgatttagcggaagtggctccggtacggagttcaccttaacaatttctagcctgcagcccgaagattttgcgacttattactgtctacagcacaactcctatccttacaccttcgggcagggaacaaagctcgagatcaaa

SEQ ID NO: 27619 - RNA, 321 nt, synthetic construct
  misc_feature 1..321: note = derived and/or modified sequence opt3 from anti-influenza_Chain
  source 1..321: mol_type = other RNA
gacatccagctgacccaaagcccctcctctctctcagccagtgtgggcgatagagtcacaattacttgcagggctagccagtccatatctcggtaccttaactggtatcagcagaagcctgggaaagcaccaaagctgttgttattcgccgcgtcgacgctgctagacggagttccgtcacgctttagcggtagtggctccgggaccgatttcacactcactatctctagcctgcaacccgaggactttgctacctactattgtcagcgaaatcactccccttcatggacattcggacagggcacccgtgtggaaattaaa

SEQ ID NO: 27620 - RNA, 321 nt, synthetic construct
  misc_feature 1..321: note = derived and/or modified sequence opt3 from anti-influenza_Chain
  source 1..321: mol_type = other RNA
gacatccagatgacccaaagcccctcctctctgtcagccagtgtgggcgatagagtcacaatgacttgcagggctagccagaacattcggtcctacctcaattggtatcagcagcgccctgggacggcaccaaaacttctgatatacgccgcgtctaccttgcactcgggagttccgtcacgattcagcggtggcgggagtggaacagactttactttaaccatcaacaatctgcaacccgaggatttcgcttcctattactgtcagcagtcttatgacaaccctcagacatttggccaaggtaccaaggtggaaattaag

SEQ ID NO: 27621 - RNA, 321 nt, synthetic construct
  misc_feature 1..321: note = derived and/or modified sequence opt3 from anti-influenza_Chain
  source 1..321: mol_type = other RNA
gacatccagatgacccaaagcccctcctctctgtcagccagtgtgggcgatagagtcacaattacttgcagggctaaccaggacatagggatctacctcaattggtatcagcagaaccctggaaaggttccaaaacttctgttgcacggtgcaagctccttacaaggcggggtgccgtctcggttctcggcctcaggaagcggcacggattttaccctgacaattcatagtctacagcccgaggacctcgcgacttactattgtcagcagtcccgccgactgccttacaccttcggtcaagggacacgtgtagaacttaag

SEQ ID NO: 27622 - RNA, 321 nt, synthetic construct
  misc_feature 1..321: note = derived and/or modified sequence opt3 from anti-influenza_Chain
  source 1..321: mol_type = other RNA
gacatccagatgacccaaagcccctccacactgtctgcctcaattggcgatagagtgactataacgtgcagggctagtcagagcatcgcatcctggctcgcctggtaccagcagaagcctgggaaagcgccaaaacttctgatttatgaggctgtcaacttggaatctggagttccgtcgcggttctcaggtagcggcagtgggaccgactttacattaactatctcctctctgcaacccgatgacttcgccacctacttttgtcagcactatggaacaattagccagaccttcggcggtgggactaaggtggagatcaag

SEQ ID NO: 27623 - RNA, 321 nt, synthetic construct
  misc_feature 1..321: note = derived and/or modified sequence opt3 from anti-influenza_Chain
  source 1..321: mol_type = other RNA
gacatccagatgacccaaagcccctcctctctgtcagccagtgtgggcgatagagtcacaattacttgcagggctagccagtccatatcttcgtacctcaactggtatcagcacaagcctgggaaagcaccaaaggttcttatgtacgccgtgtcaatcctgcagagcggagtaccgagtcggttctccggttctggcagcggggcggactttacgttgaccatttcctcattacaacccgaggatttcgctacatattactgtcagcagagttatagctctcctctgacttttggaggcggtaccaaagtggaaatcaag

SEQ ID NO: 27624 - RNA, 321 nt, synthetic construct
  misc_feature 1..321: note = derived and/or modified sequence opt3 from anti-influenza_Chain
  source 1..321: mol_type = other RNA
gacatccagatgacccaaagcccctcctctctgtcagccagtgtgggcgatagagtcacaattacttgcagggctagccagaacataaagcggtacttcaattggtatcagcagaaacctgggaaggcaccaaaactccttatctacgccgcgtccaacctggagaatggagttccgtctcgcttttcgggttcaggcagcgggacggacttcaccttgacaattagttccttacaacccgaagattttgctacttattactgtcagcagtctttcagcaagtcctggacctttggacagggcacaaacgtggacatcaaa

SEQ ID NO: 27625 - RNA, 321 nt, synthetic construct
  misc_feature 1..321: note = derived and/or modified sequence opt3 from anti-influenza_Chain
  source 1..321: mol_type = other RNA
gacatccagatgacccaaagcccctcctctctgtcagccagtgtgggcgatagagtcacaattacttgcagggctagccagaacatatacaagtatctcaattggtaccagcagcggcctgggaaagcaccaaagggacttatctccgccgcgtctggtctgcaatcgggcgttccgtcacgcttcagcgggagtggatccggcacggactttaccttgacaattacttctttacagcccgaggatttcgctacctattactgtcagcagagctattcccctccactgacatttggtgggggaacccgagtggaaatcaaa

SEQ ID NO: 27626 - RNA, 321 nt, synthetic construct
  misc_feature 1..321: note = derived and/or modified sequence opt3 from anti-influenza_Chain
  source 1..321: mol_type = other RNA
gacatccagatgacccaaagcccctcctctctgtcaagtagcgtgggcgatagagtcacaattacttgcagggcctcccagtctataggggcttacgttaactggtatcagcagaaggcaggaaaagcccctcaagtgctcatcttcggtgcgtcgaatcttcagtcaggcgtaccaagccggtttagtgggtccggatctggcacggacttcaccctgacaattagctccttgcagccggaggattttgctacttacttctgtcagcaaacctattcaacacccatcacctttggtcaggggactcgcttagaaattaag

SEQ ID NO: 27627 - RNA, 321 nt, synthetic construct
  misc_feature 1..321: note = derived and/or modified sequence opt3 from anti-influenza_Chain
  source 1..321: mol_type = other RNA
gacatccagatgacccaaagcccctcctctctgtcagccagtgtgggcgatagagtcacaattagctgcagggcttcccagtctatatcgacttacctcaactggtatcagcagcaacctgggaaggcaccaaaagttcttatcttcggagccacgaatctgcagtcaggtgtgccgagccggtttagtggctccgggtctggaaccgacttcacattgactattagctccttacagcccgaggattttgcgacctactattgtcagcaatcatacaacacacctctgatcttcggccagggtaccaagctagaaattaaa

SEQ ID NO: 27628 - RNA, 321 nt, synthetic construct
  misc_feature 1..321: note = derived and/or modified sequence opt3 from anti-influenza_Chain
  source 1..321: mol_type = other RNA
gacatccagatgacccaaagcccctcctctctgtcagccagtgtgggcgatagagtcacaattagctgcagggcttcccagtctatatcgacttacctcaactggtatcagcagcaacctgggaaggcaccaaaagttcttatctcaggagccacgaatctgcagagcggtgtgccgagtcggttctccggctctgggagcggaaccgactttacattgactatttcctcattacagcccgaggatttcgcgacctactattgtcagcaaagttacaacacacctctgatctttggccagggtaccaagctagaaattaaa

SEQ ID NO: 27629 - RNA, 321 nt, synthetic construct
  misc_feature 1..321: note = derived and/or modified sequence opt3 from anti-influenza_Chain
  source 1..321: mol_type = other RNA
gacatccagatgacccaaagcccctcctctctgtcagccagtgtgggcgatagactcacaattacttgcagggctagccagtccatatctacgtaccttcactggtatcagcagaagcctgggaaagcaccaaagctgttgatctacgccgcgtcgtcattacaaagcggagtcccgagtcggttctccggttctcgcagcggcaccgactttacactgactatttcctcactacagcccgatgacttcgctacctattactgtcagcagagttatagccctccactcacatttgggcccggaaccaaagttgatatgaag

SEQ ID NO: 27630 - RNA, 321 nt, synthetic construct
  misc_feature 1..321: note = derived and/or modified sequence opt3 from anti-influenza_Chain
  source 1..321: mol_type = other RNA
gacatccagatgacccaaagcccctcctctctgtcagccagtgtgggcgatagagtcacaattacttgcagggctagccagtccatatctaactacctcaattggtatcagcacaagcctggggaggcaccaaaacttctgaactacgccgcgtcgtcattgcagagcggagttccgagtcggttctccgcttctggtagcggcacggactttaccttaacaatctcctcactgcaacccgaagatttcgccacttattactgtcagcagagttataatacccctattacatttgggcagggaacccgcctagagatcaag

SEQ ID NO: 27631 - RNA, 321 nt, synthetic construct
  misc_feature 1..321: note = derived and/or modified sequence opt3 from anti-influenza_Chain
  source 1..321: mol_type = other RNA
gacatccagatgacccaaagcccctcctctctgtcagccagtgtgggcgatagagtcacaattacttgcagggctagccagtccatatctaactacctcaattggtatcagcacaagcctggggaggcaccaaaacttctgaactacgccgcgtcgtcattgcagagcggagttccgagtcggttctccgcttctggtagcggcacggactttaccttatccatctcagggctgcaacccgaagatttcgccacatattactgtcagcagagttataatactcctattacctttggaccaggcacacgcctagagatcaag

SEQ ID NO: 27632 - RNA, 321 nt, synthetic construct
  misc_feature 1..321: note = derived and/or modified sequence opt3 from anti-influenza_Chain
  source 1..321: mol_type = other RNA
gacatccagatgacccaaagcccctcctctctgtcagccagtgtgggcgatagagtcacaattacttgcagggctagccagtccatatctacgtacctcaactggtatcagcagaagcctgggaaagcaccaaaacttctgatctacgccgcgtcgtcattgcacagcggagttccgagtcggttctccggttctggcagcgggaccgactttgctttaacaatttcctcactgcaacccgaggatttcgccacttattactgtcagcagagttatagccctccaatcacctttggacagggcacacgcctagaaattaag

SEQ ID NO: 27633 - RNA, 321 nt, synthetic construct
  misc_feature 1..321: note = derived and/or modified sequence opt3 from anti-influenza_Chain
  source 1..321: mol_type = other RNA
gacatccagatgacccaaagcccctcctctctgtcagccagtgtgggcgatagagtcacaattacttgcagggctagccagacgatatccacctacctcaactggtatcagcagaagtctgggaaagcacctaaacttctgatctacgccgcgtcgggattgcaatcaggtgttccaagccggttcagtggctccgggtctggaacagactttactttaaccattagctccctgcagccggaggatttcgctacatatttttgtcagcagtcatacaatactcccctaaccttcggccaaggtacaaaggtggaaatcaag

SEQ ID NO: 27634 - RNA, 321 nt, synthetic construct
  misc_feature 1..321: note = derived and/or modified sequence opt3 from anti-influenza_Chain
  source 1..321: mol_type = other RNA
gacatccagatgacccaaagcccctcctctctgtcagccagtgtgggcgatagagtcacaattagctgcagggcttcccagtctatatcgacttacctcaactggtatcagcagcaacctgggaaggcaccaaaagttcttatctcaggagccacggacctgcagagcggtgtgccgagtcggttctccggctctgggagcggaaccgattttacattgactatttcctcattacagcccgaggacttcgcgacctactattgtcagcaaagttacaatacacctctgatctttggccagggtaccaagctagaaattaaa

SEQ ID NO: 27635 - RNA, 321 nt, synthetic construct
  misc_feature 1..321: note = derived and/or modified sequence opt3 from anti-influenza_Chain
  source 1..321: mol_type = other RNA
gacatccaggtgacccaaagcccctcctctctgtcagccagtgtcggcgatagagttacaattacttgcagggctagccagaacatatacaagtatctcaattggtaccagcagcggcctgggaaagcaccaaagggacttatctccgccgcgtctggtctgcaatcgggcgtgccgtcacgcttcagcgggagtggatccggcacggactttaccttgacaattacttctttacagcccgaggatttcgctacctattactgtcagcagagctattcccctccactgacatttggtgggggaacccgagtagacatcaaa

SEQ ID NO: 27636 - RNA, 321 nt, synthetic construct
  misc_feature 1..321: note = derived and/or modified sequence opt3 from anti-influenza_Chain
  source 1..321: mol_type = other RNA
cagagcgtgctgacccaacccccttccgagtctgtctcaccaggccagacagccagtgttacttgcagcgggcacaagctcggagacaaatacgtgtcctggtatcagcagaagccgggtcaatctcccgtacttctgatctaccaggataacagaaggccttcgggcattccagaacggttcatagggtcaaatagcggaaacacggctaccttgacaatcagtggcactcaggcattagacgaggccgattattactgtcaggcgtgggactcctctaccgctgtgtttggtgggggaacaaaactgaccgtcctaggc

SEQ ID NO: 27637 - RNA, 321 nt, synthetic construct
  misc_feature 1..321: note = derived and/or modified sequence opt3 from anti-influenza_Chain
  source 1..321: mol_type = other RNA
gacatccagctgacccaaagcccctcctctctctcagccagtgtgggcgatagagtcacaattacttgcagggctagccaggggatatccacgtaccttgcatggtatcagcagaagcctggaaaagttccaaagctgttgatctacgccgcgtctaccttacaatcgggtgtgccgtcacggttcagcggcagtgggtccggaacagactttactctgaccatttctagcctacagcccgaggatgtagctacatattactgtcagaaatataactccgccccttcattcggcccaggtaccaaggtggacatcaaacgc

SEQ ID NO: 27638 - RNA, 321 nt, synthetic construct
  misc_feature 1..321: note = derived and/or modified sequence opt3 from anti-influenza_Chain
  source 1..321: mol_type = other RNA
agcgtgctgacccagcccccttccgcctctggctcaagagggcaaagtatcacaattagctgcactggatccacgtctgacataggttcgtacaactatgtctcatggtaccagcagcacccaggcaccgctccgaaggttatcctctatgaggtgagccagaggcccagtggggtacctgatcggttctccggatctaaaagcggcaatacagcatttcttactgtgtccggtctgcaagccgaagacgaggcggattactattgtgcttcatacgccgggaacaatatttatgtcttcggaagtggcaccaaggtgaca

SEQ ID NO: 27639 - RNA, 321 nt, synthetic construct
  misc_feature 1..321: note = derived and/or modified sequence opt3 from anti-influenza_Chain
  source 1..321: mol_type = other RNA
agcgccctgacccagcccccttccgcttctggctcaagagggcaaagtatcacaattagctgcactggatccacgtctgacataggttcgtacaactatgtgtcatggtaccagcagcacccaggcaccgcaccgaaggtcatcctctatgaggttagccagaggcccagtggggtgcctgatcggttctccggatctaaaagcggcaatacagcctttcttactgtatccggtctgcaagcggaagacgaggctgattactattgtgcctcatacgcagggaacaatatttatgtgttcggaagtggcaccaaggtcaca

SEQ ID NO: 27640 - RNA, 321 nt, synthetic construct
  misc_feature 1..321: note = derived and/or modified sequence opt3 from anti-influenza_Chain
  source 1..321: mol_type = other RNA
gagatcgtgctgacccagagccccgccacactctccctttctcctggcgaaagagctactctgtcatgcagggcaagtcaaagcgtctccacgttcttggcctggtaccagcagaagccagggcaggcgccgcggttactgatgtatgacgcttctaaccgcgccaccggtattcccgcacgattttcgggatcaggcagcgggacagatttcactctaaccataagttccctcgagcctgaagactttgccatctactattgtcaacagcgttctcactggccacccattttcggacagggcacaagactggagatcaaa

SEQ ID NO: 27641 - RNA, 321 nt, synthetic construct
  misc_feature 1..321: note = derived and/or modified sequence opt3 from anti-influenza_Chain
  source 1..321: mol_type = other RNA
gacatccagatgacccaaagccccgcctccctgtctgtgtcagtcggcgagacagttactattacgtgcagagctagtgaaaagatatacagcaacctcgcatggtatcagcagaaagaggggaagtcccctcagcttctggtgtacgccgcgatcaggttggctgatggagtaccatctcggttctcgggttcaggcagcgggacccaatttagtttaaaaattaattccctgcagtctgaagacttcggaacatattactgtcagcacttttggggcactccgctaaccttcggtgccgggacaaagctcgagctgaaa

SEQ ID NO: 27642 - RNA, 321 nt, synthetic construct
  misc_feature 1..321: note = derived and/or modified sequence opt3 from anti-influenza_Chain
  source 1..321: mol_type = other RNA
gacatccagatgacccaaagcccctcctctgtgtcagccagtgtcggcgatagagttacaattacttgcagggctagccaggacatatccacgtggctggcatggtaccagcagaagcctgggaaagccccaaagctccttatctatgcggcttcttcgctgcaatcaggagtgccgagccggttcagtggttccggctctgggaccgattttacattgactattagctccttacagcccgaggacttcgccacctacttttgtcagcaggcaaactcattccctccaacatttggacaaggcaccaaactggaaatcaag

SEQ ID NO: 27643 - RNA, 321 nt, synthetic construct
  misc_feature 1..321: note = derived and/or modified sequence opt3 from anti-influenza_Chain
  source 1..321: mol_type = other RNA
gacatccagatgacccaaagcccctcctctgtgtcagccagtgtcggcgatagagttacaattacttgcagggctagccaggacatatccacgtggctggcatggtaccagcagaagcctgggaaagccccaaagctccttatctatgcggcttcttcgctgcaatcaggagtgccgagccggttcagtggttccggctctgggaccgattttacattgactattagctccttacagcccgaggacttcgccacctacttttgtcagcaggcaaactcattccctccaacatttggatgcggcaccaaactggaaatcaag

SEQ ID NO: 27644 - RNA, 321 nt, synthetic construct
  misc_feature 1..321: note = derived and/or modified sequence opt3 from anti-influenza_Chain
  source 1..321: mol_type = other RNA
gacatccagatgacccaaagcccctcctctgtgtcagccagtgtcggcgatagagttacaattacttgcagggctagccaggacatatccacgtggctggcatggtaccagcagaagcctgggaaatgtccaaagctccttatctatgccgcgtcttcgctgcaatcaggagtgccgagccggttcagtggttccggctctgggaccgattttacattgactattagctccttacagcccgaggacttcgctacctacttttgccagcaggccaactcattccctccaacatttggacaaggcaccaaactggaaatcaag

SEQ ID NO: 27645 - RNA, 321 nt, synthetic construct
  misc_feature 1..321: note = derived and/or modified sequence opt3 from anti-influenza_Chain
  source 1..321: mol_type = other RNA
gacatccagatgacccaaagcccctcctctgtgtcagccagtgtcggcgatagagttacaattacttgcagggctagccaggacatatccacgtggctggcatggtaccagcagaagcctgggaaagccccaaagctccttatctatgcggcttcttcgctgcaatcaggagtgccgagccggttcagtggttccggctctgggaccgattttacattgactattagctccttacagcccgaggacttcgccacctactattgtcagcaggcaaactcatttcctccaacattcggacaaggcaccaaactggaaatcaag

SEQ ID NO: 27646 - RNA, 321 nt, synthetic construct
  misc_feature 1..321: note = derived and/or modified sequence opt3 from anti-influenza_Chain
  source 1..321: mol_type = other RNA
gacatccagatgacccaaagcccctcctctgtgtcagccagtgtcggcgatagagttacaattacttgcagggctagccaggacatatccacgtggctggcatggtaccagcagaagcctgggaaagccccaaagctccttatctatgcggcttcttcgctgcaatcaggagtgccgagccggttcagtggttccggctctgggaccgattttacattgactattagctccttacagcccgaggacttcgccacctactattgtcagcaggcaaactcatttcctccaacattcggatgcggcaccaaactggaaatcaag

SEQ ID NO: 27647 - RNA, 321 nt, synthetic construct
  misc_feature 1..321: note = derived and/or modified sequence opt3 from anti-influenza_Chain
  source 1..321: mol_type = other RNA
gacatccagatgacccaaagcccctcctctgtgtcagccagtgtcggcgatagagttacaattacttgcagggctagccaggacatatccacgtggctggcatggtaccagcagaagcctgggaaatgtccaaagctccttatctatgccgcgtcttcgctgcaatcaggagtgccgagccggttcagtggttccggctctgggaccgattttacattgactattagctccttacagcccgaggacttcgctacctactattgccagcaggccaactcatttcctccaacattcggacaaggcaccaaactggaaatcaag

SEQ ID NO: 27648 - RNA, 321 nt, synthetic construct
  misc_feature 1..321: note = derived and/or modified sequence opt3 from anti-influenza_Chain
  source 1..321: mol_type = other RNA
gagatcgtgctgacccagagccccgccacactctccctttctcctggcgaaagagctactctgtcatgcagggcaagtcggagcattacgaccttcttggcctggtaccaacagaagccagggcaggcgccgcgcttactgatatatgacgcttccaaccgagccacaggagtccccgcacgtttttctggttcgggctcagggactgatttcaccctaacaatcaatagcctcgagcctgacgattttgccatttactattgtcagcaaagagaccactggccacccatcttcggacagggcaccaggctggaaattaaa

SEQ ID NO: 27649 - RNA, 321 nt, synthetic construct
  misc_feature 1..321: note = derived and/or modified sequence opt3 from anti-influenza_Chain
  source 1..321: mol_type = other RNA
gagatcgtgctgacccagagccccgccacactctccctttctcctggcgaaagagctactctgtcatgcagggcaagtcggagcattacgaccttcttggcctggtaccaacagaagccagggcaggcgccgcgcttactgatatatgacgcttccaaccgagccacaggagtccccgcacgtttttctggttcgggctcagggactgatttcaccctaacaatcaatagcctcgagcctgacgattttgccatttactattgtcagcaaagagaccactggccacccatcttcggatgcggcaccaggctggaaattaaa

SEQ ID NO: 27650 - RNA, 324 nt, synthetic construct
  misc_feature 1..324: note = derived and/or modified sequence opt3 from anti-influenza_Chain
  source 1..324: mol_type = other RNA
gagatcgtgctgacccagagccccggcacactctccctttctcctggggaaagagccactctgtcatgcagggctagtcaaacggtcagctcctcttacttggcatggtatcagcagaagccaggacaggccccgcggttactgatttacggtgcgtcgtcacgcgctaccggcatacccgaccgattcagcgggagtggatccggcacagattttactctaaccatctctcgtctcgagcctgaagacttcgccgtttattactgtcaacagtatggtaacagcccatacacatttgggcagggaaccaaactggagattaag

SEQ ID NO: 27651 - RNA, 324 nt, synthetic construct
  misc_feature 1..324: note = derived and/or modified sequence opt3 from anti-influenza_Chain
  source 1..324: mol_type = other RNA
gagatcgtgctgacccagagccccggcacactctccgtctctcctggggaaagagccactctttcatgcagggctagtcaaagcatttcctctggatacctggcatggtatcagcagaagccaggtcaggccccgcggttgttaatatacggcgcgtcgtcacgcgctacggggatccccgaccgattcagcggaagtggctccggtaccgattttacactgactatttctcgtctagagcctgaagacttcgccgtttattactgtcaacagtatgggaccagcccacagacatttggacagggcaccaaagtggagatcaag

SEQ ID NO: 27652 - RNA, 324 nt, synthetic construct
  misc_feature 1..324: note = derived and/or modified sequence opt3 from anti-influenza_Chain
  source 1..324: mol_type = other RNA
gaggtggtcctgacccagagccccggcacactctccctttctcctgggcaaagagccactctgtcatgcagggctagtcagagcgtttcctcttcgtacttggcatggtatcagcagaagccaggacaagccccgcggttactgatctacgacgcgtcaaaccgcgctacgggtattcccgatcgattcagcggcagtgggtccggaaccgactttacactaactatatctcgtctcgaacctgaggatttcgccgtgtattactgtcagcagtatggcagctccccatacacctttggtcaggggacaaaactggaaatcaag

SEQ ID NO: 27653 - RNA, 324 nt, synthetic construct
  misc_feature 1..324: note = derived and/or modified sequence opt3 from anti-influenza_Chain
  source 1..324: mol_type = other RNA
gacatccagctgacccaaagcccctcctctctctcagccagtgtgggcgatagagtcacaattacttgcagggctagccaggggataatcacgtaccttaactggtatcagcagaagcctggaaaagcaccaaagctgttgatttacgccacctattccttacaaaatggtgttccgtctcggttctcgggctcagggagcggaacagactttactctgaccatcagttccctacagcccgaggatttcgcgacatactattgtcagcagtcttacagctccctcatgtttaccttcggccaaggtactaaactggacattaag

SEQ ID NO: 27654 - RNA, 324 nt, synthetic construct
  misc_feature 1..324: note = derived and/or modified sequence opt3 from anti-influenza_Chain
  source 1..324: mol_type = other RNA
gagaccgtgctgacacagagccccggcactctctcccttacgcctggggaaagagccaccctgtcttgcagggtcggacaatcagttagtggtagccacttggcttggtaccagcagaagccaggccaggcaccgcggttactgatctatggggcctcctctcgcgcgacaggcattcccgaccgattcggaggttcggtgtcagggactgattttaccctaacaataagccgtctcgagcctgaagacagtgctgtatactattgtcaacagtacggagattccagatataccttcggccagggcactaaactggagatcaag

SEQ ID NO: 27655 - RNA, 324 nt, synthetic construct
  misc_feature 1..324: note = derived and/or modified sequence opt3 from anti-influenza_Chain
  source 1..324: mol_type = other RNA
gagatcgtgctgacccagagccccggcacactctccctttctcctggggaaagagccactctgtcatgcagggctagtcaaagcgtctcctcttcgcagttggcatggtaccagcagaagccaggacaagccccgcggttaattatatatggtgcgtcaacgcgcgctaccggcatccccgaccgattcagcgggagtggatccggcacagattttactctgaccattggtcgtctagagcctgaagacttcgccgtgtttttctgtcagcagtactctacaagcccacccacctttgggcagggaactaaagttgatttcaag

SEQ ID NO: 27656 - RNA, 324 nt, synthetic construct
  misc_feature 1..324: note = derived and/or modified sequence opt3 from anti-influenza_Chain
  source 1..324: mol_type = other RNA
gacatcgtgctgacccagagccccggcacactctccctttctcctggggagagagccactctgtcatgcagggctagtcaaagcgtctcctcttcgtacttggcatggtatcagcagaagccaggacaggccccgcggttagttatgtacggtgcggctacgcgcgccaccggcattcccgatcgattctcagggagcggaagtggccctgactttacactgactatatcccgtctagaaccagaggatttcgcaatgtattactgtcaacagtatggtaactctcccatcacctttgggcagggaacaagactcgaaattaaa

SEQ ID NO: 27657 - RNA, 324 nt, synthetic construct
  misc_feature 1..324: note = derived and/or modified sequence opt3 from anti-influenza_Chain
  source 1..324: mol_type = other RNA
gagatcgtgctgacccagagccccgccacactctccctttctcctggcgaaagagctactctgtcatgcagggcaagtcaaagcgtctcctcttacttggcctggtatcagcagaagccagggcaggcgccgcggttactgatttacgacgcttcgaaccgcgccacgggaatacccgcacgattctcaggtagcggcagtgggaccgattttacactaactatctcctctctcgagcctgaagacttcgccgtttattactgtcaacagcgtagccactggccacccattacctttggacagggcacaagactggagatcaaa

SEQ ID NO: 27658 - RNA, 324 nt, synthetic construct
  misc_feature 1..324: note = derived and/or modified sequence opt3 from anti-influenza_Chain
  source 1..324: mol_type = other RNA
agctacgagctgacccagcccccttccgtgtctgtctcaccaggccaaacagccagaatcacttgcagtggggacgctctcccgaagcagaacgcatattggtaccagcagaaacccggacaagcccctgttcttctgatttataaggatagcgaaaggccatccggtatacccgagcggttctctggctcgtcaagcgggacgaccgtgacattgactatcagtggagtacaggcggaagacgaggctgattactattgtcagtccgccgactctagcggcacctcctgggtgtttggtgggggaacaaaattaaccgtcctg

SEQ ID NO: 27659 - RNA, 324 nt, synthetic construct
  misc_feature 1..324: note = derived and/or modified sequence opt3 from anti-influenza_Chain
  source 1..324: mol_type = other RNA
agctacgtgctgacccaggccccctccgtctctgttgctcctggccaaacagcaagaatcacttgcgggggaaacgccattggttcaaagaaagtgcactggtatcagcataaggcgggccaggctccagtactcgtggtctacgacgatacggacaggccgagtgggatacccgagcggttcagcggatccaattcttggtcgaccgccacacttactatcaaccgcgtggaagcaggcgatgaggccgactattactgtcaggtttgggattttaccattgaccacgtggtcttcggtgggggaacaaaactgaccgtgttg

SEQ ID NO: 27660 - RNA, 324 nt, synthetic construct
  misc_feature 1..324: note = derived and/or modified sequence opt3 from anti-influenza_Chain
  source 1..324: mol_type = other RNA
gagatcgtgctgacccagagccccggcacactctccctttctcctggggaaagagccactctgtcatgcagggctagtcaaagcgtctcctcttcgtacttggcatggtatcagaagaaaccaggacaggccccgcggttactgatttacggtgcgtcaacgcgcgctaccggcatacccgaccgattcacagggagcggaagtggcactgattttaccctatccatctctcgtctcgagcctgaagacttcgccgtttattactgtcagcactttggtacaagcgtgttcacctttgggggaggcactaaggtagagattaaa

SEQ ID NO: 27661 - RNA, 324 nt, synthetic construct
  misc_feature 1..324: note = derived and/or modified sequence opt3 from anti-influenza_Chain
  source 1..324: mol_type = other RNA
gagatcgtgatgacccagagccccgccacactgtccgtctctcctggcgaaagagctactctctcatgcagggcaagtcaaagcgttgggaactcccttgcctggtaccagcagcggccaggacaggcgccgcgcctgttgatttatggtgcttctacgcgagccaccggcataccccctcgtttctcggggtcaggaagcggcacagagtttactttaaccatcagttccctgcaaacagaagacttcgcagtgtactattgtcagcagtacattaattggagaccactatcttttggtgggggaaccaaggtagagatcaaa

SEQ ID NO: 27662 - RNA, 324 nt, synthetic construct
  misc_feature 1..324: note = derived and/or modified sequence opt3 from anti-influenza_Chain
  source 1..324: mol_type = other RNA
caggagagcggcgccgaactggtgagacccggggcttccgtcaagctctcttgcaaagactcaggatacaccttcacaacttattggatgaactgggttaagcaaaggcctgagcagggtcttgaatggatcggccggattgatccatacgacagtgagacgcactataatcagaaatttaaggataaagcaatactgaccgtggacaagagctccaacacagcctacatgcagttgtcttcgttaacttcagaagatagcgcggtatattactgtgtgcgcgggggaagtaccgtcgcttatttcggcgtgtggggtcaaggg

SEQ ID NO: 27663 - RNA, 324 nt, synthetic construct
  misc_feature 1..324: note = derived and/or modified sequence opt3 from anti-influenza_Chain
  source 1..324: mol_type = other RNA
gagatcgtgctgacccagagccccggcacactctccctttctcctggggaaagagccactctgtcatgcagggctagtcaacgggtcagctcctacttggcatggtatcagcagaagccaggacaggccccgcgcttactgatttacggtgcgtctacgcgagctgccggcatacccgaccgtttctcggggtcaggaagcggcaccgattttacactaactatcagtagactcgagcctgaagactccgcagtttattactgtcaacagtatggtaggaccccactgacattcgggggaggcaccaaagtggagattaagcgg

SEQ ID NO: 27664 - RNA, 324 nt, synthetic construct
  misc_feature 1..324: note = derived and/or modified sequence opt3 from anti-influenza_Chain
  source 1..324: mol_type = other RNA
gagatcgtgatgacccagagccccggcacactgtccctctctcctggggaaagagccactctttcatgcagggctagtcaaagcgtctcctcttcgtacctggcatggtatcagcagaagccaggacaggccccgcggttgttaattttcggtgcgtcaagccgcgctacgggcatacccgaccgatttagtgggtccggatctggcaccgatttcacactgactatcagccgtctagagcctgaagactttgccgtttactattgtcaacagtacggttcctcactcaccttcgggggaggcacaaaactggagattaagaga

SEQ ID NO: 27665 - RNA, 324 nt, synthetic construct
  misc_feature 1..324: note = derived and/or modified sequence opt3 from anti-influenza_Chain
  source 1..324: mol_type = other RNA
gagatcgtgctgtaccagagccccggcaccctctccctttctcctggggaaagagccacactgtcatgcagggctagtcaacgggtcagctcctatttggcatggtaccagcagaagccaggacaggccccgcgcttactgatttatggtgcgtctactcgagctgccggcatacccgaccgtttctcggggtcaggaagcggcacggattttaccctaacaatcagtagactcgagcctgaagactccgcagtttactattgtcaacagtacggtaggactccactgaccttcgggggaggcacaaaagtggagattaagcgg

SEQ ID NO: 27666 - RNA, 324 nt, synthetic construct
  misc_feature 1..324: note = derived and/or modified sequence opt3 from anti-influenza_Chain
  source 1..324: mol_type = other RNA
gacatcgtgctgacccaggcccccagcgtctccgtttctcctggccaaacagcttcaattacttgcagtggggatagactcggagagaagttcgcaagctggtaccagcagaaaccaggtcagtccccggtgcttgtaatatatgaagactctaagaggccctcgggcatccctgatcggttttcagggagcaacagtggaaatacggccaccctgacaatttccggcactcaaatcatggacgagggtgatttcttttgtcaggcgtgggactctagcaccgtggtcttcgggggaggcacaaaattgaccgtgttaggccag

SEQ ID NO: 27667 - RNA, 324 nt, synthetic construct
  misc_feature 1..324: note = derived and/or modified sequence opt3 from anti-influenza_Chain
  source 1..324: mol_type = other RNA
gacatcgagctgacccagagcccctccgtgtctgtctcacctggccaaacagccagtattacttgcagcggggataagctcggagacaaattcgtttgttggtaccagcagaaggctggtcagtccccaatagtggtaatctatcaagatgacaaaagaccgtctggcattcccgaaaggttttcggggtcaaacagcggaaatacggcaacccttacaatcagtggcactcaggccatggatgaggcggactacttctgccaggcttgggattccaccacagtggtctttggtgggggaaccaagctgactgtgttgggccag

SEQ ID NO: 27668 - RNA, 324 nt, synthetic construct
  misc_feature 1..324: note = derived and/or modified sequence opt3 from anti-influenza_Chain
  source 1..324: mol_type = other RNA
cagagcgtgctgacccaacccccttccgcctctggctcaagagggcagagtatcacaattagctgcactggatccacgtctgacataggttcgtacaactatgtctcatggtaccagcagcacccaggcaccgctccgaaggttatcctctatgaggtgagccaaaggcccagtggggtacctgatcggttctccggatctaaaagcggcaatacagcatttcttactgtgtccggtctgcagaccgacgatgaagccgactactattgtgcgtcatacgctgggaacaatatttatgtcttcggaagtggcacaaaggtgacc

SEQ ID NO: 27669 - RNA, 327 nt, synthetic construct
  misc_feature 1..327: note = derived and/or modified sequence opt3 from anti-influenza_Chain
  source 1..327: mol_type = other RNA
aacttcatgctgacccagccccacagcgtgtccgagtctcctggcaagacagtcactatctcatgcacggggagtggaggtaatattgccagaaactacgttcaatggtatcagcagaggccaggcagcgctccggtgaccgtaatactcgaagacgataaacggccctccgggatccctgaccgcttttctggatcgattgatcgatcaagcaatagtgcatcccttacaatctctggcctgcgtactgaggacgaagccttgtactattgtcagagctacgatgactccgatttagtggtcttcggtgggggaaccaagctgaca

SEQ ID NO: 27670 - RNA, 327 nt, synthetic construct
  misc_feature 1..327: note = derived and/or modified sequence opt3 from anti-influenza_Chain
  source 1..327: mol_type = other RNA
atgctggagcccctccagatccttagcatttgctccttcatactgtctgccttgcactttatggcttggaccatcggccatttaaaccaaattaagagaggggtgaatctgaaaatccagattaggaaccctaataaggaagcaatcaaccgggaggtctcaatactacgccacaattaccagaaagaaatccaggccaaggagacaatgaaaaagattctcagtgacaacatggaagttctgggagatcatatcgtggtagagggtcttagcactgacgagattatcaagatgggcgaaacggtgctggaggtcgaagagttgcaa

SEQ ID NO: 27671 - RNA, 327 nt, synthetic construct
  misc_feature 1..327: note = derived and/or modified sequence opt3 from anti-influenza_Chain
  source 1..327: mol_type = other RNA
gacatcagactgacccagagccccgccacactctccgtgtctcctggcgagagggctactctttcatgccgggcaagtcacagcgtctcccgcaacctggcctggtaccaacagaagccagggcgagcgccgcgtttgttagtttatgatacgtcttcgagagctaccggtattcccgccaggttctcaggaagcggcagtgggacagaatttactctgaccatatcctctctacagagcgaggacttcgcagtgtactattgtcagcaatacaataactggcctcggacatttggacagggcaccaaagtagatatcaagcgcact

SEQ ID NO: 27672 - RNA, 327 nt, synthetic construct
  misc_feature 1..327: note = derived and/or modified sequence opt3 from anti-influenza_Chain
  source 1..327: mol_type = other RNA
gagatcgtgatgacccagagccccggcacactgtccctctctcctggggaaagagccactctttcatgcagggctagtcaaagcgtctcctcttcgtacctggcatggtatcagcagaagccaggacaggccccgcggttgttaatttacggtgcgtcaacgcgcgctaccggcgttcccgaccgattccacgggggaggcagcggtacagattttactctgaccataagtcgtctagagcctgaagacttcgccgtgtattactgtcaacagtatgatacatcctctgggctcacctttggaggcggcactaaagtagagatcaag

SEQ ID NO: 27673 - RNA, 327 nt, synthetic construct
  misc_feature 1..327: note = derived and/or modified sequence opt3 from anti-influenza_Chain
  source 1..327: mol_type = other RNA
gagatcgtgatgacccagttccccgccacactgagcgtctcccctggcgaaagagttactctctcttgcagggcttcacaaagtgtgagcaacaatcttgcatggtaccagcagaagccagggcagccgccccggctgttgatttatgacgcctccacgcgcgcgaccggagtacctgctaaattttctggtacaggctcggggactgagttcaccttatcaataagcagtctgcaatccgaagattttgccgtgtactattgtcagcagtaccacaactggccaccctcttatagcttcggactaggcacaaagctcgagatcaaa

SEQ ID NO: 27674 - RNA, 327 nt, synthetic construct
  misc_feature 1..327: note = derived and/or modified sequence opt3 from anti-influenza_Chain
  source 1..327: mol_type = other RNA
gagatcattctggcccagagccccggcaccctctccctttctcctggggaaagagctacactgtcatgcagggcaagtcaattcgtgagcactcggtccttggcctggtaccagcagcgcccaggacaggcgccgcgattactgatatatggtgcttcttcgcgtgccacgggcatccccgacagattttcagggagcggaagtggcaccgatttcacactaactatttccaggctcgagcctgaagactttgcagtctactattgtcaacactacggttattctccacggtacgccttcgggcagggaagcaaggttgagatcaaa

SEQ ID NO: 27675 - RNA, 327 nt, synthetic construct
  misc_feature 1..327: note = derived and/or modified sequence opt3 from anti-influenza_Chain
  source 1..327: mol_type = other RNA
gagatcgtgctgacccagagccccggcacactctccctttctcctggggaaagagccactctgtcatgcagggctagtcacttcgtcaactaccggagcttggcatggtatcaacagacgccaggacaggttccgcgcttactgatttacggtgcctccacccgagcgacaggcatacccgaccgtttttctgggtcgggatcaggcactgatttcaccctaacaatcagcagactcgagcctgaagactttgctgtgtatttctgtcagcaatacggtgggagtccaaggtatacctttggacagggcactcggctggagattaag

SEQ ID NO: 27676 - RNA, 327 nt, synthetic construct
  misc_feature 1..327: note = derived and/or modified sequence opt3 from anti-influenza_Chain
  source 1..327: mol_type = other RNA
gagatcgtgctgacccagagccccggcacactctccctttctcctggggaaagagccactctgtcatgcagggctagtcacttcgtcattggacgggcagttgcctggtaccaacagaagccaggtcaggcgccgcgcttgttaatatatggcgctagctcccgagccacggggatccccgaccgtttttctggatcgggctcaggtaccgatttcacactgactattagcagactagagaccgaagactttgcagtgttctactgtcagcattatgggagttcccctaggtacgcctttggacaaggcacaaaactcgagatcaag

SEQ ID NO: 27677 - RNA, 327 nt, synthetic construct
  misc_feature 1..327: note = derived and/or modified sequence opt3 from anti-influenza_Chain
  source 1..327: mol_type = other RNA
gagatcgtgctgacccagagccccgccacactctccctttctcctggcgaaagagctactctgtcatgcagggcaagtcaaagcgtcgggaactacttggcctggtatcagcagaagccaggacaggcgccgcggttactgatttacgactcctctaatcgcgctcccggtatacctgcccgattctcgggctcagggagcggaacggattttaccctaacaatcagttccctcgcaccagaggacttcgccgtttattactgtcaacagcgttctaaatggccccctatgtatagctttggccacggtactaagctggaaattaaa

SEQ ID NO: 27678 - RNA, 327 nt, synthetic construct
  misc_feature 1..327: note = derived and/or modified sequence opt3 from anti-influenza_Chain
  source 1..327: mol_type = other RNA
caggccgtggtcacccaagagcccagcctgacagtttcccctggcgggactgtgacgctcacttgcggatcttcaacaggtccagtaaccagtggccactacccgtattggttccagcagaagcccgggcaggctcctagaacccttatcagcgcaacatccaacacccattcttggactccagccaggttttcgggatcactgttgggcggtcgggcggctttaacactgagcggggcccaacccgaagacgaggcagattactattgtttcctaagttactccggagcctgggtgtttggcggcgggaccacgctcactgtcctg

SEQ ID NO: 27679 - RNA, 327 nt, synthetic construct
  misc_feature 1..327: note = derived and/or modified sequence opt3 from anti-influenza_Chain
  source 1..327: mol_type = other RNA
gccatccagatgacccaaagcccctcctctctgtcagctagtgtgggcgacagagtcacaattacttgcagggcaagccagaacatacggtcctacctcaattggtatcagcagaagcctgggaaagccccaaaccttctgatctacggaacgacctctttggagtcgggtgttccgtcacgcttcagcggcagtgggtccggaacagattttactttaaccatttctagcctgcaacccgaagacttcgcgacatattactgtcagcagtcctatcacacccctcagacttttggccaaggtacaaaggtggagatcaaacgaacc

SEQ ID NO: 27680 - RNA, 327 nt, synthetic construct
  misc_feature 1..327: note = derived and/or modified sequence opt3 from anti-influenza_Chain
  source 1..327: mol_type = other RNA
gacatccagatgacccaaagcccctcctctctgtcagccagtgtgggcgatagaattacaataacttgcagggctagccaggggatcgacaactacctcgcatggttccagcagaagcctggaaaagtcccagagcttctgatttatgccgcgtccacgttgcaatctggtgttccgtcgcggttttcaggcagcgggagtggaaccggcttcacattaactatctcctctctgcagcccgaagatgtggctacctactattgtcagaagtacgacagcgcccctctaacatttggtgggggaaccaaagtagatattaagcgcact

SEQ ID NO: 27681 - RNA, 327 nt, synthetic construct
  misc_feature 1..327: note = derived and/or modified sequence opt3 from anti-influenza_Chain
  source 1..327: mol_type = other RNA
gacatccagctgacccaaagcccctcctctctctcagccagtgtgggcgatagagtcacaattacttgcagggctagccaggggataacggactaccttgcatggtatcagcagaagcctggaaccatcccaaaactgttgatttacgccgcgtccacattacaatctggtgttccgtcgcggttctcaggcgggggatatggcactgattttaccctgacaatcagcagtctacagcccgaggacgtggctacctactattgtcagaagtacaactccgcccctctcactttcggtgggggaacaaaagtagaaattaagcgcacc

SEQ ID NO: 27682 - RNA, 327 nt, synthetic construct
  misc_feature 1..327: note = derived and/or modified sequence opt3 from anti-influenza_Chain
  source 1..327: mol_type = other RNA
gacatcgtgatgacccagagccccttctccctgtctctctcacctggcgagagagccacacttagttgcagggctagccaatccatttctaactacctggcatggtatcagcagaagccagggcaggccccgcggttgttaatatacgattcgtcaaatcgcgcgactggagtccccgctcgatttagcggtagtggctccgggacggacttcaccctgacaatctctagcctagaacctgaggattttgccgtttattactgtcaacagcgttccaactggatgtatactttcggacagggcaccaaagtggaaattaagagaaca

SEQ ID NO: 27683 - RNA, 327 nt, synthetic construct
  misc_feature 1..327: note = derived and/or modified sequence opt3 from anti-influenza_Chain
  source 1..327: mol_type = other RNA
gacatccagatgacccaaagcccctcctctctgtcagccagtgtgggcgatagagtcacaattacttgcagggctagccaggggatatcctcttacctcgcatggtatcagcagaagcctggaaaagttccaacgcttctgatctacgacgcctcgaccttgcggtcaggtgtgccgagccgcttcagtggctccgggtctgcgacagattttactttaaccattagctccctgcaacccgaggacgtagctacatattactgtcagcgatataactcagcccctccaatcaccttcggacagggcactcgtctagaaattaagaga

SEQ ID NO: 27684 - RNA, 327 nt, synthetic construct
  misc_feature 1..327: note = derived and/or modified sequence opt3 from anti-influenza_Chain
  source 1..327: mol_type = other RNA
gagatcgtgatgacccagagccccggcacactgtccctctctcctggggaaagagccactctttcatgcagggctagtcaaagcgtctcctcttcgtacctggcatggtatcagcagaagccaggacaggccccgcggttgttaatttacgacgcgtcaagccgcgctacggatatacccgaccgattcagtggttccggctctgggaccgattttacactgactatcagccgtctagagcctgaagacttcgccgtttattactgtcaacagtatggatcctcactctggacctttggccagggtacaaaagtggagattaagaga

SEQ ID NO: 27685 - RNA, 327 nt, synthetic construct
  misc_feature 1..327: note = derived and/or modified sequence opt3 from anti-influenza_Chain
  source 1..327: mol_type = other RNA
agctacgtgctgacccagcccccttccgtctctgttgccccaggccaaacagctagaatcacttgcgggggaaacaatattggttcaaagagtgtgcactggtatcagcagaaaccgggccaggcacccgtactcgtggtctacgacgatagcgacaggccttccgggataccagagcggttctctggatcgaactcaggcaatacggccacccttacaatcagccgcgtggaagcgggtgatgaggctgactattactgtcaagtttgggatagttcctctgaccatgccgtgtttgggggaggcactcagctgaccgtcttgggc

SEQ ID NO: 27686 - RNA, 327 nt, synthetic construct
  misc_feature 1..327: note = derived and/or modified sequence opt3 from anti-influenza_Chain
  source 1..327: mol_type = other RNA
gagatcgtgctgacccagagccccggcacactctccctttctcctggggaaagagccactctgtcatgcagggctagtcaaagcgtctcctcttcgtacttggcatggtatcagcagaagccaggacaggccccgcggttactgatttacggtgcgtcaagccgcgctacgggcatacccgaccgattcagtgggtccggatctggcaccgattttacactaactatcagccgtctcgagcctgaagacttcgccgtttattactgtcaacagtatggttcctcaccaagaacctttgggggaggcacaaaagtggagattaagagg

SEQ ID NO: 27687 - RNA, 327 nt, synthetic construct
  misc_feature 1..327: note = derived and/or modified sequence opt3 from anti-influenza_Chain
  source 1..327: mol_type = other RNA
agctacgtgctgacccagcccccttccgtctctgttgccccaggccaaacagctagaatcacttgcgggggaaacaatattggttcaaagggcgtgcactggtatcagcagaaaccggggcaggcacccgtactcgtggtctacgacgatagtgacaggcctagcggaataccagagcggttctccggctctaactcgggtaatacggccacccttacaatctcacgcgtggaagcgggggatgaggctgactattactgtcaagtttgggatagcagttccgaccatgtggtctttggaggcggcactaagctgaccgtgttgggg

SEQ ID NO: 27688 - RNA, 327 nt, synthetic construct
  misc_feature 1..327: note = derived and/or modified sequence opt3 from anti-influenza_Chain
  source 1..327: mol_type = other RNA
gagatcgtgctgacccagagccccggcacactctccctttctcctggggaaagagccactctgtcatgcagggctagtcaaagcgtctcctctaactacttgggatggacgcagcagaagccaggtcaggcaccgcggttactgatttatggcgcctcgtcacgcgcgagcgggatacccgaccgattcagtggaggcggttccgggaccgattttacactaactatctctcgtctcgagcctgaagacttcgctgtttactattgtcaacagtacggaagctccccactgacctttggcggcgggacaaaagtggagattaagaga

SEQ ID NO: 27689 - RNA, 327 nt, synthetic construct
  misc_feature 1..327: note = derived and/or modified sequence opt3 from anti-influenza_Chain
  source 1..327: mol_type = other RNA
cagagcgtggtcacccaacccccttccgtttctgtggccccaggccagacagctagaatcacttgcgggggaaacaatattggttcaaagagtgtacactggtaccagcagaaaccgggccaagcacccgtgctggtcgtgtatgacgatagcgacaggccttccgggataccagagcggttctctggatcgaactcaggcaatacggccaccctcacaatcagccgcgttgaagcgggtgatgaggctgactactattgtcaggtgtgggatagttcctctgaccattacgtctttgggactggaaccaaggtgacagtacttggc

SEQ ID NO: 27690 - RNA, 327 nt, synthetic construct
  misc_feature 1..327: note = derived and/or modified sequence opt3 from anti-influenza_Chain
  source 1..327: mol_type = other RNA
agctacgtgctgacccagcccccttccgagtctgtcgccccaggccaaacagctagaatcacttgcgggggaaacaatattggtaggaactcagttcactggtatcagcagaagccgggccaggcacccgtgctcgtagtgtacgacgatagtgaccggcctagcgggataccagaacgcttctccggatctaaatcgggcaatacggccacccttatcatttcacgagtcgaggtgggtgatgaagcggactattactgtcaagtttggcatagcagttccgatcactatgtgtttgggacaggaactaaggtcaccgtgctgggc

SEQ ID NO: 27691 - RNA, 327 nt, synthetic construct
  misc_feature 1..327: note = derived and/or modified sequence opt3 from anti-influenza_Chain
  source 1..327: mol_type = other RNA
gagatcgtgatgacccagagccccggcacactgtccctctctcctgggcaaagagccactctttcatgcagggctagtcagagcgtctcctcttcgtacctggcatggtatcagcagaagccaggacaagccccgcggttgttaatgtacggtgcgtcaagccgcgctacgggcattcccgaccgattcagtgggtccggatctggcaccgattttacactgactataagccgtctagaacctgaggacttcgccgtttattactgtcagcagtatggttcctcaagtctcacctttgggggaggcacaaaactggaaatcaagaga

SEQ ID NO: 27692 - RNA, 327 nt, synthetic construct
  misc_feature 1..327: note = derived and/or modified sequence opt3 from anti-influenza_Chain
  source 1..327: mol_type = other RNA
caggccggcctgacccaaccccctagcgtgtccgtcgctccagggcagacagcaagaatcacttgcggaggtaacaatattggctctaagtcagttcactggtaccagcagaaaccggggcaagcccccgtgctcgtagtgtatgacgatagtgacaggcctagcggaataccagagcggttctccggctctaactcgggtaatacggcgacccttacaatctcacgcgtcgaagctggggatgaggccgactactattgtcaggtgtgggatagcagttccgaccatgttgtgtttggaggcggcactaagctgaccgtcttgggg

SEQ ID NO: 27693 - RNA, 327 nt, synthetic construct
  misc_feature 1..327: note = derived and/or modified sequence opt3 from anti-influenza_Chain
  source 1..327: mol_type = other RNA
cagagcgtggtcacccaacccccttccgagtctgttgccccaggccagacagctagaatcacttgcgggggacacaacattggttcaaatagtgtgcattggtaccagcagaagccgggccaagcacccgtactggtggtctatgacaacagcgataggccttccgggataccagaacggttctctggatcaaattcgggcaacacggccaccctcacaatcagccgcgtggaggcgggtgacgaagctgattactattgtcaggtttgggggagttcctctgaccactacgtgtttggaactggcaccaaagtcacagtgcttggc

SEQ ID NO: 27694 - RNA, 327 nt, synthetic construct
  misc_feature 1..327: note = derived and/or modified sequence opt3 from anti-influenza_Chain
  source 1..327: mol_type = other RNA
gagatcgtgctgacccagagccccggcacactctccctttctcctggggaaagagccactctgtcatgcagggctagtcaaagcgtctcctctaactacttgggatggtatcagcagaagccaggtcaggcaccgcggttactgatttacggcgcctcgtcacgcgcgagcgggatacccgaccgattcagtggaggcggttccgggacggattttaccctaacaatctctcgtctcgagcctgaagacttcgctgtttattactgtcaacagtatggaagctccccactgacttttggcggcgggaccaaagtggagattaagaga

SEQ ID NO: 27695 - RNA, 327 nt, synthetic construct
  misc_feature 1..327: note = derived and/or modified sequence opt3 from anti-influenza_Chain
  source 1..327: mol_type = other RNA
gagatcgtgctgacccagagccccgccacactctccgtctctcctggcgaaagagctactctttcatgcagggcaagtcaaagcgttgactccaacctggcctggtaccagcagaagccagggcaggcgccgcggttgttagtgtattctgcttcgacgcgcgccaccggtattcccgcacgattctcaggaagcggcagtgggacagagtttactctggccatatcctctctacaaagcgaagatttcgctgtatactattgtcagcactacaccaattggcctccacgtctcacatttggaggcggttccaaagtggagatcaag

SEQ ID NO: 27696 - RNA, 327 nt, synthetic construct
  misc_feature 1..327: note = derived and/or modified sequence opt3 from anti-influenza_Chain
  source 1..327: mol_type = other RNA
gagatcgtgctgacccagagccccgccacactctccgtctctcctggcgaaagagctactctttcatgcagggcaagtcaaagcgtttcccacaacctggcctggtaccagcagaagccagggcaggcgccgcggttgttagtgtattctgcttcgacgcgcgccaccggtattcccgcacgattctcaggaagcggcagtgggacagagtttactctggccatatcctctctacaaagcgaagacttcgctgtatactattgtcagcattacaccaattatcctccacgtctcacatttggaggcggttccaaagtggagatcaag

SEQ ID NO: 27697 - RNA, 327 nt, synthetic construct
  misc_feature 1..327: note = derived and/or modified sequence opt3 from anti-influenza_Chain
  source 1..327: mol_type = other RNA
gagatcgtgatgacccagagccccgccacactgtccgtctctcctggcgaaagagctactctctcatgcagggcaagtcaaagcgttgactccaaccttgcctggtaccagcagaagccagggcaggcgccgcggctgttggtgtattctgcttcgacgcgcgccaccggtattcccgcacgattctcaggaagcggcagtgggacagagtttactttagccatatcctctctgcaaagcgaagatttcgctgtatactattgtcagcactacaccaattggcctccacgtctaacatttggaggcggttccaaagtggagatcaag

SEQ ID NO: 27698 - RNA, 327 nt, synthetic construct
  misc_feature 1..327: note = derived and/or modified sequence opt3 from anti-influenza_Chain
  source 1..327: mol_type = other RNA
gagatcgtgctgacccagagccccgccacactctccgtctctcctggcgaaagagctactctttcatgcagggcaagtcaaagcgtttcctctaacctggcctggtaccagcagaagccagggcaggcgccgcggttgttagtgtattcggcttcaacgcgcgccaccggtattcccgcacgattcagcggaagtggctccgggacagagtttactctggccatatctagcctacaatccgaagacttcgctgtatactattgtcagcactacaccaattggcctccacgtctcacatttggaggcggttcaaaagtggagatcaag

SEQ ID NO: 27699 - RNA, 327 nt, synthetic construct
  misc_feature 1..327: note = derived and/or modified sequence opt3 from anti-influenza_Chain
  source 1..327: mol_type = other RNA
gagatcgtgctgacccagagccccgccacactctccgtctctcctggcgaaagagctactctttcatgcagggcaagtcaaagcgttgaccacaacctggcctggtaccagcagaagccagggcaggcgccgcggttgttagtgtattccgcttctacgcgcgccaccggtattcccgcacgattctcgggatcaggcagcgggacagagtttactctggccataagttccctacaatctgaagatttcgctgtatactattgtcagcattacaccaattggcctccacgtctcacatttggaggcggtagcaaagtggagatcaag

SEQ ID NO: 27700 - RNA, 327 nt, synthetic construct
  misc_feature 1..327: note = derived and/or modified sequence opt3 from anti-influenza_Chain
  source 1..327: mol_type = other RNA
gagatcgtgctgacccagagccccgccacactctccgtctctcctggcgaaagagctactctttcatgcagggcaagtcaaagcgtttcccacaacctggcctggtaccagcagaagccagggcaggcgccgcggttgttagtgtattctgcttcgacgcgcgccaccggtattcccgcacgattctcaggaagcggcagtgggacagagtttactctggccatatcctctctacaaagcgaagacttcgctgtatactattgtcagcattacaccaattggcctccacgtctcacatttggaggcggttccaaagtggagatcaag

SEQ ID NO: 27701 - RNA, 327 nt, synthetic construct
  misc_feature 1..327: note = derived and/or modified sequence opt3 from anti-influenza_Chain
  source 1..327: mol_type = other RNA
gagatcgtgctgacccagagccccgccacactctccgtctctcctggcgaaagagctactctttcatgcagggcaagtcaaagcgtttcccacaacctggcctggtaccagcagaagccagggcaggcgccgcggttgttagtgtattctgcttcgacgcgcgccaccggtattcccgcacgattctcaggaagcggcagtgggacagagtttactctggccatatcctctctacaaagcgaagacttcgctgtatactattgtcagcattacaccaattttcctccacgtctcacattcggaggcggttccaaagtggagatcaag

SEQ ID NO: 27702 - RNA, 327 nt, synthetic construct
  misc_feature 1..327: note = derived and/or modified sequence opt3 from anti-influenza_Chain
  source 1..327: mol_type = other RNA
gagatcgtgctgacccagagccccgccacactctccgtctctcctggcgaaagagctactctttcatgcagggcaagtcaaagcgttgactccaacctggcctggtaccagcagaagccagggcaggcgccgcggttgttagtgtattctgcttcgacgcgcgccaccggtattcccgcacgattctcaggaagcggcagtgggacagagtttactctggccatatcctctctacaaagcgaagatttcgctgtatactattgtcagcactacaccaattttcctccacgtctcacattcggaggcggttccaaagtggagatcaag

SEQ ID NO: 27703 - RNA, 327 nt, synthetic construct
  misc_feature 1..327: note = derived and/or modified sequence opt3 from anti-influenza_Chain
  source 1..327: mol_type = other RNA
gagatcgtgctgacccagagccccgccacactctccgtctctcctggcgaaagagctactctttcatgcagggcaagtcaaagcgttgactccaacctggcctggtaccagcagaagccagggcaggcgccgcggttgttagtgtattctgcttcgacgcgcgccaccggtattcccgcacgattctcaggaagcggcagtgggacagagtttactctggccatatcctctctacaaagcgaagatttcgctgtatactattgtcagcactacaccaattatcctccacgtctcacatttggaggcggttccaaagtggagatcaag

SEQ ID NO: 27704 - RNA, 327 nt, synthetic construct
  misc_feature 1..327: note = derived and/or modified sequence opt3 from anti-influenza_Chain
  source 1..327: mol_type = other RNA
gagaccacactgactcagagccccgccacgctctccgtgtctcctggcgaaagagctaccctttcatgcagggcaagtcaagtcatcagccacaacctggcctggtaccagcagaagccagggcaggcgccgcggttgttaatttatggagcttccacacgcgcctctggtatacccgcacgattctcgggctcagggagcggaactgactacaccctgacaatcaccagtctacaatccgaggattttgccgtttattactgtcagcattattctaattggcctccacgtctcactttcggcggtgggacaaaagtggaaattaag

SEQ ID NO: 27705 - RNA, 327 nt, synthetic construct
  misc_feature 1..327: note = derived and/or modified sequence opt3 from anti-influenza_Chain
  source 1..327: mol_type = other RNA
gagatcgtgctgacccagagccccgccacactctccgtctctcctggcgaaagagctactctttcatgcagggcaagtcaagttattagccacaacctggcctggtaccagcagaagccagggcaggcgccgcggttgttaatatatggagcttccacgcgcgcctctggtatccccgcacgattctcgggctcagggagcggaaccgactacacactgactattaccagtctacaatccgaggattttgccgtgtattactgtcagcattattctaattggcctccacgtctcacattcggcggtgggaccaaagtagaaatcaag

SEQ ID NO: 27706 - RNA, 327 nt, synthetic construct
  misc_feature 1..327: note = derived and/or modified sequence opt3 from anti-influenza_Chain
  source 1..327: mol_type = other RNA
gagatcgtgctgacccagagccccgccacactctccgtctctcctggcgaaagagctactctttcatgcagggcaagtcaagttattagccacaacctggcctggtaccagcagaagccagggcaggcgccgcggttgttaatatatggagcttccacgcgcgcctctggtatccccgcacgattctcgggctcagggagcggaaccgactacacactgactattaccagtctacaacctgaggattttgccgtgtattactgtcagcattattccaattggccaccccgtctcacattcggcggtgggaccaaagtagaaatcaag

SEQ ID NO: 27707 - RNA, 327 nt, synthetic construct
  misc_feature 1..327: note = derived and/or modified sequence opt3 from anti-influenza_Chain
  source 1..327: mol_type = other RNA
gagatcgtgatgacccagagccccgccacactgtccgtctctcctggcgaaagagctactctctcatgcagggcaagtcaagttattagccacaaccttgcctggtaccagcagaagccagggcaggcgccgcggctgttgatatatggagcttccacgcgcgcctctggtatccccgcacgattctcgggctcagggagcggaaccgactacacattaactattaccagtctgcaatccgaggattttgccgtgtattactgtcagcattattctaattggcctccacgtctaacattcggcggtgggaccaaagtagaaatcaag

SEQ ID NO: 27708 - RNA, 327 nt, synthetic construct
  misc_feature 1..327: note = derived and/or modified sequence opt3 from anti-influenza_Chain
  source 1..327: mol_type = other RNA
gagatcgtgctgacccagagccccgccacactctccgtctctcctggcgaaagagctactctttcatgcagggcaagtcaagttattagccacaacctggcctggtaccagcagaagccagggcaggcgccgcggttgttaatatatggagcttccacgcgcgcctctggtatccccgcacgattctcgggctcagggagcggaaccgactacacactgactattaccagtctacaatccgaggattttgccgtgtattactgtcagcattattctaatttccctccacgtctcacatttggcggtgggaccaaagtagaaatcaag

SEQ ID NO: 27709 - RNA, 327 nt, synthetic construct
  misc_feature 1..327: note = derived and/or modified sequence opt3 from anti-influenza_Chain
  source 1..327: mol_type = other RNA
gagatcgtgctgacccagagccccgccacactctccgtctctcctggcgaaagagctactctttcatgcagggcaagtcaagttattagccacaacctggcctggtaccagcagaagccagggcaggcgccgcggttgttaatatatggagcttccacgcgcgcctctggtatccccgcacgattctcgggctcagggagcggaaccgactacacactgactattaccagtctacaatccgaggattttgccgtgtattactgtcagcattattctaattaccctccacgtctcacattcggcggtgggaccaaagtagaaatcaag

SEQ ID NO: 27710 - RNA, 327 nt, synthetic construct
  misc_feature 1..327: note = derived and/or modified sequence opt3 from anti-influenza_Chain
  source 1..327: mol_type = other RNA
gagatcgtgctgacccagagccccgccacactctccgtctctcctggcgaaagagttactctttcatgcagggctagtcaaagcgtggcaaacaatctggcctggtaccagcagaagccagggcagtccccgcggttgttaatttatggagcgtctacgcgcgacaccggtatacccgctcgattctcgggctcagggagcggaacagagtttactctgaccatcagttccctacaatctgaagatttcgccgtatactattgtcagcagtacaacaattggcctccaatgtatacatttggccagggtaccaaactcgagattaag

SEQ ID NO: 27711 - RNA, 327 nt, synthetic construct
  misc_feature 1..327: note = derived and/or modified sequence opt3 from anti-influenza_Chain
  source 1..327: mol_type = other RNA
gacatcgtgatgacccagagcccctccacactgtctgcctcagtcggcgatagagttactattacgtgcagggctagtcaaagcatagggaactggctcgcatggtaccagcagaagcctggaaaagccccaaaacttctgatctataaggtgtccaccttggagtctggtgtaccgtcgcggttctcaggcagcgggagtggaacagaatttactttaaccattaattccctgcagcccgacgatttcgcgacatactattgtcaacgctacacctctaacagccagggctttactttcggtcaggggacaaagctagagatcaaa

SEQ ID NO: 27712 - RNA, 327 nt, synthetic construct
  misc_feature 1..327: note = derived and/or modified sequence opt3 from anti-influenza_Chain
  source 1..327: mol_type = other RNA
gacatcgtgatgacccagagccccgccacactgtccgtctctcctggcgagagagctactctctcatgcagggcaagtcaagttgtggggacgaaccttgcctggtaccagcagaagccaggacaggcgccgcggctgttgatttatgctgccagcacccgcgcaacaggtatacccgcccgattctccggctctgggtttggaactgatttcaccttaacaatctcgtcactgcaaagcgaagactttgctgtatactattgtcagcagtacaataactggcctctaagtttcggcggtgggaccaaagtggagattcgtagaact

SEQ ID NO: 27713 - RNA, 327 nt, synthetic construct
  misc_feature 1..327: note = derived and/or modified sequence opt3 from anti-influenza_Chain
  source 1..327: mol_type = other RNA
gacatccagatgacccaaagcccctcctctctgtcagccagtgtgggcgatagagtcacaattgtttgcagggctagccaggggataaacactcacctccattggtaccagcagaagcctggaaaagcaccaaaacttctgatctattccgcctctacgttgcacaccggtgtgccgtcgcggttatcaggcagcgggagtggaacagacttcactctgtccatttctagcctacaacccgaggattttgcgacctactattgtcagcagtcctacaattatcctcgcacattcggccagggtaccaacgtagacatcaagcgaact

SEQ ID NO: 27714 - RNA, 327 nt, synthetic construct
  misc_feature 1..327: note = derived and/or modified sequence opt3 from anti-influenza_Chain
  source 1..327: mol_type = other RNA
gacatcctgatgacccagagcccctcctctctctcagccagtgtgggcgatagagtcacaattacttgcagggctagccaagacatacggaaccgccttgcatggtaccagcagaagcctgggaaagccccaaagcgactgatctatgcggcttcctctttgcagtcgggagttccgtcacgtttcagcggtagtggctccgggacggagtttaccttaacaattaattctctgcaacccgaagatttcgccacttactattgtctacagcacaacagctacccttggacctttggaccaggcacaaaagtggagatcaagagaacc

SEQ ID NO: 27715 - RNA, 327 nt, synthetic construct
  misc_feature 1..327: note = derived and/or modified sequence opt3 from anti-influenza_Chain
  source 1..327: mol_type = other RNA
gacatcgtgatgacccagagccccgccacactgtccgtctctcctggcgagggggctactctctcatgcagagcaagtcaaggaattggtagcaaccttgcctggtaccagcacaagccaggccaggcgccgaggctgttgatatatgctgcctccacgcgggcaaccggggttcccgcccgcttctctggatcgggctcaggtacagaatttactttaaccatcagcagtctgcagtccgaggatctagctgtgtacttctgtcaacagtataatacatggcctctcacctttgggggaggcactaaagtagaaattatccgaaca

SEQ ID NO: 27716 - RNA, 327 nt, synthetic construct
  misc_feature 1..327: note = derived and/or modified sequence opt3 from anti-influenza_Chain
  source 1..327: mol_type = other RNA
gacatcgtgatgacccagagcccctccacactgtctgcctcagtcggcgatagagttactattacgtgcagggctagtcaaaccatataccggtggctcgcatggtatcagcagaagcctgggaaagccccaaaggtgcttatctacaaagcgagcacactggagtccggagtaccgtctcgcttctcgggttcaggcagcgggactgaatttaccttggctattagttccttacagcccgacgatttcgccacatattactgtcaacagtataactcttttccttaccgattcggacagggcaccaaggtggagatcaaacgtact

SEQ ID NO: 27717 - RNA, 327 nt, synthetic construct
  misc_feature 1..327: note = derived and/or modified sequence opt3 from anti-influenza_Chain
  source 1..327: mol_type = other RNA
gacatcgtgatgacccagagcccctcctctctgtcagccagtgtcggcgatagagttagcattacatgcagggcttcccaaactataacgcggttcctcaactggtaccagcagaagcctgggaagggaccaaaacttctgatctatgcagcctctaccgtgcaccgcggtgtaccgtcgcgattttcaggcagcgggagtggaacagacttcactttgaccatttcctctttacagcccgaggattttgcgacatactattgtcaacagagctactccgctcctttcacctttggcccaggtactacagtggacatccgtagaacc

SEQ ID NO: 27718 - RNA, 327 nt, synthetic construct
  misc_feature 1..327: note = derived and/or modified sequence opt3 from anti-influenza_Chain
  source 1..327: mol_type = other RNA
gacatcgtgatgacccagccccctgccacactgagcgtctccccaggcgagagagctactctctcttgcggggcatcacaaggacttggtagtaacctggcctggtaccagcagaagccgggccaggcgcccaggttgttaatttatgctgccagcacgcgggcaaccgggataacagcccgcttctccggatctggctcgggtactgaatttaccctgacaatcaattcactacaaagcgaggatttcgctctctactattgtcagcagtacacctattggcctctgacttttgggggaggcacaaaagttgaaattaagcgaacc

SEQ ID NO: 27719 - RNA, 327 nt, synthetic construct
  misc_feature 1..327: note = derived and/or modified sequence opt3 from anti-influenza_Chain
  source 1..327: mol_type = other RNA
gacatcgtgctgacccagagccccgccacactctccgtctctcctggcgagagagctactctttcatgcagggcaagtcaaagcgttaaccggaatctggcctggttccagcagattccagggcaggcgccgcgcttgttaatatttgatgcttccacgcgagccgcagacatccccgcccgtttctctggaggtggctcgggggctgaatttaccctgacagtgtcaagcctacaacctgaggatttcgcagtatactattgtcagcagtacgacaagtggccacccggatttggccagggtactaaagtggaaattaagagaacc

SEQ ID NO: 27720 - RNA, 330 nt, synthetic construct
  misc_feature 1..330: note = derived and/or modified sequence opt3 from anti-influenza_Chain
  source 1..330: mol_type = other RNA
cagagcgtgctgacccagcccccttccgcctctggcgctccagggcagagagtcacactctcatgcagtggaagcggttccaacatcggctctaatactgtttcgtggtaccagcagcttccggggacggcacccaagctgttggtgttcaccaacaatcaaaggccttcaggagtaccagaccggtttagcggcagtaaatccggtacatctgccagcttagcgatttccgggctgcagtcagaggatgaagctgactattactgtgccgcatgggatgacagtctaaacggacaactcttcggcggcgggactaagctgaccgtgctt

SEQ ID NO: 27721 - RNA, 330 nt, synthetic construct
  misc_feature 1..330: note = derived and/or modified sequence opt3 from anti-influenza_Chain
  source 1..330: mol_type = other RNA
cagagcgtgctgacccaacccccttccgtctctgccgctccaggccagagagttacaatctcatgcagtgggactagctccaacattggaaagaattacgtgtcttggtatcagcagctcccgggtgcagcccccaaacttctgatatacgacaacgataagaggccttcgggcatcccagaccggttctcagggagcaaaagtggaacgtccgcgaccttgggcattacaggtttacaaactggggatgaggctgactattactgtggaacctgggattctagcctgtccgtaggcatgtttggcgggggaacacgcctaaccgtgctc

SEQ ID NO: 27722 - RNA, 330 nt, synthetic construct
  misc_feature 1..330: note = derived and/or modified sequence opt3 from anti-influenza_Chain
  source 1..330: mol_type = other RNA
gagaccacactgactcagagccccgccacgctctccgtgtctcctggcgaaagagctaccctttcatgcagggcaagtcaaagcgtctcccggaacctggcctggtaccagcagaagccagggcaggcgccgcgcttgttaatctatggagcttcttcgcgagccacaggtattcccgaccgtttctcaggcagcgggagtggaactgattttaccctgacaatatccagactagagcctgaagacttcgcagtttactattgtcaacagtacggctctagctccatcacctttggtcaggggactaggctcgagattaaacggacagtg

SEQ ID NO: 27723 - RNA, 330 nt, synthetic construct
  misc_feature 1..330: note = derived and/or modified sequence opt3 from anti-influenza_Chain
  source 1..330: mol_type = other RNA
cagagcgtgctgacccaacccccttccgcctctggcacaccagggcagagagtcactatctcatgcagtggaagctcctctaacattggttcgaatacggttaactggtacaagcagctcccgggcaccgctcccaggcttctgatatattcaaatgaccagcggcctagcggggtgccagatcgcttcagtggatccaaatctggcacaagcgcatccttggccatctcaggtttacaaagtgaggacgaagcgaactactattgtgctgcctgggatgacagcctgtctgggtgggtatttggaggcggcactaagctaaccgtgctc

SEQ ID NO: 27724 - RNA, 330 nt, synthetic construct
  misc_feature 1..330: note = derived and/or modified sequence opt3 from anti-influenza_Chain
  source 1..330: mol_type = other RNA
cagagcgccctgacccaacccagatccgtgtctggctcacctgggcagagtgtcacaatcagctgcactggatcctcttcggacgttggtgcttcaaacagcgtgagttggtaccagcagcacccaggcaaggcaccgaaactcgtaatttatgatgtgacggagaggccctccggggtccctcatcggttctctggaagcaagtccggcaataccgcctcacttacagtgagtggtctgcaaccagaagacgaggcggattacttttgttgcgcttatgggggaaaatacttggttgtgttcggcggcgggactaaggtcaccgtgtta

SEQ ID NO: 27725 - RNA, 330 nt, synthetic construct
  misc_feature 1..330: note = derived and/or modified sequence opt3 from anti-influenza_Chain
  source 1..330: mol_type = other RNA
cagagcgccctgacccaacccgcttccgtgtctggctcacctgggcagagtatcacaattagctgcactggaacgtcctctgacgtcggtggctacaactatgtttcgtggtaccagcagcacccagggaaggcaccgaaactccttatatatgaggtgaccaattggccctcaggagtaagcaacagattcagtggctccaagtctggtaatacagccagcctgactatctccgggttgcaagcggaagatgaggctgactactattgttcaagttacgccggaagctctacctgggtgtttggcggcgggacaagggtcaccgtgtta

SEQ ID NO: 27726 - RNA, 330 nt, synthetic construct
  misc_feature 1..330: note = derived and/or modified sequence opt3 from anti-influenza_Chain
  source 1..330: mol_type = other RNA
cagaccgtggtcacacaagagcccagcctgactgtttcccctggcgggacggtgaccctcacatgcgcctcttcaactggagctgtaaccagtagctacttcccaaactggtttcagcagaagccgggtcaggcacccagacctcttatctattccacaaccattaggcactcttggactccagcccggttctcgggctcactgttagggggaaaagcggctttgacactgagcggcgtgcaacccgaagacgaggccgattactattgtctactctacagtggtggggaccctgtcgcatttggaggcggcaccaagctgacggtgctt

SEQ ID NO: 27727 - RNA, 330 nt, synthetic construct
  misc_feature 1..330: note = derived and/or modified sequence opt3 from anti-influenza_Chain
  source 1..330: mol_type = other RNA
cagagcgtgctgacccaatccccctctgtctcagccgctcctggccagaaggttacaatcagttgcagcgggtccgactctaacattggagattacttcgtgtgttggtatcagcacctcccaggtaaaccgccccagcttctgatatacgagaataacaagagaccttcgggcatcccagacaggttttcagggagcaaaagtggaacttccgcaacgttgggcattaccggtatccaaacaggggatgaagccgactattactgcgcgacttgggatggatctttaagcgcttgggtattcggcggcgggaccaagctgacagtgcta

SEQ ID NO: 27728 - RNA, 330 nt, synthetic construct
  misc_feature 1..330: note = derived and/or modified sequence opt3 from anti-influenza_Chain
  source 1..330: mol_type = other RNA
cagagcgccctgacccaacccagatccgtgtctggctcacctgggcagagtatcacaattagctgcactggaggttcctctgacataggcgcttcgaactcagtcagctggtaccagcagcacccagggaaggcaccgaaactcgttatcttcgatgtgacggagaggcccagtggagtacctcatcggttttccggctctaagagcggtaataccgcctcccttacagtgtcagggctgcaaccagacgatgaagcggactatttctgttgcgcttacggaggcaaatatttggtcgtgtttggcgggggaactaaggttaccgtgtta

SEQ ID NO: 27729 - RNA, 330 nt, synthetic construct
  misc_feature 1..330: note = derived and/or modified sequence opt3 from anti-influenza_Chain
  source 1..330: mol_type = other RNA
caggccgtggtcacccaagagcccagcctggctgtttcccctggcgggacagtgactctcacgtgcggatcttcaaccggtgcagtaacaagaggccactacccatattggttccagcagaagccggggcaggcccccagggcgcttatctacgacagtgctggaaaccggcatagctggactcctgcccgcttttccggctctctgttgggtgggaaagcagccttaaccctgtcgggagctcaaccagaagatgaggcagaatattactgtctactctcatatagcggcgtgtgggtcttcggcgggggaacaaagctgaccgtgctt

SEQ ID NO: 27730 - RNA, 330 nt, synthetic construct
  misc_feature 1..330: note = derived and/or modified sequence opt3 from anti-influenza_Chain
  source 1..330: mol_type = other RNA
gagatcgtgatgacccagagccccgccacactgtccgtctctcctggcgaaagagttactctctcatgcagggctagtcaaagcattacggacgggcttgcatggtaccagcagaagtccggacaggccccacggctgttgatatatggtgcgtctacccgcgctacaggcatcccggcccgattctcggggtcaggaagcggcactgagtttaccttaacaattagttccctgcaatctgaagatttcgcagtgtactattgtcagcagtacaacaattggccccctgtaacctttggtcaggggactaaagtggagatcaagcgtaca

SEQ ID NO: 27731 - RNA, 330 nt, synthetic construct
  misc_feature 1..330: note = derived and/or modified sequence opt3 from anti-influenza_Chain
  source 1..330: mol_type = other RNA
agctccgagctgacccagcccccttctgcctcaggcacaccagggcaaagagtgactatcagttgcagcggatccacgtctaacattggttacaatccggtctcgtggtatcagcaggttcccggcaccgctcctaagctccttatatactcaaacacagaaaggccaagcggggtgcccgaccggttcagtggatccaaatctggcactagcgcatccctggccatctcaggtttgcagagtgaggatgaagcggactattactgtgctgcctgggatgacaccttaaatgggcctgtatttggaggcggcacaaaggtgaccgtcctg

SEQ ID NO: 27732 - RNA, 330 nt, synthetic construct
  misc_feature 1..330: note = derived and/or modified sequence opt3 from anti-influenza_Chain
  source 1..330: mol_type = other RNA
cagagcgccctgacccaacccgcttccgtgtctggctcacctgggcagagtatcacaattagctgcactggaacgtcctctgacgtcggtggctacaactatgtttcgtggtaccagcagcacccaggggaggcaccgaagctcatgatatcagatgtgagcaatagacccagtggagtatccaacaggttctctggcagcaaatccggtaataccgcctcacttacaatcagtgggctgcaagcggaagacgaggctgattattactgtactagctatacctcttccaacacattggtgtttggaggcggcaccaagttaactgtcctg

SEQ ID NO: 27733 - RNA, 330 nt, synthetic construct
  misc_feature 1..330: note = derived and/or modified sequence opt3 from anti-influenza_Chain
  source 1..330: mol_type = other RNA
cagagcgtgctgacccaacccccttccgtctctgccgctccaggccagaaggttacaatctcatgcagtgggagctcctctaacattggacacaatttcgtgtcgtggtaccagcagctcccggcaactgcccccaaacttctgatatatgacacggataagagaccttcaggtatcccagacaggtttagcggcagtaaatccgggacctctgcgacattgggaattactggcttacaaaccggtgatgaggctgactactattgtgggacatgggatagctccctgtcaagtgtaatcttcggaggcggcaccaagctaactgtgctc

SEQ ID NO: 27734 - RNA, 330 nt, synthetic construct
  misc_feature 1..330: note = derived and/or modified sequence opt3 from anti-influenza_Chain
  source 1..330: mol_type = other RNA
gacatccagatgacccaaagcccctccacactgtctgcctcagtgggcgatagagtcactattacgtgcagggctagtcagaccataaacaattacctcgcatggtatcagcagaagcctgggaaagccccaaaacttctgatctacaaggcgagctccttggagtctggagttccgtcgcggttctcaggtagcggcagtgggacagaatttactttaaccatttcctctctgcaacccgacgatttcgctacatattactgtcaggagtataacaatgacagccctctaacctttggaggcggtactaaggtggaaatcaaacgcaca

SEQ ID NO: 27735 - RNA, 330 nt, synthetic construct
  misc_feature 1..330: note = derived and/or modified sequence opt3 from anti-influenza_Chain
  source 1..330: mol_type = other RNA
gacatcgagctgacccaggatcccagcgtgtccgtcgcccctggccaaacagctaggattccatgcgttagattcaacatggggccgacttctgtgcactggtaccagcagaagcccggacaggcacctgtactcgtggtctatgacgattcagaccggccaagtggtatacccgaacgctttagcggctccaattctggggattcggccacgcttaccatctcacgagtggaggcgggagacgaagctgattactattgtcaagtttgggacatgagcagtgatcgtagagtgttcggcggtgggacaactctgaccgtcttgggacag

SEQ ID NO: 27736 - RNA, 330 nt, synthetic construct
  misc_feature 1..330: note = derived and/or modified sequence opt3 from anti-influenza_Chain
  source 1..330: mol_type = other RNA
gacatcgtgatgacccagagccccggcacactgtccctctctcctggggagagagccactctttactgcagggcttcacaaagtgtccggagcggatatctggcatggtaccagcacaagccaggtcaggccccgttgttactgttctatgatgcgtccggccgcgctacggggattcccgaccgattttctggatcgggctcaggtaccgatttcacactaactataagccgtctcgaacctgaggactttgccgtttactattgtctgcagtacgggagttccccaagaaccttcggacaaggcacaaaagtggaaatcaagaggacc

SEQ ID NO: 27737 - RNA, 330 nt, synthetic construct
  misc_feature 1..330: note = derived and/or modified sequence opt3 from anti-influenza_Chain
  source 1..330: mol_type = other RNA
gacatcgtgctgacccagagcccctccttcctctctgcctcagtcggcgatagagttacaattacttgcagggctagtcaacttataagctcctactttgcatggtatcagcagaagcctgggaaaccaccgaagctgttgatctacgccgcgtctacgttacagtcgggagtgccctcacggttcagcggtagtggctccgggacccaattttctctgacaattagctccctacagcctgaggacttcgctacttattactgtcagcagctcaactcatatccacccatcacctttggacaaggcacacgcctggaaattaaacgaacc

SEQ ID NO: 27738 - RNA, 330 nt, synthetic construct
  misc_feature 1..330: note = derived and/or modified sequence opt3 from anti-influenza_Chain
  source 1..330: mol_type = other RNA
gacatcaccctgacacagagccccgccactctctccgtgtctcctggcgagagagctacgctttcatgcagggcaagtcaaagcgtctcctctaacctggcctggtaccagcagaagccagggcaggcgccgcggttgttaatttatggagcttcgaatcgcgccaccgatatacccgcacgattctcaggtagcggcagtgggacagaatttactctgaccatctcctctctacaaagcgaggacttcgccgtttactattgtcagcagtttaacgattggcctttcctcacatttggaggcggtaccaaagtggaaattaagcgtact

SEQ ID NO: 27739 - RNA, 330 nt, synthetic construct
  misc_feature 1..330: note = derived and/or modified sequence opt3 from anti-influenza_Chain
  source 1..330: mol_type = other RNA
gacatcgtgatgacccagagcccctccttcctgtctgcctcagtcggcgatagagttacaattacttgcaggacgagtcaagtgataagctcctacctcgcttggtatcagcagcggcctgggaaggcaccaaaacttctgatctacgccgcgtctaccttgcagtcgggagtaccgtcacgctttagcggtagtggctccgggacacgattctctttaactattagcaacctgcaacccgaggactttgctacctatttctgtcagcagctaacaacctaccctccaatcacttttggacagggcacacgtctcgaaattaagagaacc

SEQ ID NO: 27740 - RNA, 330 nt, synthetic construct
  misc_feature 1..330: note = derived and/or modified sequence opt3 from anti-influenza_Chain
  source 1..330: mol_type = other RNA
gacatcgtgctgacccagagcccctccgtctctgttgcccctggccaaacagctagaattacttgcgggggaaacgatataggttcaaagagtgtgcactggtaccagcagaaaccaggccaggcaccggtactcgtggtcttcgacgatagggaccggcccagcgggatccctgagcgcttttccggatctaattcgggcaacacggccacccttacaatttcacgagtggaagcgggtgatgaggctgactattactgtcaagtttgggatatcactagcgacctggtggtcttcgggggaggcaccaagttgacagtggtaggccag

SEQ ID NO: 27741 - RNA, 330 nt, synthetic construct
  misc_feature 1..330: note = derived and/or modified sequence opt3 from anti-influenza_Chain
  source 1..330: mol_type = other RNA
gacatcgtgatgacccagccccctggcacactgagcgtctccccaggggagagagccactctctcttgcagggcttcacaaagtgttagcacgaaccttgcatggtaccagcagaagccgggacaggcgccccggctgttgattcacggtgcctccacccgcgctacaggcatacctgcccgattctctgggtcgggatcaggcgcagaatttactttaaccatcagcagtctgcaatccgaggatgtggccgtatattactgtcagcagtatgacaattggctaccaattacattcggtcccgggaccaaagtggatatccagcgtact

SEQ ID NO: 27742 - RNA, 330 nt, synthetic construct
  misc_feature 1..330: note = derived and/or modified sequence opt3 from anti-influenza_Chain
  source 1..330: mol_type = other RNA
gaccccatgctgacccagacagccagccctgtgtccgctgcagtcggcgggactgttacgatcaactgccaagcctctcagtcagtgtacaataagaacaatctcgcgtggtatcagcagaaacttggacaaccaccgaagctgttgatttacgctgccagtaccttaacaagcggtgtaccctccagattcaaaggctctgggtcgggaactcagtttaccctgacaatatcagatctagagtgtgacgatgcagccacctattactgcgctggcgactatagcggtgggatctacgcattcggaggcggcactaaggtggaaattaaa

SEQ ID NO: 27743 - RNA, 330 nt, synthetic construct
  misc_feature 1..330: note = derived and/or modified sequence opt3 from anti-influenza_Chain
  source 1..330: mol_type = other RNA
gagctggtgatgacccagacacccgccagcgtctccgctgcagttggcgggactgtgacgatctcttgccaatcaagtgaaagcgtatacaagaacaataacctcgcctggttccagcagaaacttggacagcctccaaagctgttgatttatgacgcgtccaaattagcttctggtgtgccgtcgagattttcaggcagcgggagtggaacccaattcacactgactatatccgatctagagtgtgacgatgccgcaacctactattgcgccggcgactactctggtagcaattatgcttttgggggaggcacaaagctcgaaatcaaa

SEQ ID NO: 27744 - RNA, 330 nt, synthetic construct
  misc_feature 1..330: note = derived and/or modified sequence opt3 from anti-influenza_Chain
  source 1..330: mol_type = other RNA
gagcccatgctgacccagacagccagctccgtgtctgctgcagtcggcgggtcagttactatcagttgccaaagctcccagtctgtggactcgaacaatcagctctcatggtaccagcaaaagcctggacagccaccgaaacttctgatttatgccgcgagcacgttgaccagtggtgtaccctccagattcaagggctctgggagcggaacacagtttactttaaccatatccgatctggaatgtgacgatgctgccacatactattgcgcaggcgactactcaggtgggatctatgccttcggaggcggcaccgaggtggtcgtgaaa

SEQ ID NO: 27745 - RNA, 330 nt, synthetic construct
  misc_feature 1..330: note = derived and/or modified sequence opt3 from anti-influenza_Chain
  source 1..330: mol_type = other RNA
gaccccatgctgacccagacagccgctagcgtgtccgcagccgtcggcgggactgttacgatctcttgccaatcaagtgagagcgtgtacaagaacaataacctcgcgtggttccagcagaaacttggacagcctccaaccctgttgatttgggatgcttccaagttagcctctggtgtaccgtcgagattttcaggcagcgggagtggaacacaattcactctgaccatatccgacctagaatgtgatgacgcagccacatattactgcgctggcgattattctggtgtgaattacgcatttgggggaggcaccgaggtcgtggttaaa

SEQ ID NO: 27746 - RNA, 330 nt, synthetic construct
  misc_feature 1..330: note = derived and/or modified sequence opt3 from anti-influenza_Chain
  source 1..330: mol_type = other RNA
gagctggtgatgacccagacacccgccagcgtctccgctgcagttggcgggactgtgacgatctcttgccaatcaagtgaaagcgtatacaagaacaataacctcgcctggttccagcagaaacttggacagcctccaaagctgttgatttatgacgcgtccaaattagcttctggtgtgccgtcgagattttcaggcagcgggagtggaacccaattcacactgactatatccgatctagagtgtgacgatgccgcaacctactattgcgccggcgactactctggtagcaattatgcttttgggggaggcacagaagtcgtggttaag

SEQ ID NO: 27747 - RNA, 330 nt, synthetic construct
  misc_feature 1..330: note = derived and/or modified sequence opt3 from anti-influenza_Chain
  source 1..330: mol_type = other RNA
gaccccatgctgacccagacagccagctccgtgtctgctactgtcggcgggacggttaccatctcatgccaaagtagccagtccgtggataacaataaggacctcgcatggttccagcagaaacctggacactctccaaaacttctgatttactttgcctcgagattggcgtcaggtgtaccgagcaggttcaagggcagtgggtccggaacacattttactttaaccatatctgatctggagtgtgacgatgctgccacatattactgcgcaggcgactatagcggtgccaactacgctttcgggggaggcaccaagctagaaatcaaa

SEQ ID NO: 27748 - RNA, 330 nt, synthetic construct
  misc_feature 1..330: note = derived and/or modified sequence opt3 from anti-influenza_Chain
  source 1..330: mol_type = other RNA
gaccccatgctgacccagacagccagccctgtgtccgctgcagtcggcgggactgttacgatcaactgccaatcttcacagagtgtgtacaataacaatagactcagctggttccagcagaagccaggacaaccgcccaaacttctgatttattccgcctctaccttggcgtcgggtgtatcaagcaggtttaagggcagtgggtccggaacacagttcactttaaccatatctgatctggagtgtgacgatgctgccacatactattgcgcaggcgactacagcggtgggatctatgcctttggaggcggcaccgaactagagattctc

SEQ ID NO: 27749 - RNA, 330 nt, synthetic construct
  misc_feature 1..330: note = derived and/or modified sequence opt3 from anti-influenza_Chain
  source 1..330: mol_type = other RNA
gagctggtgctcacccagacacccgccagcgtctccgctgcagttggcgggactgtgtctatctcatgccaaagtagccagtccgtatacaagaacaataaccttgcctggttccagcagaaactgggacaacctccaacgttgttaatttgggacgcgtctaagctggcttcgggtgtgccgtcaagatttagcggcagtgggtccggaacccagttcacactaactatatctgatctcgaatgtgacgatgccgcaacctattactgcgccggcgactatagcggtgtcaattacgcttttgggggaggcacaaaactggagatcaag

SEQ ID NO: 27750 - RNA, 330 nt, synthetic construct
  misc_feature 1..330: note = derived and/or modified sequence opt3 from anti-influenza_Chain
  source 1..330: mol_type = other RNA
gagctggacctcacccagacacccgccagcgtgtccgctgcagtcggcgggactgttacgatctcttgccaatcaagtgaaagcgtgtacaagaacaataaccttgcctggttccagcagaaactgggacagcctccaaccttgttaatttgggatgcgtccaagctggcttctggtgtaccgtcgagattttcaggcagcgggagtggaacacaattcactctaaccatatccgacctcgagtgtgatgacgccgcaacatattactgcgccggcgattattctggtgtgaattacgcttttgggggaggcaccgaagtcgtggttaaa

SEQ ID NO: 27751 - RNA, 330 nt, synthetic construct
  misc_feature 1..330: note = derived and/or modified sequence opt3 from anti-influenza_Chain
  source 1..330: mol_type = other RNA
gacatccagatgacccaaagcccctcctctctgtcagccagtgtgggcgatagagtcacaattacttgccagagctccgagtctgtttacaagaacaataacctcgcttggtatcagcagaaacctgggaagccaccgaaacttctgatatgggacgcatcgaagttggcctcaggagtgcccagcaggttcagtggttccggctctgggacggattttaccttaacaatcagctccctgcaacctgaagacgtagcgacttactattgtgctggagattactcaggcgtgaattatgccttcggtgggggaaccgaggtcgtggttaaa

SEQ ID NO: 27752 - RNA, 333 nt, synthetic construct
  misc_feature 1..333: note = derived and/or modified sequence opt3 from anti-influenza_Chain
  source 1..333: mol_type = other RNA
gacatcgtgatgacccagagccccgattccctggccgtctctctcggcgagagagctacaattaactgcaagtcaagtcaaagcgttactttcaataacaaaaattaccttgcatggtatcagcagaagcctgggcagccaccgaaactgttgatatactgggcctccacgagggaatctggagtgcccgaccggttttcgggttcaggcagcgggaccgatttcacattaactatcagttccctgcaagcggaggacgtagctgtgtattactgtcagcagcactatcgcacccctccaacatttggacagggcaccaaggtcgaaattaaa

SEQ ID NO: 27753 - RNA, 333 nt, synthetic construct
  misc_feature 1..333: note = derived and/or modified sequence opt3 from anti-influenza_Chain
  source 1..333: mol_type = other RNA
cagagcgccctgacccaacccgcttccgtgtctggctcacctgggcagagtatcacaattagctgcactggaacgggttccgacgtcggcagctcgaacctcgtttcatggtaccagcagcacccagcaaaggccccgaaacttataatctatgaggtgaccaagagacccagcggggtaagtaataggttctccggatctaaaagcggcaacacagcgtccctgactatttcaggtttgcaagctgaagatgaggccgactactattgttgcagttacgcagggtcttcttcctcacgggtgtttggaaccggcacaaaggtcaccgtgtta

SEQ ID NO: 27754 - RNA, 333 nt, synthetic construct
  misc_feature 1..333: note = derived and/or modified sequence opt3 from anti-influenza_Chain
  source 1..333: mol_type = other RNA
cagagcgtgctgacccaacccccttccgcctctggcacaccagggcagagagtcactatctcatgcagtggaagcacgtccaacattggttctaatgctgttaactggtaccagcagctcccgggcaccgcacccaaacttctgatatattcgaataaccaaaggccttcaggggtgccagaccggttcagcggaagtaagtccggcacatctgccagcttggcgatctccggtttacagtcagaggatgaagctgactactattgtgccgcatgggatgacagtctgagcgggtcttgggtatttggaggcggcactaagctaaccgtgctc

SEQ ID NO: 27755 - RNA, 333 nt, synthetic construct
  misc_feature 1..333: note = derived and/or modified sequence opt3 from anti-influenza_Chain
  source 1..333: mol_type = other RNA
gagaccacactgactcagagccccggcacgctctccctttctcctggggaaagagccaccctgtcatgcagggtgagtcaaagcgtctcctctaactacttggcttggtatcagcagaagccaggacaggcaccgcggttactgatctacggtgcctcgtcacgcgcgacaggcattcccgaccgattcagcgggagtggatccggcactgattttaccctaacaatatctcgtctcgagcctgaagacttcgctgtttattactgtcaacagtatggtaccagcccaagagcctttgggcacggaactaaagtggagatcaagaggacagta

SEQ ID NO: 27756 - RNA, 333 nt, synthetic construct
  misc_feature 1..333: note = derived and/or modified sequence opt3 from anti-influenza_Chain
  source 1..333: mol_type = other RNA
cagagcgtgctgacccaacccccttccgtctctggcgccccagggcagagagttacaatctcatgcggaggtagtaggagcaacattggcgctgggtacgacgtgcactggtatcagcagttcccgggaactgcacccaaggtagtgatatacggcaataacaatcggccttccggtgtcccagatcgcttttctgggtcgaaatcaggaacgagcgccagtctcgcgatcaccggccttcaagctgaggacgaagccaactattactgtcagtcctatgatacaaatctgggcgggtctattttcggaggtggcactcaggtgaccgttttg

SEQ ID NO: 27757 - RNA, 333 nt, synthetic construct
  misc_feature 1..333: note = derived and/or modified sequence opt3 from anti-influenza_Chain
  source 1..333: mol_type = other RNA
aacttcatgctgacccagccccacagcgtgtccgagtctcctggcaagacagtcactatctcatgcacggggagtagcggatccattgcctctaattacgttcaatggtatcagcagagaccaggttcggctccgaccacagtgatatacgaagactatcagaggccctcaggcgtacctgatcggtttagcgggagtatcgactcctctagcaactccgcatcactcactattagtggacttaaaaccgaggatgaagccgactactattgtcaaagctacgatgactctgatcatctgatcttcggcggtgggacaaagttgaccgtgtta

SEQ ID NO: 27758 - RNA, 333 nt, synthetic construct
  misc_feature 1..333: note = derived and/or modified sequence opt3 from anti-influenza_Chain
  source 1..333: mol_type = other RNA
cagagcatgctgacccaacccccttccgcctctggcacaccagggcagagagtgactatctcatgcagtggaagctcctctaacattggttcgaatacggtcaactggttcaagcacctcccgggcaccgctcccaaacttctgatatacaggaatgacttgcggccttcaggggttccagatcgctttagcggaagtaagtccggcacatctgccagcttagcaatctccggtctgcagtcagaggacgaagcggattattactgtgctacttgggacgatagtctaaacgggttctatgtgtttggaaccggcacaaaagtaaccgtgctc

SEQ ID NO: 27759 - RNA, 333 nt, synthetic construct
  misc_feature 1..333: note = derived and/or modified sequence opt3 from anti-influenza_Chain
  source 1..333: mol_type = other RNA
gacatccagctgacccaaagcccctcctctctctcagccagtgctggcgatagagtgagcatgacatgcagggcatcccagattatatcttcgtcacttaactggtaccagcagaagcctgggaaagccccaaagctgttgatctatgcggctagcaatttacaaagtggagtcccgtcccggttctctggtagcggctccgggactgactttacgctgaccatttcaagtctacagcccgaggatttcgccacatactattgtcagcagagctactctactcctccagaactcacctttggaggcggtacaaaagttgacatcaagcgcacc

SEQ ID NO: 27760 - RNA, 333 nt, synthetic construct
  misc_feature 1..333: note = derived and/or modified sequence opt3 from anti-influenza_Chain
  source 1..333: mol_type = other RNA
agctacgtgctgacccagcccccttccgcctctggcacaccagggcaaagagtcactatctcatgcagtggaagcacgttcaacattggttccaatgctgttgactggtataggcagctcccgggcaccgcacccaaacttctgatatactctaacaatcagcggccttcgggggtgccagatcgcttttcaggaagccgaagtggcacatccgcctctttggcgatcagcggtttacagtccgaggacgaagctgattattactgtgccgcatgggacgatattctgaacgtacccgtgttcgggggaggcactaagctaaccgtcctcggc

SEQ ID NO: 27761 - RNA, 333 nt, synthetic construct
  misc_feature 1..333: note = derived and/or modified sequence opt3 from anti-influenza_Chain
  source 1..333: mol_type = other RNA
cagagcgccctgacccaacccgctgcagtgtccggctctcctgggcagtcaatcacaattagttgcactggaacgagctccgacgtcggtggctacaactatgtttcttggtaccagcagcacccagggaaggccccgaaactcatgatatatgaggtgtcgaatagaccctcaggagtaagcaacaggttcagtggctccaagtctggtaataccgcgagccttacaatctccgggctgcaagctgaagatgaggccgactactattgttcaagttacacttctagctccacctatgtgtttggaacaggcaccaaagtcactgtgttgggc

SEQ ID NO: 27762 - RNA, 333 nt, synthetic construct
  misc_feature 1..333: note = derived and/or modified sequence opt3 from anti-influenza_Chain
  source 1..333: mol_type = other RNA
agctacgtgctgacccagcccccttccgtctctggcacaccagggcaaagagttactatctcatgcagtggaagcaggtccaacgtgggtgacaattctgtatattggtaccagcacgtgccggagatggcccccaagctccttgtctataaaaacacgcagcggccttcgggcgtgccagctcgcttctcagggagcaagagtggaacctccgcatctctggccattataggcttgcagagcggtgatgaagcggactactattgtgttgcttgggatgactccgtggatgggtacgtctttggatcaggcacaaaagtgactgtattaggc

SEQ ID NO: 27763 - RNA, 333 nt, synthetic construct
  misc_feature 1..333: note = derived and/or modified sequence opt3 from anti-influenza_Chain
  source 1..333: mol_type = other RNA
agcgtgctgacccagcccccttccgtctctgccgctccaggccaaaaggttacaatctcatgcagtgggagctcctctaacattggaaatgactacgtgtcgtggtatcagcagctcccgggtactgcacccaaacttctgatatacgataacaataagagaccttcaggcatcccagacaggttcagcgggagtaaatccggaacgtctgccaccttgggcattacaggtttacagactggggatgaggcgaactattactgtgctacctgggaccggcgccccacagcctatgtagtgtttggaggcggcaccaagctgactgtcctaggg

SEQ ID NO: 27764 - RNA, 333 nt, synthetic construct
  misc_feature 1..333: note = derived and/or modified sequence opt3 from anti-influenza_Chain
  source 1..333: mol_type = other RNA
cagagcgccctgacccaacccagatccgtgtctggctcacctgggcagagtgtcacaatcagctgcactggaacgtcctctgacgttggtggctacaactatgtgtcgtggtaccagcagcacccagggaaggctccgaaactcatgatttatgatgtatcaaagaggcccagcggagtgcctgaccggttcagtggctccaaatctggtaataccgcaagccttacaatatccgggctgcaagccgaggatgaagcggactactattgttcaagttacacttctagctccacccatgtctttggaacaggcaccaaggtgactgttttgggc

SEQ ID NO: 27765 - RNA, 333 nt, synthetic construct
  misc_feature 1..333: note = derived and/or modified sequence opt3 from anti-influenza_Chain
  source 1..333: mol_type = other RNA
agctacgtgctgacccagcccccttccgcctctggcacaccagggcaaagagtcactatctcatgcagtggaagctcctctaacattggttcgaattatgtttactggtatcagcagctcccgggcacggctcccaagttgctgatatacagggacgggcagcggccttcaggagtgccagatcgcttcagcggcagtaaatccggtacctctgcaagccttgccatctccgggttacgatcagacgatgaggcggactattactgtgctacatgggatgacaacctgagtggacccgtatttggcggcgggactaagctaaccgtgctcgga

SEQ ID NO: 27766 - RNA, 333 nt, synthetic construct
  misc_feature 1..333: note = derived and/or modified sequence opt3 from anti-influenza_Chain
  source 1..333: mol_type = other RNA
cagagcgccctgacccaacccgcttccgtgtctggctcacctgggcagagtatcacaattagctgcactggaacgtcctctgacgtcggtggctacaactatgtttcgtggtaccagcagcacccagggaaggcaccgaaactcatgatatatgaggtgtcaaatagacccagcggagtaagtaacaggttctccggctctaagagcggtaataccgcctcccttacaatctcagggctgcaagcggaagatgaggctgactactattgtagtagctacacttcttcctcaaccttggtgtttggaacaggcaccaaagtcactgtgttaggc

SEQ ID NO: 27767 - RNA, 333 nt, synthetic construct
  misc_feature 1..333: note = derived and/or modified sequence opt3 from anti-influenza_Chain
  source 1..333: mol_type = other RNA
accgtgctgacacagccccctagcgtctccggcgccccagggcaaagagttactatctcttgcacgggatcaagtagcaacattggtgctggctacgacgtgcactggtatcagcagctcccggggaccgcacccaaacttctgatatacggaaattccaacaggccttctggcgtaccagatcggttctcgggttcaaagagcgggacaagtgccactttgggaatcaccggcttacagacaggcgacgaggcggattattactgtgggacctgggactcctctctgagcgcttatgtgtttggaactggtacaaaggtcaccgtgctaggc

SEQ ID NO: 27768 - RNA, 333 nt, synthetic construct
  misc_feature 1..333: note = derived and/or modified sequence opt3 from anti-influenza_Chain
  source 1..333: mol_type = other RNA
ggcagcgccctgacccagcccagatccgtgtctgggtcacctggacaaagtgtcacaatcagctgcactggtacgtcctctgacgttggcgggtacaactatgtgtcgtggtaccagcagcacccaggaaaggctccgaaactcatgatttatgatgtatcaaagaggcccagcggcgtgcctgaccggttcagtggttccaaatctgggaataccgcaagccttacaatatccggactgcaggccgaggatgaagcggactactattgttcaagttacacttctagctccacccatgtctttggcacaggcaccaaggtgactgttttgggg

SEQ ID NO: 27769 - RNA, 333 nt, synthetic construct
  misc_feature 1..333: note = derived and/or modified sequence opt3 from anti-influenza_Chain
  source 1..333: mol_type = other RNA
gagatcgtgctgacccagagccccggcacactctccctttctcctggggaaagagccactctgtcatgcagggctagtcaaagcgtctcctcttcgtacttggcatggtatcagcagaagccaggacaggccccgcggttactgattttcggtgcgtcaacgcgcgctaccggcatacccgaccgatttagcgggagtggatccggcacagatttcactctaaccatctctcgtctcgagcctgaagactttgccgttttctactgtcaacagtatggtagcctgccacttacatttgggggaggcaccaaagtggagattaagggcactgta

SEQ ID NO: 27770 - RNA, 333 nt, synthetic construct
  misc_feature 1..333: note = derived and/or modified sequence opt3 from anti-influenza_Chain
  source 1..333: mol_type = other RNA
gagatcgtgctgacccagagccccggcacactctccctttctcctggggaaagagccactctgtcatgcagggctagtcaaagcgtccggtccaacaatttggcatggtaccagcacaagccaggacaggccccgcgcttactgattttcggtgcgtcttcgcgagctacgggcatacccgaccgtttttcagggagcggaagtggcaccgatttcacactaactatctccagactcgagcctgaagactttgccgtttattactgtcagcaatatggttctagcccagcactgaccttcgggggaggcacaaaagtggagattaagaggacc

SEQ ID NO: 27771 - RNA, 333 nt, synthetic construct
  misc_feature 1..333: note = derived and/or modified sequence opt3 from anti-influenza_Chain
  source 1..333: mol_type = other RNA
cagagcctggaggaatccggcgggggactcgtgaagcccggtggctctcttaccctgacatgcactgtctcagggttgagtttatacagcaacgagatcaattgggttagacaagcccctggaaacggcctggaatggattggtgctatagcagggtccggatctgccgactatgcgtcgtgggctaaaggcaggtcaacgatcacccggaatacagatctaaacactgtgaccctcaagatgacaagcctgaccgccgcagacactgccacatacttctgtgctagtttttgggatctttggggcccagggaccctggtaacggtgtcctct

SEQ ID NO: 27772 - RNA, 333 nt, synthetic construct
  misc_feature 1..333: note = derived and/or modified sequence opt3 from anti-influenza_Chain
  source 1..333: mol_type = other RNA
cagagcgtggaggaatccggcgggggactggtcaagcccggtggctctctcacccttacatgcactgtttcagggctgagtttgtacagcaacgagatcaattgggtgagacaagcccctggaaacggcttagaatggattggtgctatagcagggtccggatctgccgactatgcgtcgtgggctaaatcaaggagcacgatcacccggaatacaaacctgaatactgtaaccctaaagatgacaagtctcaccgccgcagatactgccacatacttctgtgcttccttttgggacctgtggggcccaggcacccttgtgacggtctctagc

SEQ ID NO: 27773 - RNA, 333 nt, synthetic construct
  misc_feature 1..333: note = derived and/or modified sequence opt3 from anti-influenza_Chain
  source 1..333: mol_type = other RNA
cagagcctggaggaatccggcgggggactcgtgaagcccggtggctctcttaccctgacatgcactgtctcagggttgagtttatacagcaacgagatcaattgggttagacaagcccctggaaacggcctggaatggattggtgctatagcagggtccggatctgccgactatgcgtcgtgggctaaatcaaggagcacgatcacccggaatacaaacctaaatactgtgaccctcaagatgacaagtctgaccgccgcagatactgccacatacttctgtgcttccttttgggacctttggggcccaggcaccctggtaacggtgtctagc

SEQ ID NO: 27774 - RNA, 333 nt, synthetic construct
  misc_feature 1..333: note = derived and/or modified sequence opt3 from anti-influenza_Chain
  source 1..333: mol_type = other RNA
aacatcgtgctgacccagagccccgcctccctcgctgtctctcttggccaaagagcaacaatttcatgcagggccagtgagagcgttgacatatacggaaattccttcatgcactggtatcagcagaagcctgggcagccaccgaaactgttgatctacttagcgtctaagctggaatgtggtgtgtgcgctcggtttaacggctcggggtgtcgcactgatttcacgctagccattgaccccgtagagggagatgacggcgcaacctattactgccaacagaattatgaagatccttggacatttggtgggggaactaaactcgagatcaag

SEQ ID NO: 27775 - RNA, 333 nt, synthetic construct
  misc_feature 1..333: note = derived and/or modified sequence opt3 from anti-influenza_Chain
  source 1..333: mol_type = other RNA
aacatcgtgctgacccagagccccgcctccctcgctgtctctcctggccaaagagcaacaatttcatgcagggccagtgagagcatagacatctacggaaattccttcatgcactggtatcagaagaaaccagggcagccgcccaaacttctgatttaccgggcgtctaacttggaatcgggtgttcctgctcgctttaatggctcagggagccgaactgatttcacgttaaccatcgacccagtggagggagatgacggcgccacatattactgtcagcaaaactatgaagatccctggacttttggtgggggaaccaagctggagattaag

SEQ ID NO: 27776 - RNA, 333 nt, synthetic construct
  misc_feature 1..333: note = derived and/or modified sequence opt3 from anti-influenza_Chain
  source 1..333: mol_type = other RNA
gagatcgtgctgacccagagccccgccacactctccctttaccctggcgaaagagctactctgtcttgcagggcatcacaaagtgtcagccggtatttggcctggtaccagcagaagccagggcaggcgccgcgcttactgatttatgacgcttccaaccgagccacgggaatacccgcacgtttctctggttcgggctcagggaccgattttacactaactatcagcagtctcgagcctgaagacttcgccgtttactattgtcaacagagatccaattggctgaaaattacctttggacagggcacaaggcttgagatcaagggtaccgtg

SEQ ID NO: 27777 - RNA, 336 nt, synthetic construct
  misc_feature 1..336: note = derived and/or modified sequence opt3 from anti-influenza_Chain
  source 1..336: mol_type = other RNA
gacatcgtgatgacccagagccccgattccctggccgtctctctcggcgagagagctacaattaactgcaagtcaagtcaaagcgttctttactcctctaataacaaaaattatctggcatggtaccagcagaagcctgggcagccaccgaaattgttaatagactgggcctcgactagggaatcaggagtgcccgatcggttcagcggtagtggctccgggacggactttaccctgacaatctctaacctacaagtagaggatgtggcggtctattactgtcagcagtattaccgcagcccttccttcggacagggcactaagctcgaaattaaa

SEQ ID NO: 27778 - RNA, 336 nt, synthetic construct
  misc_feature 1..336: note = derived and/or modified sequence opt3 from anti-influenza_Chain
  source 1..336: mol_type = other RNA
gacatcgtgatgacccagacacccctgagcctctccgtcactcctggccaaccagcctctatttcatgcaagagtagccagtcccttctgcactctgatgggaaaacgtacttgtattggtacttacagaagccgggacagtcgccccaactgctaatatatgaggtttcaaacagattcagcggtgtgcctgacaggtttagtggctccgggtctggaaccgatttcacactcaaaatcagccgggtagaagctgaggacgtgggcgtctactattgtatgcagaatattctgcttccactgacttttggtgggggaaccaaggtggaaatcaaa

SEQ ID NO: 27779 - RNA, 336 nt, synthetic construct
  misc_feature 1..336: note = derived and/or modified sequence opt3 from anti-influenza_Chain
  source 1..336: mol_type = other RNA
gagatcgtgatgacccagacacccctgagcctctccgtcactcctggccaaccagcctctatttcatgcagaagtagccagtcccttctgcactctgacgggaagacgtacttgtattggtacttacagaaaccgggacagccccctcaactgctaatatcggaagttttcaacaggttttcaggtgtgccagatcggttcagcggcagtgggtccggaaccgactttacactcaagatctctcgcgtagaggctgaagatgtgggcgtctattactgtatgcagagcctgcagcttcccctgactttcggtgggggaaccaaagtggagattaag

SEQ ID NO: 27780 - RNA, 336 nt, synthetic construct
  misc_feature 1..336: note = derived and/or modified sequence opt3 from anti-influenza_Chain
  source 1..336: mol_type = other RNA
gacatcgtgatgacccagagccccctgtccctccctgtcacaccaggcgagccggcctctatttcatgcagagctagtcaaagccttctgcactccaacgggtacaattatttggattggtacttacagaagcccggacagtctcctcagctgctaatacaactcggttcgactagggcatcaggcgttccagaccggttcagcgggagtggatccggcacggattttaccctggaaatctctcgcgtggaggccgaagacgtaggtgtgtattactgtatgcaggcgcttcagctgcccttggctttcgggcagggaacacgactcgagattaaa

SEQ ID NO: 27781 - RNA, 336 nt, synthetic construct
  misc_feature 1..336: note = derived and/or modified sequence opt3 from anti-influenza_Chain
  source 1..336: mol_type = other RNA
gacatcgtgatgacccagagccccctgtccctccctgtctctccaggcgagccggcctcaattagttgcagaagctcccaatctcttctgcacgggaacggatacaattatttggattggtacttacagaagcccggtcagtcgcctaggctgctaatatatctcggctcaaaccgggctagcggggttccagaccgcttcagtggatccggctctggtacagattttactctgaaaatcagccgagtggaagcagaggacgtaggggtgtactattgtatgcaggcccttcaaacgcccctgaccttcggaggcggcacaaaggtcgaaattaaa

SEQ ID NO: 27782 - RNA, 336 nt, synthetic construct
  misc_feature 1..336: note = derived and/or modified sequence opt3 from anti-influenza_Chain
  source 1..336: mol_type = other RNA
cagagcgtgctgacccaacccccttccgtctctggcgccccagggcagagagttacaatctcatgcactggaagtagctccaacattggtgctggctacgacgtgcactggtatcagcagctcccggggacggcacccaaacttctgatatacgataataacaataggccttctggagtaccagaccggttctcgggctcaaagagcggtgccagtgcgtccttggctatcaccgggttacaagccgaggatgaagcacattattactgtcagtcttatgacaacagcctgtccggatcagtgtttggcggcgggacacagctaactgtcctcagt

SEQ ID NO: 27783 - RNA, 336 nt, synthetic construct
  misc_feature 1..336: note = derived and/or modified sequence opt3 from anti-influenza_Chain
  source 1..336: mol_type = other RNA
cagagcgtgctgacccaacccccttccgtctctggcgccccagggcagagagttacaatctcatgcactggaagtagctccaacattggttctgactacgatgtgcactggtataagcagctcccgggcacggctcccaaacttctgatattcgggaatagcaacaggccttcaggagtaccagaccggtttagcggcagtaagtccggtacctctgcatcgttggccatcacagggttacaggcggaggatgaagctgactactattgtcaatcctacgattcaagtctgagcggattccatgtgtttggctctggcactaaagtcaccgtgcta

SEQ ID NO: 27784 - RNA, 336 nt, synthetic construct
  misc_feature 1..336: note = derived and/or modified sequence opt3 from anti-influenza_Chain
  source 1..336: mol_type = other RNA
cagagcgtgctgacccaacccccttccgtctctgccgctccaggccagaaggttacaatctcatgcagtgggagctcctctaacattggaaatgactacgtgtcgtggtatcagcagctcccgggtactgcacccaaacttctgatatacgataacaataagagaccttcaggcatcccagacaggttcagcgggagtaaatccggaacgtctgccaccttgggcattacaggtttacaaactggggatgaggcgaactattactgtgctacctgggaccggcgccccacagcctatgtagtgtttggaggcggcaccaagctgactgtcctaggg

SEQ ID NO: 27785 - RNA, 336 nt, synthetic construct
  misc_feature 1..336: note = derived and/or modified sequence opt3 from anti-influenza_Chain
  source 1..336: mol_type = other RNA
gagatcgtgctgacccagagccccggcacactctccctttctcctggggaaagagccactctgtcatgcagggctagtcaaagcgtctcctcttcgtacttggcatggtatcagcagaagccaggacaggccccgcggttactgatttacggtgcgtcaacgcgcgctaccggcatacccgaccgattcagcgggcgtggaagtggcacagattttactctaaccatctcctctctcgagcctgaagacttcgccgtttattactgtcaaaactatggtagcccatttctgttcacatttgggcccggaaccaaagtggatattaagagaactgta

SEQ ID NO: 27786 - RNA, 336 nt, synthetic construct
  misc_feature 1..336: note = derived and/or modified sequence opt3 from anti-influenza_Chain
  source 1..336: mol_type = other RNA
gacatccagctgacccaaagccccctctcccctccagtgacacttggccagccggcctctatttcatgcagaagtagccagtccctgttgtacactgatgggttcacgtatttatcttggtaccaccagaggcccggacaatcgcctcggcgcctgatatataagatctcaaaccgagacagcggtgtcccagatcgttttagtggctccgggtctggaaccgacttcacactaaaaattagcagagttgaggctgaagatgtgggcgtatactattgtatgcaggcaactcattggcccctcacctttggtgaggggacaaaggtggaaatcaaa

SEQ ID NO: 27787 - RNA, 336 nt, synthetic construct
  misc_feature 1..336: note = derived and/or modified sequence opt3 from anti-influenza_Chain
  source 1..336: mol_type = other RNA
gacatcgagctgacccaggaacccagcgcctccggcacacctgggcaaagagtgactatttcttgctcaggagatacgagtaacataggtagcaataccgtctcctggttccagctccttccaggcacagctccgaagctgttgatctttactgacaaccagaggccctctggggttcctggacggttctcgggctcaaaaagcggtaccagtgcatccttagccatttctgggctgcagagcgaggatgaaacagactactattgtgcggcttgggatgactccctaaatggatgggtgtttggcggcgggaccaagctcactgtactgggacaa

SEQ ID NO: 27788 - RNA, 336 nt, synthetic construct
  misc_feature 1..336: note = derived and/or modified sequence opt3 from anti-influenza_Chain
  source 1..336: mol_type = other RNA
gacatcgtgctgacccagagcccctccgcctctggctcacctgggcaaagtgtcacaattagctgcactggaacgtcctctgatgttggtggctacgactatgtgtcgtggtaccagcagcacccagggaaggctccgaaactcatgatatatgaggtaagaaagaggccctcaggagtgcctgatcggttcagcggcagtaaatccggtaacaccgcatctcttacagtcagcgggctgcaggccgaagacgaggcgtactattactgtgcttcctatgccggaacttacatccatttgtttggcggcgggaccaagttaacagtgctgggacaa

SEQ ID NO: 27789 - RNA, 336 nt, synthetic construct
  misc_feature 1..336: note = derived and/or modified sequence opt3 from anti-influenza_Chain
  source 1..336: mol_type = other RNA
caggagcaactgatggaaagcggcgggggactcgtgaagcccggtggctcccttaccctgacatgcactgtctctgggttgtcattatacagtaacgagatcaattgggttagacaggcccctggaaacggcctggaatggattggtgctatagcagggagcggatccgccgactatgcgtcttgggctaaatcgaggtcaacgatcacccggaatacaaacctaaatactgtgaccctcaagatgacaagcctgaccgccgcagatactgccacatacttctgtgctagtttttgggacctttggggcccaggcaccctggtaacggtgtcctct

SEQ ID NO: 27790 - RNA, 336 nt, synthetic construct
  misc_feature 1..336: note = derived and/or modified sequence opt3 from anti-influenza_Chain
  source 1..336: mol_type = other RNA
cagcaacagctgatggagagcggcgggggactcgtgaagcccggtggctcccttaccctgacatgcactgtctctgggttgtcattatacagtaacgaaatcaattgggttagacaggcccctggaaacggcctggagtggattggtgctatagcagggagcggatccgccgactatgcgtcttgggctaaatcgaggtcaacgatcacccggaatacagatctaaacactgtgaccctcaagatgacaagcctgaccgccgcagacactgccacatacttctgtgctagtttttgggatctttggggcccaggcaccctggtaacggtgtcctct

SEQ ID NO: 27791 - RNA, 336 nt, synthetic construct
  misc_feature 1..336: note = derived and/or modified sequence opt3 from anti-influenza_Chain
  source 1..336: mol_type = other RNA
cagcaacagctggtggagagcggcgggggactcgtcaagcccggtggctcccttaccctgacatgcagagtttctgggttgtcattattcagtaacgaaatcaattgggtgaggcaggcccctggaaacggcctggagtggattggtgctatagggggaggcggcagcgcagactacgcctcctgggcgaaatctcggtcgactatcacgcgcaataccaacctaaatacagtaactctccgaatgacctcactgacagctgccgataccgcagcctatttttgtgctagcttctgggacctttgggggccaggaactctggtgacagtcagttcc

SEQ ID NO: 27792 - RNA, 336 nt, synthetic construct
  misc_feature 1..336: note = derived and/or modified sequence opt3 from anti-influenza_Chain
  source 1..336: mol_type = other RNA
gaggtgcagctggtcgaaagcggcgggggactcgttaagcccggtggctcccttagactgtcttgcgccgcttcagggttgagtttattcagcaacgagatcaattgggtgaggcaagcacctggaaaaggcctggaatggattggtgccatagggggaggcggctccgcggactacgcttcttgggccaagtcgcggtttaccatctcacgcgataacgccaaaaatagcctatatctccagatgaacagtctgcgagcagaggacacagctgtatacttctgtgcatccttttgggatctttgggggccaggaactctggtgacggtctctagc

SEQ ID NO: 27793 - RNA, 336 nt, synthetic construct
  misc_feature 1..336: note = derived and/or modified sequence opt3 from anti-influenza_Chain
  source 1..336: mol_type = other RNA
gacatcgtgatgacccagagccccctgtccctccctgtcacaccaggcgagccggcctctatttcatgcagaagtagccaatcccttctgaggtctaacgggtacaattatttggattggtacttacagaagcccggacagtcgcctcagctgctaatatatctcggttcaaaccgggctagcggcgttccagaccgcttcagtgggtccggatctggcactgattttacgctgaaaatcagccgagtggaagcagaggacgtaggtgtgtactattgtatgcaagcccttcagaccccctacacattcgggcagggaactaagctggaaattaaa

SEQ ID NO: 27794 - RNA, 339 nt, synthetic construct
  misc_feature 1..339: note = derived and/or modified sequence opt3 from anti-influenza_Chain
  source 1..339: mol_type = other RNA
gacatcgtgatgacccagagccccgatttcctgcctgtctccctcggcgagagagccacaattaactgcaagtcttcacaaagggttctttacagtagcaataacaaaaattatctggcttggtaccagttgaagccagggcagccgcccaaattaataatctattgggcatccactcgggaatctggagtgcctgaccgcttttcgggttcaggcagcgggacggagttcaccctgacaattagttccctacaggccgaagatgtagcggtgtactattgtcaacagtactattctcgaccatacacttttggacagggcaccaagctcgagatcaaa

SEQ ID NO: 27795 - RNA, 339 nt, synthetic construct
  misc_feature 1..339: note = derived and/or modified sequence opt3 from anti-influenza_Chain
  source 1..339: mol_type = other RNA
gacatcgtgatgacccagagccccgattccctggccgtctctctcggcgagagagctacaattaactgcaagtcaagtcaaagcgttctttactcctctaataacaaaaattatctggcatggtaccagcagaagcctgggcagccaccgaaattgttaatatattgggcctcgactagggaatcaggagtgcccgaccggatcagcggtagtggctccggggcggatttcacgctgaccatttctagcctacaagctgaggacgtagccgtgtactattgtcagcagtactttgcaacacctcgcactttcggacagggcaccaaggtcgaaatcaaa

SEQ ID NO: 27796 - RNA, 339 nt, synthetic construct
  misc_feature 1..339: note = derived and/or modified sequence opt3 from anti-influenza_Chain
  source 1..339: mol_type = other RNA
gacatcgtgatgacccagagccccgattccctggccgtctctctcggcgagagagctacaattaactgcaagtcaagtcaaagcgttctttactcctctaataacaaatcgcacctggcatggtatcagcagaagcctgggcagccaccgaaattgttaatatactgggcctcaactagggaaagcggagtgcccgaccggttcagtggttccggctctgggacggattttaccctgatcattagctccctacaagcggaggacgtagctgtgtattactgtcagcagtattacttctcacctctcacatttggaggcggtactaaggtcgaaatcaaa

SEQ ID NO: 27797 - RNA, 339 nt, synthetic construct
  misc_feature 1..339: note = derived and/or modified sequence opt3 from anti-influenza_Chain
  source 1..339: mol_type = other RNA
gacatcgtgatgacccagagccccgattccctggccgtctctctcggcgagagagctacaattaactgcaggtcaagtcaaagcatattccacaattccaacaatgaaaactaccttgcatggtatcagcagaagcctgggcagccaccgaaactgttgatctactgggcctctactcgggagtcgggagttcccgaccgcttttcaggtagcggcagtgggacggatttcaccttaacaatttcctctctgcaagcggaagacgtggctgtatatttttgtcagcagtactataatgcccctctaactttcggaggcggtaccaaggtggagatcaaa

SEQ ID NO: 27798 - RNA, 339 nt, synthetic construct
  misc_feature 1..339: note = derived and/or modified sequence opt3 from anti-influenza_Chain
  source 1..339: mol_type = other RNA
gagatcgtgctgacccagagccccctctcccttcctgtcacaccaggcgaaccggcctctatttcatgcagaagtagccaatccctgttgcactctaacgggtacaattatttagactggtacctgcagaagcccggacagtcgcctcagctactcatatatctgggttcaaacagggctagcggcgttccagatcggttcagtgggtccggatctggcactgactttacgcttaaaatcagccgcgtggaggcagaagatgtaggtgtgtactattgtatgcaagccctgcagacccccttgacattcgggggaggcactaaggtcgagattaaacga

SEQ ID NO: 27799 - RNA, 339 nt, synthetic construct
  misc_feature 1..339: note = derived and/or modified sequence opt3 from anti-influenza_Chain
  source 1..339: mol_type = other RNA
gacatcgtgctgacccagccccctagcgtctccgttgccccaggccaaacagctactattacgtgcgggggaaactacataggttctaagtcagtgaattggtatcagcagagaccgggccacgcacccgtactcgtggtctacgatgacagtgataggcctagcgggatcccagaccggttctccggatctaactcgcgctcaaccgccacaactgcgacccttacaattagccgagtggaggctggcgatgaagccgactattactgtcaggtttgggagaccagtgaagatctgtgggtgtttggtgggggaactaaattgacagtcttaggccaa

SEQ ID NO: 27800 - RNA, 342 nt, synthetic construct
  misc_feature 1..342: note = derived and/or modified sequence opt3 from anti-influenza_Chain
  source 1..342: mol_type = other RNA
gacgtggtcatgacccagagccccgattccctggccgtttctctcggcgagagagctacaatcaactgcaagtcaagtcaaagcgtgctttactcctctaataacaaaaattatctggcatggtaccagcagaagcctgggcagccaccgaaattgttaatttattgggcctcgactagggaatcaggagtacccgaccggttcagcggtagtggctccgggacggattttaccctgacaatatctagcctacaagcggaggacgtggctgtctactattgtcagcagtactattccactcctctcaccttcggaggcggtacaaaggtggatatcaaacgc

SEQ ID NO: 27801 - RNA, 342 nt, synthetic construct
  misc_feature 1..342: note = derived and/or modified sequence opt3 from anti-influenza_Chain
  source 1..342: mol_type = other RNA
gacatccagatgacccaaagccccgattccctggccgtgtctctcggcgagaaggctacaattaactgcaaatcaagtcagagcatacttaattcctctaacaataagaactacctggcatggtatcagcagaaacctgggcaaccaccgaagttgttaatctactgggcctcgactagagaatcaggagtccccgacaggttcagcggtagtggctccgggacggattttaccctgacaatttctagcctacaggcggaggacgttgctgtgtattactgtcagcagtattactcctcacctccaactttcggacaaggcaccaaagtagaaatcaagcgg

SEQ ID NO: 27802 - RNA, 342 nt, synthetic construct
  misc_feature 1..342: note = derived and/or modified sequence opt3 from anti-influenza_Chain
  source 1..342: mol_type = other RNA
gagatcgtgctgacccagagccccgccacactctccctttaccctggcgaaagagctactctgtcttgcagggcatcacaaagtgtcagccggtatttggcctggtaccagcagaagccagggcaggcgccgcgcttactgatttatgacgcttccaaccgagccacgggaatacccgcacgtttctctggttcgggctcagggaccgattttacactaactatcagcagtctcgagcctgaagacttcgccgtttactattgttgcgatagacaacagaggtccaattggctgaaaattacctttggacagggcacacggcttgagatcaagggtaccgtg

SEQ ID NO: 27803 - RNA, 342 nt, synthetic construct
  misc_feature 1..342: note = derived and/or modified sequence opt3 from anti-influenza_Chain
  source 1..342: mol_type = other RNA
gacatcgtgatgacccagagccaaaagttcgtctccacatctgttggcgatagagtgtcagtaacttgcaaagccagtcagaacgtggggagcaatgtcgcttggtaccagcacaagcccggacattcccctacggcactgatttattctgcctcgcacaggtactcaggtgtgccagaccggtttaccggcagcgagagtgggacagatttcactctcaccatatccaacgttcagtctgaagaccttgcggagtatttttgtcaacagtactatagctacccgtatacattcggaggcggtaccaaactggaaatcaagcgcgctgatgccgcacccact

SEQ ID NO: 27804 - RNA, 342 nt, synthetic construct
  misc_feature 1..342: note = derived and/or modified sequence opt3 from anti-influenza_Chain
  source 1..342: mol_type = other RNA
gacatcgagatgacccagagccccctgtccctccctgtgacaccaggcgaatctgcctcaattagttgcagaagctcccaatctcttctgcactcgaacgggtacaattatttggattggtacttacagaagccgggacagtcaccccagctgctaatatatctcggtagcagtagggcttccggcgtccctgaccggttctctgggagcggatccggcactgattttacgctgaaaatctcacgcgttgaggcagaagacgtgggtgtatactattgtatgcaagggcttcagaccccatacacattcggacagggcactaagctggagattaaacgaacc

SEQ ID NO: 27805 - RNA, 342 nt, synthetic construct
  misc_feature 1..342: note = derived and/or modified sequence opt3 from anti-influenza_Chain
  source 1..342: mol_type = other RNA
gacatcgagatgacccagagccccctgtccctccctgtgacaccaggcgaaccggcctctatttcatgcagaagtagccaatcccttctgcactctaacgggtacaatcacttggcttggtatttacagaagcccggaaggtcgcctcatctgctaatatacctcgcatcaactcgggccagcggtgtcccagatcgcttcagtggctccgggtctggaacggactttaccctgaaaatcagccgagttgaggcggaagatgtgggcatttattactgtatgcagtcccttcagacatcaatcactttcggtcaagggacccgtctggagattaagagaaca

SEQ ID NO: 27806 - RNA, 345 nt, synthetic construct
  misc_feature 1..345: note = derived and/or modified sequence opt3 from anti-influenza_Chain
  source 1..345: mol_type = other RNA
caggtgcaactggtccagagcggcgccgaggttaagaaacccgggtcctctgtgagagtatcatgcaagaccagtggaggtacattcagctcctacgctgtgacttgggtcaggcaggcacctggccaggggctcgaatggatgggaggcatcattggtatgtttgggacgaccaactatgcccaaaaattccagggacggcttacaataactgcggacgagatgacctctacagcttacatggaactgtcgtcattgcgcagcgaggataccgccgtgtattactgtgcacgaggcagttattactatgaaactacattagactactggggccgtgggaccctg

SEQ ID NO: 27807 - RNA, 345 nt, synthetic construct
  misc_feature 1..345: note = derived and/or modified sequence opt3 from anti-influenza_Chain
  source 1..345: mol_type = other RNA
gaggtgcagctggtccaaagcggcgccgaagttaagaaacccgggtcctctgtgaaggtatcatgcaaaaccagtggaggtacattcagctcctacgctgtgacttgggtcagacaggcacctggccaggggctcgagtggatgggagccatcattggcatgtttggtacgaccaactatgcgcagaagttccaagggagggtgacaataactgctgacgaacttacctctacagcctacatggagctgtcgtcattgcggagcgatgacaccgcagtttattactgtgcccgcggaagttattactatgaatcctctttagattactggggcaaaggcactctg

SEQ ID NO: 27808 - RNA, 345 nt, synthetic construct
  misc_feature 1..345: note = derived and/or modified sequence opt3 from anti-influenza_Chain
  source 1..345: mol_type = other RNA
caggtgcaactggtccagagcggcgccgaggttaagaaacccgggtcctctgtgaaggtatcatgcaaaaccagtggaggtacattcagctcctacgctgtgacttgggtcagacaggcacctggccaggggctcgaatggatgggaggcatcattggtatgtttgggacgaccaactatgcccaaaagttccagggaagggtgacaataactgcggacgagcttacctctacagcttacatggaactgtcgtcattgcggagcgaggataccgccgtttattactgtgcacgcggcagttattactatgaatcctctttagactactggggccgagggactctg

SEQ ID NO: 27809 - RNA, 345 nt, synthetic construct
  misc_feature 1..345: note = derived and/or modified sequence opt3 from anti-influenza_Chain
  source 1..345: mol_type = other RNA
gaggtgcagctggtccaaagcggcgccgaagttaagaaacccggggcttccgtgaaggtatcttgcaaagcatcaggatacaccttcacaggttattacgtgtattgggtcagacaggcccctggccaggggctcgagtggatgggatggatcagtgcgtacaacggcaatactaactatgctcagaagtttcaaggtagggtgacgattaccgccgacaaaagcacatccactgcatacatggaactttcttcgctgcggtcagaggataccgccgtttattactgtgctcgcagccgaagtttggacgtgtgggggcagggaacaaccgtcactgtgtcctct

SEQ ID NO: 27810 - RNA, 345 nt, synthetic construct
  misc_feature 1..345: note = derived and/or modified sequence opt3 from anti-influenza_Chain
  source 1..345: mol_type = other RNA
gacatcgtgatgacccagagccccctgtccctccctgtcacaccaggcgagccggcctctatttcatgcagaagtagccaatcccttctgcactctaacgggcatatatacttcgattggtatttgcagaagcccggacagtcgcctcagttactgatctacctagtttcaaaaagggctagcggtgtgccagaccggtttagtggctccgggtctggaactgatttcacgctcaagattagccgcgtagaagcagaggacgtgggcgtctattactgtatgcaagccctggaaaccccctttacattcggtcctgggactaaagtgcacatcaagcgaaccgtt

SEQ ID NO: 27811 - RNA, 345 nt, synthetic construct
  misc_feature 1..345: note = derived and/or modified sequence opt3 from anti-influenza_Chain
  source 1..345: mol_type = other RNA
cagagcgccctgacccaacccgcttccgtgtctggctcacctgggcagagtatcacaattagctgcactggaacgtcctctgacgtcggtgcatacaactatgtttcgtggtaccagcaccatccaggcaaggccccgaaactcatgatatatgatgtgacctacagaccctcaggggtaagcacaaggttcagtggatccaagtctggcaatactgcgagccttaccatctccggtctgcaggctgaggacgaagccgattattactgttcaagtcaaagccggtcttccacattggtgatttttgggggaggcaccaaattaactgtcctgggccagcctaag

SEQ ID NO: 27812 - RNA, 345 nt, synthetic construct
  misc_feature 1..345: note = derived and/or modified sequence opt3 from anti-influenza_Chain
  source 1..345: mol_type = other RNA
gacatcgtgctgacccagagccccgtctccctcgccgtttctcttggcgagtcagctacagtgaactgcaagagtagccaatccgtactgtctaattcgaaaaacttgaattacttagcatggtatcagcacaagcctgggcagccaccgaaactgctaatttactgggcctcaactagagaaagcggagtgcccgataggttcagtggttccggctctgggacggactttaccctcacaataagctccctgcaggcggaggatgtcgctgtgtattactgtcaacagcattattcaatccctcttactttcggaccaggcaccaaggttgacattaaacggaca

SEQ ID NO: 27813 - RNA, 348 nt, synthetic construct
  misc_feature 1..348: note = derived and/or modified sequence opt3 from anti-influenza_Chain
  source 1..348: mol_type = other RNA
gacatcgtgctgacccagagccccctctcccttcctgtcacaccaggcgagccggcctctatttcatgcagaagtagccaatccctgttggattctaacgggtacaattatttagactggtacctgcagaagcccggacagtcgcctcagctactcatatatctggcttcatacagggcaccaggtgttcccgatcggttcagcggcagtgggtccggaactgactttacgcttaaaatctctcgcgtggaagccgaggatgtaggcctgtattactgtatgcaagcgttgcagacccctccaatgtatacattcggtcaggggactaagctcgaaattaaacgaacc

SEQ ID NO: 27814 - RNA, 351 nt, synthetic construct
  misc_feature 1..351: note = derived and/or modified sequence opt3 from anti-influenza_Chain
  source 1..351: mol_type = other RNA
ctggagagcggcgggggactcgtgcagcccggtggctcccttagactgtcttgcgccgcttcagggatcaccttcagtagctacgcaatgtcctgggtcaggcaagcccctggaaagggcttggaatgggtttctacagtgaactcgggtgggggatcaacttattacggcgacagcgtacggggccgctttacgattagtcgagataattccaaatctaccttatatctgcagctaaacagcctccgtgcggaggacacagctatatactattgtgccaaggataaagggagaccaatcttcggactggtgactccgtcctactatatggacgtctggggtaatggcacc

SEQ ID NO: 27815 - RNA, 351 nt, synthetic construct
  misc_feature 1..351: note = derived and/or modified sequence opt3 from anti-influenza_Chain
  source 1..351: mol_type = other RNA
caggagcaactggtgcagagcggcgccgaagtcaagaaacccggggcttccgttaaggtgtcttgcaaagcatcaagaaagagtttcatcggatactatgtacactgggtgaggcaggcccctggtcagggcctcgagtggatggggtggattagcccagactccgatgcgaccaaatacgctcaaaagtttcagggatctgtcataatgacacgggacacttcggtgtcaacggtttatatggaacttagccgcctgaccagtgatgacacagccttgtactattgtttactgttccgaggcggtaactccctatcttgggggcagggaactctcgtgaccgtcagctcc

SEQ ID NO: 27816 - RNA, 351 nt, synthetic construct
  misc_feature 1..351: note = derived and/or modified sequence opt3 from anti-influenza_Chain
  source 1..351: mol_type = other RNA
caggtgcaactgcaggagagcggccccgggctcgtcaagccttccgaaaccctttctctgacatgcactgtttcaggaagtagcatctccaactactattggtcttggattagacagtcgccaggtaaaggcttggagtggatagggttcatctactatggaggcaatacgaagtacaacccgtcattaaaaagcagggtgaccattagtcaggacacatccaagtctcaagtaagcctgactatgtcctcagtgaccgccgctgaaagtgcagtctatttttgtgcccgggcgagctgctctggtgggtactgtatcctagattattggggacagggcacactcgtgacc

SEQ ID NO: 27817 - RNA, 351 nt, synthetic construct
  misc_feature 1..351: note = derived and/or modified sequence opt3 from anti-influenza_Chain
  source 1..351: mol_type = other RNA
gaggtgcagctggtcgaaagcggcgggggactcgttcaacccggtggctcccttagactgtcttgcgccgcttcagggttcacctttagtatctacgcaatgagctgggtgaggcaggcccctggaaagggcttggagtgggtatccgcgatttcttcgtcaggtgacagcacatattacgctgatagtgtgaaagggcggttcactatatcccgcgacaacgcccgaaatacgttatatctgcagatgaactctctacgtgcagaagataccgccgtctactattgtgctagagcatacggatatacatttgacccatggggccagggcactctcgtgaccgttagctcc

SEQ ID NO: 27818 - RNA, 354 nt, synthetic construct
  misc_feature 1..354: note = derived and/or modified sequence opt3 from anti-influenza_Chain
  source 1..354: mol_type = other RNA
caggtgcaactgcaggagagcggccccgggctcgtcaagccttccgaaaccctttctctgacatgcactgtttcaggatacagtttcgacagcggttattactggggctggttgagacagccaccggggaaaggattagagtggatcggctccatttatcactctaggaacacgtactataatccctcgctgaagtcacgggtgaccataagcgtagatacaagtaaaaaccagttttccctacaactctctagcgtgactgccgctgacaccgcagtctactattgtgcccgcggtacatggtactcctcaaatctgcgatactggttcgatccttgggggaagggaaccctt

SEQ ID NO: 27819 - RNA, 354 nt, synthetic construct
  misc_feature 1..354: note = derived and/or modified sequence opt3 from anti-influenza_Chain
  source 1..354: mol_type = other RNA
cagcccgtgctgacccaacctccaagcgcctccgcttctctcggcgcatcagtcacacttacttgcacgctgagtagcgcctactccaactataaggttgactggtaccagcagagaccggggaaaggacccaggttcgtgatgcgggtaggtaccggcgggatcgtgggatctaagggcgatggtattcctgaccgcttttcggtcttggggtcaggattaaatcgatatctgacaatcaaaaacatacaggaggaagatgagagcgactaccactgtggcgcggatcatggcagtgggtccaatttcgtgtctccatatgtttttggaggtggcactaagctaaccgtgctc

SEQ ID NO: 27820 - RNA, 354 nt, synthetic construct
  misc_feature 1..354: note = derived and/or modified sequence opt3 from anti-influenza_Chain
  source 1..354: mol_type = other RNA
caggtgcaactggtccagagcggcgccgacgttaagaaacccgggtcctctgtgaccgtatcatgcaaggctagtggaggtagcttctccaactacggcatcaattgggtgagacaggcacctgggcagggactcgagtggatgggcggtattataccacttatcaacgccccgaattatgcgcccaaatttcaagggagggtcacaattactgctgatatgttctctaacatcgtgtcgctgcagttgacgtcattacggaccgacgatacagccgtttactattgtgcacgccgaaagatgactaccgccattgactactggggacagggcacactggtgaccgtcagcagt

SEQ ID NO: 27821 - RNA, 354 nt, synthetic construct
  misc_feature 1..354: note = derived and/or modified sequence opt3 from anti-influenza_Chain
  source 1..354: mol_type = other RNA
caggtgcaactggtccagagcggcgccgaggttaagaaacccgggtcctctgtgaaggtatcatgcagagaaagtggaggtaccttcaacggctacacaatcacttgggtgaggcaggctcctgggcagggactcgagtggatgggcggtattataccaatgatggggacggtcaattatgcacaaaaacttcagggacgggtgaccatcacaactgactactttaccaagacagcctatatggatctgaacaatttgcgcagcgaagacaccgcgatgtactattgtgttaaaattcgatacactggccagcagttactgtggggccaagggaccctagtgacagtctcctct

SEQ ID NO: 27822 - RNA, 354 nt, synthetic construct
  misc_feature 1..354: note = derived and/or modified sequence opt3 from anti-influenza_Chain
  source 1..354: mol_type = other RNA
caggtgcaactggtccagagcggcgccgaggttaagaaacccggggcttccgtgaaggtatcttgcaaagcatcaggacacaccttcacaggttactatatccattgggtgagacaggcccctggccaggggctcgaatggatgggatggattaacccagacagtggcgcgactagctccgctcaaaattttcagggtagggtcacgatgaccggggatacatcttcgtcaactgcctacatggagcttagccggctgagtttcgacgataccgcagtgtattactgtgcccgcgttttgtttacatccccgttcgacttttggggagaaggcaccttagtgactgtctctagc

SEQ ID NO: 27823 - RNA, 354 nt, synthetic construct
  misc_feature 1..354: note = derived and/or modified sequence opt3 from anti-influenza_Chain
  source 1..354: mol_type = other RNA
cagcccgtgctgagccaacctccatccgcctctgcttcactcggcgcaagtgtcacccttacatgcactctgagctccgggttcgacaactaccaggttgcctggtatcagcagagaccgggaaagggtcccaggtttgtgatgcgggtaggcaatgggggaaacgtggcgtctaaaggcgatggtatccctgaccgcttctcggtctcagggagcggattgaatcgatacttaacgattaagaacatacaagaggatgacgaaagtgattattactgtggcgctgaccacggctccgggaataactttgtgtctccatatgttttcggaggtggcaccaaactgacagtgcta

SEQ ID NO: 27824 - RNA, 354 nt, synthetic construct
  misc_feature 1..354: note = derived and/or modified sequence opt3 from anti-influenza_Chain
  source 1..354: mol_type = other RNA
gaggtgcagctggtcgaaagcggcgccgaggttaagaaacccggggcttccgtgaaggtatcttgcaaagcatcaggatacaccttcagtagatattacatccactgggtgaggcaagcccctggtcaggaactcgagtggatgggctggattaacccagacagcggggatacaaattatgcgcagaagtttcggggacgcgtcactatggctcgagacacgtccatatctaccgtgtacatggaacttaactcgctgcgttatgatgacacagccgtttacttctgtgcaagaatcatttggtcaagcagtggcatggatgtgtggggtcaggggactaccgtcacagtgtcc

SEQ ID NO: 27825 - RNA, 354 nt, synthetic construct
  misc_feature 1..354: note = derived and/or modified sequence opt3 from anti-influenza_Chain
  source 1..354: mol_type = other RNA
gaggtgcagctgctcgaaagcggcgggggagtcgttcaacccggtagatcccttaggctgtcttgcgccgcttcaggcttcacctttcggacatacgggatgcactgggtgcgccaggcacctggaaagggcttggagtgggtagccgtgatcagtcatgacggtaatttaaaatattacgggggaagcgtcaagggccgattcactatttcccgtgataattctaaaaacgcgctgtatctacagatgaactcgctcagagtggacgatacggctctgtactattgtgccaggggcatagggatcaccgacgcatttgatattcggggacagggtacaatggttgtggtctca

SEQ ID NO: 27826 - RNA, 354 nt, synthetic construct
  misc_feature 1..354: note = derived and/or modified sequence opt3 from anti-influenza_Chain
  source 1..354: mol_type = other RNA
gaggtgcagctggtcgaaagcggcgggggactcgttcaacccggtggctcccttagactgtcttgcaccgcctcagggttgagtgtgagctccacatacatgaactgggtaaggcaggctcctggaaagggcttagagtgggtgtctgtcttctattcggaaactcggacgtactatgcagactcagtgaaaggtcgctttaccgttagccgacacaatagtaacaatacactgtacctacagatgaactccctccgtgtggaggatactgccgtctattactgtgcgagagtgcagaggctgtcttatgggatggacgtatggggacaaggcaccacagttaccgtgagctcc

SEQ ID NO: 27827 - RNA, 354 nt, synthetic construct
  misc_feature 1..354: note = derived and/or modified sequence opt3 from anti-influenza_Chain
  source 1..354: mol_type = other RNA
gaggtgcagctggtcgaaagcggcgggggactcgttcaacccggtggctcccttagactgtcttgcaccgcctcagggttgagtgtgagctccacatacatgaactgggtaaggcaggctcctggaaagggcttagagtgggtgtctgtcttctattcggaaactcggacgtactatgcagactcagtgaaaggtcgctttaccgttagccgacacaatagtaacaatacactgtacctacagatgaactccctccgtgccgaggatactgcggtgtattactgtgctagagtccagaggctgtcttatgggatggacgtgtggggacaaggcaccacagtaaccgttagctcc

SEQ ID NO: 27828 - RNA, 354 nt, synthetic construct
  misc_feature 1..354: note = derived and/or modified sequence opt3 from anti-influenza_Chain
  source 1..354: mol_type = other RNA
gacatgcagctggtggagagcggcgggggactcgttccccctggtggctcccttagactgtcttgcgccgcttcagggttcagtgtcagcgataattacatcaattgggtgaggcaagcaccaggaaagggcttggactgggtatccgtgttttattctgccgatcggacctcgtacgcggactcagtcaaaggtcgcttcacagtgagcagtcacgattccaagaacactgtttatttacagatgaactctctgcgagctgaagacacggccgtgtactattgtgcacgtgtccagaaaagctactatgggatggatgtgtggggacagggcaccacagtaactgtttcctca

SEQ ID NO: 27829 - RNA, 357 nt, synthetic construct
  misc_feature 1..357: note = derived and/or modified sequence opt3 from anti-influenza_Chain
  source 1..357: mol_type = other RNA
gaggtgcagctggtcgaaagcggccccgttctcgtgaagcctaccgagacacttactgtaacgtgcaccgtgtccgggttctctgtcgacaacgatagaatgggagtgtcatggatcaggcaaccaccgggtaaagccctggaatggttggctcacatttttagtaatgacgaaaagagctactccacatctttacggtcgcgcctgactatatcaaaagataccagcaagcgacaggttgtgctaagtatgacagacatggatcccgtcgacaccgcaacttattactgtgcccgtgcgccttccgagtatgctgccatggatgtgtggggccaggggacaatggtaaccgtttct

SEQ ID NO: 27830 - RNA, 357 nt, synthetic construct
  misc_feature 1..357: note = derived and/or modified sequence opt3 from anti-influenza_Chain
  source 1..357: mol_type = other RNA
caggtgcaagtcgttcagagcggcaccgaggtgaagaaacccgggtcctctgtaaaggtgtcatgccagacaagtggaggtagattcatgagctacgccatcacttgggtcaggcaggctcctggccaagggctggaatggatgggaggcattgtgccagtttttggtacggcaaactatgcccagaaattccaggggcgggtgaccataacaactgacgattccacccgcacagcgtacatggagctctcttcgcttcgatcagaagacaccgctgtctattactgtggatttcgttatggcagcggctacgggttcgatagttggggacagggtactctggtgacagtatcctct

SEQ ID NO: 27831 - RNA, 357 nt, synthetic construct
  misc_feature 1..357: note = derived and/or modified sequence opt3 from anti-influenza_Chain
  source 1..357: mol_type = other RNA
gaggtgcagctggtcgaaagcggcgccggggttaagaaacccggatcctctgtgaaggtatcatgcaaagctagtggtaacaccttcagctccaatgcaatctcttgggtgagacaagcccctggccaggggctcgagtggatgggaggcattcttggtatgctgaggacaactaactacgcgcagaagtttcaggggcgggtcacgataaccgctgacgagttcatgaatacagcctatatggaattgtcgtcattaactagcgaagataccgcagtgtactattgtgcccgcagttccggatactatccagactactttcacctgtggggccaaggcaccctagttacagtgtct

SEQ ID NO: 27832 - RNA, 357 nt, synthetic construct
  misc_feature 1..357: note = derived and/or modified sequence opt3 from anti-influenza_Chain
  source 1..357: mol_type = other RNA
caggtgcaactgcaggagagcggccccgggctcgtcaagccttccgaaaccctttctctgacatgcactgtttcaggaagtagcatctccaactactattggtcttggattagacagtcgccaggtaaaggcttggagtggatagggttcatctactatggaggcaatacgaagtacaacccgtcattaaaaagcagggtgaccattagtcaggacacatccaagtctcaagtaagcctgactatgtcctcagtgaccgccgctgaaagtgcagtctatttttgtgcccgggcgagctgctctggtgggtactgtatcctagattattggggacagggcacactcgtgaccgtttcc

SEQ ID NO: 27833 - RNA, 357 nt, synthetic construct
  misc_feature 1..357: note = derived and/or modified sequence opt3 from anti-influenza_Chain
  source 1..357: mol_type = other RNA
gaggtgcagctggtcgaaagcggcgggggactcgttcaacccggtggctcccttagaatctcttgcgccgcttcagggttcaccgtgagtagcaactacatgtcctgggtaaggcaggcacctggaaagggcctggagtgggtgtctgtcatttattcgggtgggtcaacatactatgccgacagcgtgaaaggacggtttagtttctcccgcgataattctaagaacactgtgtttttgcagatgaatagcttacgagcggaagacacggctgtttactattgtgcccgttgcctgtccagaatgaggggctacggcctagatgtctgggggcagggaaccacagtgactgtatca

SEQ ID NO: 27834 - RNA, 357 nt, synthetic construct
  misc_feature 1..357: note = derived and/or modified sequence opt3 from anti-influenza_Chain
  source 1..357: mol_type = other RNA
caggtgcaactgcaggagagcggccccgggctcgtcaagccttccgaaaccctttctctgacatgcactgtttcaggagccagtatcagctccgactactggtcttggattagattgccaccgggtaaaggcttagagtggatagggtatatctacaacaggggatcgacgaagtataccccctcactgaaaagccgggtgacaattagtctagatactgctgaaaatcagttctccctccgcctgcgatctgtaaccgcagccgacacagcgatctactattgtgctcgtcacgtgggcggtcatacctacgggattgattattggggacagggcactcttgtcacagtgagctcc

SEQ ID NO: 27835 - RNA, 357 nt, synthetic construct
  misc_feature 1..357: note = derived and/or modified sequence opt3 from anti-influenza_Chain
  source 1..357: mol_type = other RNA
caggtgcaactgcaggagagcggccccgggctcgtcaagccttccgaaaccctttctctgacatgcactgtttcaggagccagtatcagctccgactactggtcttggattagattgccaccgggtaaaggcttagagtggatagggtatatctacaacaggggatcgacgaagtataccccctcactgaaaagccgggtgacaattagtctagatactgctgaaaatcagttctccctccgcctgcgatctgtaaccgcagccgacacagcggtgtactattgtgctcgtcacgtcggcggtcatacctacgggatcgattattggggacagggcactcttgtgacagttagctcc

SEQ ID NO: 27836 - RNA, 357 nt, synthetic construct
  misc_feature 1..357: note = derived and/or modified sequence opt3 from anti-influenza_Chain
  source 1..357: mol_type = other RNA
caggtgcaactgcaggagagcggccccagactcgtcaagccttccgaatctctttcactgacctgcacagttagtgggggaagcatctccaactctttctggggttggattaggcagccaccgggcgaggggttggaatggataggatacgtgtataattcgggcaacactaaatacaatccctcattaaagagccgggtaacgatcagtcgcgacacctccaaatctcagctgtatatgaagctacgaagcgtgacagccgctgatactgcagtctactattgtgcccgtcacgacgatgcgtcccatggttactcaattagttgggggcacggaaccctcgtgacagttagctct

SEQ ID NO: 27837 - RNA, 357 nt, synthetic construct
  misc_feature 1..357: note = derived and/or modified sequence opt3 from anti-influenza_Chain
  source 1..357: mol_type = other RNA
gaggtgcacctccagcaaagcggccccgaactggtcaagcctggggcctccgttaaaatgtcttgcgaggcttcaggatacaccttcacagactattacgtggcatgggtaaagcagagtccaggtgagagctttgaatggatcggcagagtgaacccgtattccgggggaacttcttacaatcagaaattcaagggcaaagccacgcttattgtcgataagtcgtcaagcaccgcgtatatggaactgagttccttgacatctgaggacagcgctgtgtactattgtgccaggtgggattacggtgtttacgaggggtatatagactactggggacagggctccgcattaactgtg

SEQ ID NO: 27838 - RNA, 360 nt, synthetic construct
  misc_feature 1..360: note = derived and/or modified sequence opt3 from anti-influenza_Chain
  source 1..360: mol_type = other RNA
caggtgcaactggtccagcccggcgccgaggttaagaaacctgggagctccgtgaaggtatcttgcaaggcttcaggaggtatcttcagtccatacgcaattagctgggtgagacaggccccgggccaggggctcgaatggatgggaggcataatcgcgatttttggtaccacaaattatgctcaaaaattccaggggagggtcactatcacggccgacaaatccaccacaactgcataccttgagctgaactctttgcggtttgaagataccgccgtgtattactgtgctcgcggaggccgatattacgttgactatttcgattactggggccaggggacattagtgtcggtctcaagc

SEQ ID NO: 27839 - RNA, 360 nt, synthetic construct
  misc_feature 1..360: note = derived and/or modified sequence opt3 from anti-influenza_Chain
  source 1..360: mol_type = other RNA
caggtgcaactgcaggagagcggccccgacctcgtcaagcctggggcctccgttaaaatgtcttgcaaggcttcaggatacagtttcacctattaccacatgcattgggtgaaacagacacacggtaagagccttgaatggatcggcaggattccatataacgggggaactaattactcccagagatttaaaggcaaggcagtattcacggtggatatgtcttcgtcaaccgcctatatggagctgcggagcttgacaagtgaagactccgcggtctactattgtgctcgcgatgccaactacgagggtgactggtactttgatgtgtgggggcaaggaactaccgttacagtgtctagc

SEQ ID NO: 27840 - RNA, 360 nt, synthetic construct
  misc_feature 1..360: note = derived and/or modified sequence opt3 from anti-influenza_Chain
  source 1..360: mol_type = other RNA
caggtgcaactggtccagagcggcgccgaggttaaggaacccgggtccgctatgaaagtgtcttgcaaggcatcaggaggtaccttcagtagcgacgccttttgttgggtaagacaggcgcctggcagggggctcgagtggatgggaggcatcattccagtgttccagacagctaactacggtccgaattttcaagggcgggtcactatatccgccgatgtgtatacgaccacactttacctggaattgtctggattaacttcggaggacaccgcagtttatttctgcgcccgctcaggcgatggctacaactattactttcccctgtgggggcagggaaccctagtgacagtcagcagt

SEQ ID NO: 27841 - RNA, 360 nt, synthetic construct
  misc_feature 1..360: note = derived and/or modified sequence opt3 from anti-influenza_Chain
  source 1..360: mol_type = other RNA
cagatcaccctgagagagagcggccccacactcgtgaagcctactcaaacgcttaccctgacatgcactttctccgggttttctttgtcaaccaacggagtcaatgttggttggattaggcagccaccgggcaaagccttagaatggctggctctaatatactgggacgatgacaagcggtatagtcccagcctcaaacgccgactgacaatcaccaaggatacttccaaaaaccaggtggtacttacactgaccaatatggaccctgtggatacggcaacttactattgtgcccaccgtccagacttctacggggattttgagtattggggacccggcaccttggtcacagtgtcttcg

SEQ ID NO: 27842 - RNA, 360 nt, synthetic construct
  misc_feature 1..360: note = derived and/or modified sequence opt3 from anti-influenza_Chain
  source 1..360: mol_type = other RNA
caggtgcaactggtccagagcggctccgaggttaagaaacccgggacctctgtgaaggtatcatgcacagccagtggaagcgtgttcactaactacggtatctcctgggtcagacaggctcctggccaggggctcgaatggatgggaggcattataccactttttggtgcagccaaatatgcgcaaaagttccaggggagggtgacgatcaccgctgacgagtctacaaaaactgtttacatggaactgtcgcggttgacctcaaaggatacagccatttatttttgtgcaaaggccccgcgcgtgtacgagtattacttcgaccagtggggacagggcacccccgtcactgtgagcagt

SEQ ID NO: 27843 - RNA, 360 nt, synthetic construct
  misc_feature 1..360: note = derived and/or modified sequence opt3 from anti-influenza_Chain
  source 1..360: mol_type = other RNA
caggtgcaactggtccagagcggcgccgacctcaagaaacccggggcttccgttaaggtgtcttgcaaagcatcaggatacaccttcacagattattacatccactgggtaagacaggcccctggtcagggccttgagtggatggggtggattaacccagaaagtggagacactaagtatgcgcaaaaatttcagggcagggtgacgatgacccgggatacaagcataactaccgcttacatggagctgggtcgcttgcgatccgacgatacagccgtctattactgtgcacgtgacgtgtctaccacttggtcgtggttcgccccgtgggggcagggaacattagttaccgtgtcaagc

SEQ ID NO: 27844 - RNA, 360 nt, synthetic construct
  misc_feature 1..360: note = derived and/or modified sequence opt3 from anti-influenza_Chain
  source 1..360: mol_type = other RNA
caggtgcaactgcaggagagcggccccgggctcgtcaagccttccgaaaccctttctctgacatgctcagttagtggaggtagcatcaactactattactggtcctggattagacagccaccgggcaaagggttggagtgtataggatatatctctgacactggcaggacgtactataatccctcgttacggtcacgcgtgaccattagcgtagatacaagtaagaaccagttctccctgaatctaacttctatgaccgccgctgacacagcagtgtactattgcgcccgagatcctaccggtagccgtcagaaaaacgcgtttgacatgtgggggcaaggaactatggtcacagtgtcc

SEQ ID NO: 27845 - RNA, 360 nt, synthetic construct
  misc_feature 1..360: note = derived and/or modified sequence opt3 from anti-influenza_Chain
  source 1..360: mol_type = other RNA
caggtgcaactgcaggagagcggccccagagtcgttaggccttccgaaaccctctctcttacatgcactgtgtcagggggaagtatcagctcctacaactggatttggatacggcagccaccgggtaagggcctggagtggatcgggcacatttatgactacggacgcacgttctataattcttcgttgcagtcacgacccaccatcagcgtagatgccagtaaaaaccaattatccctgcgtctaacatctgtgactgctagcgacaccgcagtctactattgtgccagacctctcggcattctgcattactatgcgatggatctttggggtcaggggacaaccgtgactgtttcctca

SEQ ID NO: 27846 - RNA, 360 nt, synthetic construct
  misc_feature 1..360: note = derived and/or modified sequence opt3 from anti-influenza_Chain
  source 1..360: mol_type = other RNA
caggtgcaactgcaggagagcggccccgggctcgtcaagccttccgaaaccctttctctgacatgctcagttagtggaggtagcatctcctctgacttctggtcgtggattagacagccaccgggcaaagggttggagtggataggatacgtgtataacaggggctcaactaagtacagccccagtttaaaatcccgggtaacgatctctgccgatatgagcaagaatcagttttccctgaacatgtcaagtgtgaccgctgcagacacagccgtctattactgtgcgaaaaatggtcgcagctctacttcctgggggattgatgtgtggggaaagggcaccacagttaccgtgtcaagc

SEQ ID NO: 27847 - RNA, 360 nt, synthetic construct
  misc_feature 1..360: note = derived and/or modified sequence opt3 from anti-influenza_Chain
  source 1..360: mol_type = other RNA
caggtgcaactgcaggagagcggccccgggctcgtcaagccttccgaaaccctttctctgacatgcactgtttcaggaggtagtatcagcgcctaccactggtcctggattagacagccaccgggcaaagggttggagtggataggacatatcttcgactctggctcgacgtattacaacccctcattaaagagcagggtgaccattagtctggatgcttccaaaaatcagctatctctccggctgacaagcgtaactgcatccgacaccgccatctattactgtgcgcgccctcttggttcacgatattactatgggatggatgtgtggggacaaggcacaaccgtcactgtgagtagc

SEQ ID NO: 27848 - RNA, 360 nt, synthetic construct
  misc_feature 1..360: note = derived and/or modified sequence opt3 from anti-influenza_Chain
  source 1..360: mol_type = other RNA
gaggtgcagctggtcgaaagcggcgggggactcgttcaacccggtggctcccttagaatctcttgcgccgcttcagggttcaccgtgagtagcaactacatgtcctgggtaaggcaggcacctggaaagggcctggagtgggtgtctgtcatttattcgggtgggtcaacatactatgccgacagcgtgaaaggacggtttagtttctcccgcgataattctaagaacactgtgtttttgcagatgaatagcttacgagcggaagacacggctgtttactattgtgcccgttgcctgtccagaatgaggggctacggcctagatgtctgggggcagggaaccacagtgactgtatcaagt

SEQ ID NO: 27849 - RNA, 360 nt, synthetic construct
  misc_feature 1..360: note = derived and/or modified sequence opt3 from anti-influenza_Chain
  source 1..360: mol_type = other RNA
caggtgcaactgcaggagagcggccccgggctcgtcaagccttccgaaaccctttctctgacatgcactgtttcaggaagtagcatctccaactactattggtcttggattagacagtcgccaggtaaaggcttggagtggatagggttcatctactatggaggcaatacgaagtacaacccgtcattaaaaagcagggtgaccattagtcaggacacatccaagtctcaagtaagcctgactatgtcctcagtgaccgccgctgaaagtgcagtctatttttgtgcccgggcgagctgctctggtgggtactgtatcctagattattggggacagggcacactcgtgaccgtttcctca

SEQ ID NO: 27850 - RNA, 360 nt, synthetic construct
  misc_feature 1..360: note = derived and/or modified sequence opt3 from anti-influenza_Chain
  source 1..360: mol_type = other RNA
caggtgcaactgcagcagagcggcgccgaggtcaagaaacccgggtcctctgttaaggtgtcatgcaaagtaagtggagtgatcttcagcggttccgctatttcttgggtcagacaggcacctggccaagggctcgaatggatgggaggcatatcgccactttttggtaccacaaactacgcccagaagttccaggggagggtgactatcacggcggaccagtcaaccaatacaacttatatggaggttaacagcctgcggtacgaagataccgctgtgtatttttgtgcccgcggaccgaaatactatagtgagtacatggacgtctggggcaagggcacaaccgtgactgtatcctct

SEQ ID NO: 27851 - RNA, 360 nt, synthetic construct
  misc_feature 1..360: note = derived and/or modified sequence opt3 from anti-influenza_Chain
  source 1..360: mol_type = other RNA
caggtgcaactggtccagagcggcgccgaggttaagaaacccgggtcctctgtgaaggtatcatgcaaagctagtggaggtaccttcagctcctacgcaatctcttgggtgagacaggcccctggccaggggctcgaatggatgggaggcattatgggtatgtttgggacaactaactatgcgcaaaagttccagggaagggtcacgataaccgctgacgagtttacatcggccgcatacatggaacttcggtcactgcgcagcgaggatactgccgtgtattactgtgctcgaagttccggctattacccagaatatttccaggactggggccaggggaccttggttacagtgtctagc

SEQ ID NO: 27852 - RNA, 360 nt, synthetic construct
  misc_feature 1..360: note = derived and/or modified sequence opt3 from anti-influenza_Chain
  source 1..360: mol_type = other RNA
cagatgcaactggtgcagagcggcgccgaggtcaagaaacccgggtcctctgttaaggtgtcatgcaaagctagtggaggtaccttcagctcctacgcaatcacatgggtaagacaggcccctggccaggggctcgaatggatgggaggcattataggtatgtttgggtctactaactatgcgcaaaatttccagggaagggtgacgatcaccgctgacgagtcgacatcaactgcctacatggaacttagcagtctgcggtccgaggataccgcagtctattactgtgcccgctctacaggctattacccagcttatttgcaccattggggccaggggaccttagtgactgttagctcc

SEQ ID NO: 27853 - RNA, 360 nt, synthetic construct
  misc_feature 1..360: note = derived and/or modified sequence opt3 from anti-influenza_Chain
  source 1..360: mol_type = other RNA
gaggtgcagctggtcgaaagcggcgccgaggttaagaaacccgggtcctctgtgaaggtatcatgcaaagctagtggaggtaccttcagctcctacggcatctcttgggtgagacaagcacctgggcagggactcgaatggatgggcgacattataggtatgtttgggtcgacaaactatgcccagaatttccagggaaggcttactatcacggcggatgagtcaaccagcacagcttacatggaactgagttccttgcggtctgaggacactgccgtctattactgtgcacgcagctccggctattacccagcctatttaccgcactggggccaagggaccctggtgacagtttcaagt

SEQ ID NO: 27854 - RNA, 360 nt, synthetic construct
  misc_feature 1..360: note = derived and/or modified sequence opt3 from anti-influenza_Chain
  source 1..360: mol_type = other RNA
gaggtgcagctggtcgaaagcggcgccgaggttaagaaacccgggtcctctgtgaaggtatcatgcaaagctagtggaggtaccttcagctcctacgcaatctcttgggtgagacaagcccctggccaggggctcgaatggatgggaggcattataggtatgtttgggacagcgaactatgctcagaagttccagggaagggtcactatcacggccgacgagtttacctcgacagcatacatggaactttcaagcctgcggagtgaggatactgccgtgtattactgtgctcgcggcaattattactatgagtcctctttggactactggggccaagggaccttagttacagtgagctcc

SEQ ID NO: 27855 - RNA, 360 nt, synthetic construct
  misc_feature 1..360: note = derived and/or modified sequence opt3 from anti-influenza_Chain
  source 1..360: mol_type = other RNA
caggtgcaactggtccagagcggcgccgaggttaagaaacccgggtcctctgtgaaggtatcatgcaaagctagtggaggtcctttcagaaactttgcaatcaattgggtgaggcaggccccaggccaggggctcgaatggatgggaggcattatagcggtcttcggtaccacaaagtacgctcacaaatttcaagggcgggtgactatcacggccgacgatagcaccaacacagcatatatggagcttggatccctgaagtctgaagacactgccgtttactattgtgctcgcggcccgcattactattcgtcatacatggatgtgtggggcgaggggaccacagtcaccgtgagcagt

SEQ ID NO: 27856 - RNA, 360 nt, synthetic construct
  misc_feature 1..360: note = derived and/or modified sequence opt3 from anti-influenza_Chain
  source 1..360: mol_type = other RNA
gaggtggccctggtcgaaaccggcgctgaggttaagaaacccgggagctccgtgaaggtaccttgcaaatcttcaggaagtccattcagaagcaacgcagtgtcctgggtcaggcaggccccgggtcaaggcctcgaatgggttgggggaatccttggcgtgtttggttctccctcgtacgcgcagaagttccaggggcgggtgacaattactgctgacgagtcaacgaataccgtccacatggaactgcgcggattgcgaagcgaggatacagccgtgtattactgtgcacgtggccctacttattactatagttacatggacgtatggggcaaagggaccacagttaccgtgtcctct

SEQ ID NO: 27857 - RNA, 360 nt, synthetic construct
  misc_feature 1..360: note = derived and/or modified sequence opt3 from anti-influenza_Chain
  source 1..360: mol_type = other RNA
cagatgcaactggtgcagagcggcgccgaggtcaagaaacccgggtcctctgttaaggtgtcatgcaaagctagtggaggtaccttcagctcctacgcaatctcttgggtaagacaggcccctggccaggggctcgaatggatgggaggcatttttggtatgttcgggacagcgaactatgctcaaaagtttcagggaagggtgactataacggccgacgagttcacctcggcagcctacatggaactttcaagcctgggcagtgaggatacagctatgtattactgtgcacggtcctctggctattacccacagtattttcaggactgggggcaaggaactttggtcaccgtgagctcc

SEQ ID NO: 27858 - RNA, 360 nt, synthetic construct
  misc_feature 1..360: note = derived and/or modified sequence opt3 from anti-influenza_Chain
  source 1..360: mol_type = other RNA
caggtgcaactggtccagagcggcgccgaggttaagaaacccgggtcctctgtgaaggtatcatgcaaagctagtggagtgaccttcagctactatgcaatgtcctgggtcagacaggcccctggtcagggcctcgaatggatgggagggatctctccaatgtttggcacaactacgtacgcgcaaaagttccagggtagggtgaccattacagctgacgattcgacttcaaccgcctatatggaggttcggagccttcgcagtgaagacacagcagtgtactattgtgcccgatcctctaactactatgatagcgtctacgactactgggggcagggaaccctggtgactgtatcctca

SEQ ID NO: 27859 - RNA, 360 nt, synthetic construct
  misc_feature 1..360: note = derived and/or modified sequence opt3 from anti-influenza_Chain
  source 1..360: mol_type = other RNA
gaggtgcagctggtcgaaaccggcgccgaggttaagaaacccgggagctccgtgaaggtaccttgcaaatcttcaggaagtccattcagaagcaacgctgtgtcctgggtcaggcaagcaccgggtcagggcctcgaatgggttgggggaatccttggcgtgtttggttctccctcgtacgcccagaagttccaggggcgggtgacaattactgcggacgagtcaacgaataccgtccacatggaactgcgcggattgcgaagcgaggatacagctgtgtattactgtgcccgtggccctacttattactatagttacatggacgtatggggcaaagggaccacagttaccgtgtcctct

SEQ ID NO: 27860 - RNA, 360 nt, synthetic construct
  misc_feature 1..360: note = derived and/or modified sequence opt3 from anti-influenza_Chain
  source 1..360: mol_type = other RNA
caggtgcacctggtccaaagcggcgccgaggttagaaagcccggggcttccgtgaaagtatcttgcaaggtgtcaggatacaccctcaacgaacttagtatccattggctgaggcaggcacctggtcggggcttggagtggatggggagcttcgacccagaagatggagagacaatttatgcccagaaatttcagggccgcgtcactatgacgggtgacacctccacagatactgcgtacttagaactgacctctctacgatcggaggacacagctctctattactgtgcccgtgggtggggagcagtgacctcaccgttcgatttttggggccaaggcactctggttacagtgagcagt

SEQ ID NO: 27861 - RNA, 360 nt, synthetic construct
  misc_feature 1..360: note = derived and/or modified sequence opt3 from anti-influenza_Chain
  source 1..360: mol_type = other RNA
gaggtgcagctggtccaaagcggcgccgaagttaagaaacccgggtcctctatgaaggtgtcatgcaaagctagtggaagcatcttctccaactacggtatttcttgggtaagacaggcacctggccaggggctcgagtggatgggaggcataatcccaatttttggtgccgcgaattatgctcagaagttccaagggagggtgaccatcacagccgacgaatcgacttcaacggtctacatggaggtgcggagccttcgcagtgaagataccgcagtttattactgtgcccgacgtcagcagctgtataaaggatactatcaccattggggccagggcacattggtgactgtctcctct

SEQ ID NO: 27862 - RNA, 360 nt, synthetic construct
  misc_feature 1..360: note = derived and/or modified sequence opt3 from anti-influenza_Chain
  source 1..360: mol_type = other RNA
caggtgcaactggtccagagcggcgccggggttaagaaacccggatcctctatgaaggtgtcatgcaaagctagtggtagcatcttctccaactacggcatttcttgggtaagacaggcacctgggcagggactcgagtggatgggcggtataatcccaatttttggggccgcgaattatgctcaaaagttccagggaagggtgaccatcacagccgacgaatcgacttcaacggtctacatggaggtgcggagccttcgcagtgaagataccgcagtttattactgtgcccgacgtcagcagctgtataaaggctactatcaccattggggccaagggacattggtgactgtctcctct

SEQ ID NO: 27863 - RNA, 360 nt, synthetic construct
  misc_feature 1..360: note = derived and/or modified sequence opt3 from anti-influenza_Chain
  source 1..360: mol_type = other RNA
caggtgcaactgcaggagagcggccccgggctcgtcaagccttccgaaaccctttctctgacatgcactgtttcaggaggtttgatcggcacggggagttactattggggatggattagacagaccccaggcaaaggtatggagtggatagggagcatctcctactctggatcgacatattaccacccgtcattaaagagcagggtgactattagtgacgatacctccaaaaaccagctgttcctaaagctccggtctgtaacagccgctgacaccgcacaatattactgtgcccgctataattggggcatccgatactttgatttctggggccgtgggactctggtgacagtcagctcc

SEQ ID NO: 27864 - RNA, 360 nt, synthetic construct
  misc_feature 1..360: note = derived and/or modified sequence opt3 from anti-influenza_Chain
  source 1..360: mol_type = other RNA
caggtgcaactggtccagagcggcgccgaggttagaaagcccgggtcctctgtgaaagtatcatgcaaggtgagtggaggtatcattaggaaatacgctataaactgggtccggcaggcacctggccaggggctcgaatggatgggaggcatcattgccatcttcaataccgcgaactatgctcaaaagtttcagggtcgcgtgacaattactgccgacgagagcacgtccaccgtttacatggaactttcttcgctgcgatcagaggatacagcattgtattactgtgcccgtgggatgaattattacagcgactatttcgattactggggacagggcagtttagtgactgtctcccca

SEQ ID NO: 27865 - RNA, 360 nt, synthetic construct
  misc_feature 1..360: note = derived and/or modified sequence opt3 from anti-influenza_Chain
  source 1..360: mol_type = other RNA
caggtgcaactggtccagagcggcgggggagttgtgcagcccggtagatccctcaggctttcttgcgccgcttcaggcttcacctttcggagtcacgcaatgcattgggtacgccaggcccctgggaagggaccagagtgggtggcgctgatcagctacgacgaagtcaacaaattctatgctgattccgtgaagggccgatttacaatttctcgtgacgtttcgaaaaatactgtgttcttgcaaatgaactcattaagcgccgatgacacggcagtctactattgtgccagaggtcacagtgggtcctacaggctgtttgatttctggggacagggcaccctagtgacagtatctagc

SEQ ID NO: 27866 - RNA, 360 nt, synthetic construct
  misc_feature 1..360: note = derived and/or modified sequence opt3 from anti-influenza_Chain
  source 1..360: mol_type = other RNA
caggtgcaactggtcgagagcggcgggggactcgttcagcccggtggctcccttagactgtcttgcgccgcttcagggttcatctttggagacttcgcaattcactgggtgaggcaggccagtggcaagggtttggaatgggtagcgcggatacgcagcgggttaaaccgatttgagaccgcttacgccgcatccgtggaaggacgtctgacaatctctagagatgactcgaaatcaatggcctatctacagatgaataacgtcaaggctgaggatactgcagtgtacctctgtacgtatctggttggcgccgtgggcttccaacattgggggcagggaacccttgtcacagtgagcagt

SEQ ID NO: 27867 - RNA, 360 nt, synthetic construct
  misc_feature 1..360: note = derived and/or modified sequence opt3 from anti-influenza_Chain
  source 1..360: mol_type = other RNA
caggtgcaactggtcgagagcggcgggggagttgtgcagcccggtagatccctcaggctttcttgcgccgcttcaggcttcacctttagtagctacgggatctattgggtacggcaggcacctggaaagggcctggaatgggtggccttcatttcctacgacgagataaacaaattttatgcggattctgtcaagggtcgcttcacaatctcgcgagacaattcaaagaacactgtgtttttgcagatgaatagcttacgtgatgaagacacggctgtttactattgtgccaaaccactgagagggagttacaggtatttcgatctatggggacggggcaccgtggtcacagtgtcctct

SEQ ID NO: 27868 - RNA, 363 nt, synthetic construct
  misc_feature 1..363: note = derived and/or modified sequence opt3 from anti-influenza_Chain
  source 1..363: mol_type = other RNA
caggtgcaactgcaggagagcggccccgacctcgtcaagcctggggcctccgttatgatctcttgcaaggcttcaggatacagtttcacctattactatatgcactgggtgaaacagagccatggtaaaacacttgaatggattggcagaatatacccatataacggggatactaattacaacaggcggtttaaggacaaagcaatcctgacggtagatgagtcctcttcgaccgcctatatggaattgcgctcattaacaagcgaggacagtgcggtgtacttctgtgctcgagatgccaattacgaaggagactggtattttgatgtctggggccagggtactaccgtgacagtttcctct

SEQ ID NO: 27869 - RNA, 363 nt, synthetic construct
  misc_feature 1..363: note = derived and/or modified sequence opt3 from anti-influenza_Chain
  source 1..363: mol_type = other RNA
caggtgcaactggtccagagcggcgggggagttgtgcagcccggtagatccctcaggctttcttgcgccgcttcaggcttcacctttagtagctacgcaatgcactgggtacggcaggcccctgggaagggactggagtgggtggcgatcatttcctatgacggcaacgatcaatactatacagactctgtcaaaggtcgcttcactatatcgcgagattcaagcaaggtgtacttgcagatgcatcgtttaagaccagaagacacggctgtttattactgtgccaaagagtttgaaaccagtgggtatttccacggatcctttgattactggggccagggcatcctggtgacagtctctagc

SEQ ID NO: 27870 - RNA, 363 nt, synthetic construct
  misc_feature 1..363: note = derived and/or modified sequence opt3 from anti-influenza_Chain
  source 1..363: mol_type = other RNA
caggtgcaagtcgttcagagcggcgccgaggtgaagaaacccgggtcctctgtaagagtgtcatgccaggctagtggaggtaccttcatgaactacgcaatcatttgggtcaggcgggcccctggccaggggctggaatggatgggaggcataatcccagtgtttccgacacccaattatgcgcaaatgttccagggtcgcgttactattagcacggacgagtcccgatctacctcgtttctcgaacttacaaacctgcgttacgaggatactgctgtgtattactgtgccagaaggatctatcacgggggaaattcaggcttcgacttttggggccaggggaccttggtcacagtgagcagt

SEQ ID NO: 27871 - RNA, 363 nt, synthetic construct
  misc_feature 1..363: note = derived and/or modified sequence opt3 from anti-influenza_Chain
  source 1..363: mol_type = other RNA
caggtgcaactgcaggagagcggccccgggctccttaagccttccgacaccctggccttgacatgcactgtctctggaggttcaatcacgagtgattactggagctggattagacagccaccgggcagggggttagactggataggattcttttataacggcggttccaccaaatacaatccctctctgaagtcgcgggttacaatctcagctgatactagcaaaaaccagctaagtctcaagctgacctccgtgacagcagccgacaccggggtatattactgtgcgcgccacgatgctaaattctctggaagctattacgtggcctcctggggccaaggcactcgagtcacagtgtcaagt

SEQ ID NO: 27872 - RNA, 363 nt, synthetic construct
  misc_feature 1..363: note = derived and/or modified sequence opt3 from anti-influenza_Chain
  source 1..363: mol_type = other RNA
caggtgcaactgcaggagagcggccccgggctccttaagccttccgacaccctggccttgacatgcactgtctctggaggttcaatcacgagtgattactggagctggattagacagccaccgggcagggggttagactggataggattcttttataacggcggttccaccaaatacaatccctctctgaagtcgcgggttacaatctcagctgatactagcaaaaaccagctaagtctcaagctgacctccgtgacagcagccgacaccggggtatattactgtgcgcgccacgatgtgaaattctctggaagctattacgtcgcttcctggggccaaggcactcgagtgacagtttcaagt

SEQ ID NO: 27873 - RNA, 363 nt, synthetic construct
  misc_feature 1..363: note = derived and/or modified sequence opt3 from anti-influenza_Chain
  source 1..363: mol_type = other RNA
caggtgcaactgcaggagagcggccccgggctcgtcaagccttccgaaaccctttctgttacatgcaaagtgtcaggagacagtatcagctcctactcttggtcgtggattagacagccaccgggtaagggcctggagtgggtagggtatttgtactattcaggaagcactaaatacaaccccagtttaaagtccaggacgaccatatctgtggatacaagcactaatcagctgtccctaaaactctcattcgtcaccgccgctgacacagcagtgtatttttgtgcccggaccggcagtgaaagcactacaggttacgggatggatgtttggggacaaggcaccacggtgactgtctcttcc

SEQ ID NO: 27874 - RNA, 363 nt, synthetic construct
  misc_feature 1..363: note = derived and/or modified sequence opt3 from anti-influenza_Chain
  source 1..363: mol_type = other RNA
gaggtgcagctggtcgaaagcggcgccgaggttaagaaacccgggtcctctgtgaaggtatcatgcaaagctagtggaggtcctttcagaagctacgcaatctcctgggtgaggcaagccccaggccaggggccggaatggatgggaggcattatacccatctttggtaccacaaagtatgcgcctaaattccaggggcgggtcactattacggctgacgattttgccggaaccgtgtacatggagctctcttcgcttcgctcagaagacacagcaatgtattactgtgccaagcacatgggctatcaggttcgagagactatggatgtgtggggcaaggggaccacagtcaccgtgagcagt

SEQ ID NO: 27875 - RNA, 363 nt, synthetic construct
  misc_feature 1..363: note = derived and/or modified sequence opt3 from anti-influenza_Chain
  source 1..363: mol_type = other RNA
caggtgcaactggtccagagcggcgccgaggttaagaaacccgggtcctctgtgaaggtatcatgcaaagctagtggaggtcctttcagaagctacgcaatctcctgggtgaggcaggccccaggccaggggccggaatggatgggaggcattatacccatctttggtaccacaaagtatgcgcctaaattccaagggcgggtcactattacggctgacgattttgccggaaccgtgtacatggagctctcttcgcttcgctcagaagacacagcaatgtattactgtgccaagcacatgggctatcaggttcgagagactatggatgtgtggggcaaggggaccacagtcaccgtgagcagt

SEQ ID NO: 27876 - RNA, 363 nt, synthetic construct
  misc_feature 1..363: note = derived and/or modified sequence opt3 from anti-influenza_Chain
  source 1..363: mol_type = other RNA
gaggtgcagctggtcgaaaccggcgccgaggttaagaaacccggggctagcgtgaaggtatcctgcaaagcatctggatacacattcacttcatattacatgcactgggtgagacaagcccctggtcagggcctcgaatggatggggtggatcaacccaaatagtggaggcacgaactatgcgcagaagtttcagggtagggtcaccatgacacgggacactagcatttccaccgcttacatggagctttctcgcctgcgatcggatgacacagccgtgtattactgtgcacgtgaagggaaatggggaccgcaagccgctttcgatatatggggccagggcaccatggttactgtgtcaagc

SEQ ID NO: 27877 - RNA, 363 nt, synthetic construct
  misc_feature 1..363: note = derived and/or modified sequence opt3 from anti-influenza_Chain
  source 1..363: mol_type = other RNA
gaggtgcagctggtcgaaagcggcgccgaggttaagaaacccgggtcctctgtgaaggtatcatgcaaagctagtggaggtaccttcagcttttactccatgtcttgggtgagacaagcacctggccaggggctcgaatggatgggaggcatcattccaatgttcggtacaactaactatgcccagaagtttcaggggagggtcacgataaccgcggtggagtcgacatcaactgcttacatggaagttagcagtcttcggtccgaggacaccgccgtgtattactgtgcacgcggagataaaggcatctattactattacatggacgtctggggcaaggggacaaccgtgactgtatctagc

SEQ ID NO: 27878 - RNA, 363 nt, synthetic construct
  misc_feature 1..363: note = derived and/or modified sequence opt3 from anti-influenza_Chain
  source 1..363: mol_type = other RNA
gaggtgcagctggtcgaaaccggcgccgaggttaagaaacccgggagctccgtgaaggtatcttgcaaggcttcaggaggtacattcagaactcacgcaatcagttgggtgaggcaagcccctggccaggggctcgaatggatgggaggcattatagcgatctttggtacggctaactacgcccagaaattccaggggcggattaccatcacagcagacgagagcacttccaccgcctatatggaactttcttcgctgcgctcagaggatacagctgtctacttttgtgcacgaggaagcggctatcatattagtaccccattcgacaattggggccaagggactttggtgacagtttcctct

SEQ ID NO: 27879 - RNA, 363 nt, synthetic construct
  misc_feature 1..363: note = derived and/or modified sequence opt3 from anti-influenza_Chain
  source 1..363: mol_type = other RNA
gaggtgcagctggtccaaagcggcgccgaagttaagaaacccgggtcctctgtgaaggtatcatgcaaagctagtggaggtatcttcagaagcaactccatttcttgggtgaggcaggcacctggccaggggctcgagtggatgggaggcatatttgcccttttcggtaccacagactacgcgcagaagtttcaagggcgggtcactatcacggctgatgaatcgtcaaccacagtgtatctggagttgagcagtttaacttccgaagacaccgccgtttactattgtgcacgcggatctggctacacaacccgaaattatttcgattactggggccaggggactctggtgacagtcagctcc

SEQ ID NO: 27880 - RNA, 363 nt, synthetic construct
  misc_feature 1..363: note = derived and/or modified sequence opt3 from anti-influenza_Chain
  source 1..363: mol_type = other RNA
gaggtgcagctggtcgaaagcggcgccgaggttaagaaacccgggtcctctgtgaaggtatcatgcaaagctagtggaggtatcttcaacagctacgcaatttcctgggtgagacaagcccctggccaggggctcgaatggatgggaggcataatcgcgatttttcacaccccaaagtatgctcagaaattccagggtagggtcacaatcactgccgacgagtctacgaataccgcatacatggaacttcggtcgctgaagtcagaggatacagccttgtattactgtgctcgcgggagcacttatgactttagttccggattagattactggggccaaggcaccctggtgacagtttctagc

SEQ ID NO: 27881 - RNA, 363 nt, synthetic construct
  misc_feature 1..363: note = derived and/or modified sequence opt3 from anti-influenza_Chain
  source 1..363: mol_type = other RNA
caggtgcaactggtccagagcggcgccgaggttaagaaacccgggtcctctgtgaaggtatcatgcaaaagtagcggaggtaacttcaataactacgctgtgtcctgggtcagacaggcacctggccaggggctcgaatggatgggaggcatctctccaatttttggttcgaccaatcacgcccaaaagttccaggggagggtgacaatatcagcggacatctttactaacacggcttatatggagcttagcagtctgcggtccgatgacaccgccatttactattgtgcacgcggacgaggctactatttctaccatgccatggatgtttggggccaggggtctacagtgactgtcagctcc

SEQ ID NO: 27882 - RNA, 363 nt, synthetic construct
  misc_feature 1..363: note = derived and/or modified sequence opt3 from anti-influenza_Chain
  source 1..363: mol_type = other RNA
caggtgcaactggtccagagcggcgccgaggttaagaaacccgggtcctctgtgaaggtatcatgcaaagctagtggaggtaccttcaacaattacgcaatcaactgggtgagacaggcccctggccaggggctcgaatggatgggaggcattagcccaatatttggttccgtcaattatgcgcaaaaacttcaggggagggtgacaatcactgctgacgttttcacgtctaccgcctacatggagctgtcgtcattgcggagcgaagatacagcagtgtattactgtgccaagggaagtggctattactattactacggcttagacgtctgggggctgggaactaccgtgacagtatcctct

SEQ ID NO: 27883 - RNA, 363 nt, synthetic construct
  misc_feature 1..363: note = derived and/or modified sequence opt3 from anti-influenza_Chain
  source 1..363: mol_type = other RNA
caggtgcaactggtcgagagcggcgggggagttgtgcagcccggtagatccctcaggctttcttgcgccgcttcaggcttcacctttacaaattacgcaatgcactgggtacggcaggcccctgggaagggactggaatgggtggcggtcatcagtttcgacgaggataataaaagctatgctgactacgtgaagggccgctttactatttcccgagataactctaataaccgtttgtatttacagatgaactcgctgagagccgaagacacggcagtttactattgtgccaggggtccagagggggtgtggggacggtcaatagatagctggggccaaggcaccctagtcacagtgagttcc

SEQ ID NO: 27884 - RNA, 363 nt, synthetic construct
  misc_feature 1..363: note = derived and/or modified sequence opt3 from anti-influenza_Chain
  source 1..363: mol_type = other RNA
caggtgcaactggtccagagcggcggggacctcgttcagcccggaggttcccttagactgtcttgcgccgcttcaggcttcacctttagtaggtacagcatgaactgggtgcggcaggcacctgggatgggattggagtgggtagcctatatctccgatacatctcgcactatttactatgcggactcggtgaagggccgattcacgatatcacgtgataatgctaaaaacagcttatacctgcaaatgaagagtctaagagacgaagataccgccgtctattactgtgcaagggacccagatacaccgtttgtgcgggccttcgactcctggggtcaggggactctcgttaccgtgtctagc

SEQ ID NO: 27885 - RNA, 363 nt, synthetic construct
  misc_feature 1..363: note = derived and/or modified sequence opt3 from anti-influenza_Chain
  source 1..363: mol_type = other RNA
caggtgcaactggtcgagagcggcgggggactcgttcagcccggtggctcccttagactgtcttgcgtggcctcagggttcacctttagtaggttcagcatgaactgggtacggcaggctcctggaatgggcttggaatgggtgtcctacatctctgacacaggtcgcactatttattacgcagattcggtcaaggggcgatttacgatatcacgtgacaatgataagaacaccttatatctgcagatgaaaagcctaagagacgaggatagtgccttctactattgtgcgagggacccagatacaccgtttgtgcgggctttcgactcctggggacaaggcgttctcgtgactgtctctagc

SEQ ID NO: 27886 - RNA, 363 nt, synthetic construct
  misc_feature 1..363: note = derived and/or modified sequence opt3 from anti-influenza_Chain
  source 1..363: mol_type = other RNA
caggtgcaactgcaggagagcggccccgacctcgtcaagcctggggcctccgttaaaatgtcttgcaaggcttcaggatacagtttcacctattaccacatgcattgggtgaaacagacacacggtaagagccttgaatggatcggcagaatttatccatacaacgggggaactaattattcccagaggtttaaaggcaaggcagtattcacggtggatatgtcttcgtcaaccgcctacatggagctgcggagcttgacaagtgaagactccgcggtctattactgtgctcgcgatgccaactacgagggtgactggtattttgatgtgtgggggcaaggaactaccgttacagtgtctagc

SEQ ID NO: 27887 - RNA, 366 nt, synthetic construct
  misc_feature 1..366: note = derived and/or modified sequence opt3 from anti-influenza_Chain
  source 1..366: mol_type = other RNA
cagggccaactggtgcagagcggggccgaggtcaagaaatccggatcttcagttaaggtgagttgcaaaaccagcggtggcacattcaactcccacgctatctcttgggtaagacaggcacccgggcagggactcgaatggattggcggtataatccctatgtttgggactacgaattacgcccaaaaacttaagggaaggattgcgatcaccgctgaccagctgccaacaactgcctatttggagttatcgtcactgcggagcgaagataccgcagtgtactattgtgcccgcggccagcgatactattacgaccgtgatggcatggacgtctgggggcagggaacaatggtgaccgttagttcc

SEQ ID NO: 27888 - RNA, 366 nt, synthetic construct
  misc_feature 1..366: note = derived and/or modified sequence opt3 from anti-influenza_Chain
  source 1..366: mol_type = other RNA
caggtgcacctggtccaaagcggcgccgaggttaagaaacccgggtcctctgtgagactctcatgcagtgctagcggaggtcctttctccggctttgcaatctcttggcttaggcaggccccagggcagggactggaatggttgggcggtatttcggcggtattcgggaccgctacatacgcccagaagtttcaaggacgggtgactataacggcagaccagttcacctcaacaagccatatggatttaagtcgcctgacttatgacgataccgccgtctactattgtgctcgatccggcggctacctaccgcagaacaattggatcgacccctgggggcagggaacactcgtgattgtttctagc

SEQ ID NO: 27889 - RNA, 366 nt, synthetic construct
  misc_feature 1..366: note = derived and/or modified sequence opt3 from anti-influenza_Chain
  source 1..366: mol_type = other RNA
caggtgcaactggtccagagcggcgccgaggttaagaaagctgggtcctctgtgaaggtatcatgccagagtagcggagtgaccttctccatgtacgcagtctcttgggtgagacaggcccccggtcaaggcctcgaatggatgggagggatcattcctctttttggcacaactacgtatgcgcagaaattcgagggtaggctgaccataacagctgacacttcgaccaacatggcctacttggaattacggtcactgcgcagcgaggatacagcagtttatttttgtgcccgagctgggaccactgtgacacgtttcaattggtttgacccatggggacagggcaccctagtcacggtgagttcc

SEQ ID NO: 27890 - RNA, 366 nt, synthetic construct
  misc_feature 1..366: note = derived and/or modified sequence opt3 from anti-influenza_Chain
  source 1..366: mol_type = other RNA
caggtgcaactggtccagagcggcgccgaggttaagaaacccgggtcctctctcaaggtgtcatgcaaagctagtggagtaaccttcagcatgtacacaatctcctgggtgagacaggcacctggtcagggccttgaatggatgggagggattataccactgtttggcactgccaactatgagcaaaagttccagggtagggtcacgatcaccgcggacacatctactaataccgcttacatggaattgtcgtcattacggagcgaggatacagccgtgtattactgtgcacgcgccgggaccactctgacacgatttaactggttcgacccgtggggacagggcaccctagttacggtgagttcc

SEQ ID NO: 27891 - RNA, 366 nt, synthetic construct
  misc_feature 1..366: note = derived and/or modified sequence opt3 from anti-influenza_Chain
  source 1..366: mol_type = other RNA
atggccgacaacatgaccacaactcagatcgagtggagaatgaagaaaatggctattggcagctccacgcactcttcaagtgtgctgatgaaggatatacaaagccagttcgaacagctcaaacttaggtgggagtcctaccccaatctggtcaagtctaccgactatcatcagaaacgggaaacaatccgcttggcaactgaggaattatacctgctatcgaagcgaattgatgactcaatcctctttcacaagaccgttattgccaacagcagtatcatagcggatatgatcgtgtccctgtctcttctggagacattgtatgagatgaaagacgtagtggaagtctacagccgtcaatgcctc

SEQ ID NO: 27892 - RNA, 366 nt, synthetic construct
  misc_feature 1..366: note = derived and/or modified sequence opt3 from anti-influenza_Chain
  source 1..366: mol_type = other RNA
gaggtgcagctggtccaaagcggcgggggactcgttcagcccggtggctcccttagactggcctgcgtggtatctgggttcaccgtgacatcaaactacatcacttgggtcaggcaggctcctggaaaaggcttggaatgggtgagtgttatttatagccacggtcgggcatactattccgcctctgtgaatgggcgctttacgatatcgcgacatacctcaaagaacacagtctacttagagatgaatagcctgcgtccagaagacactgcggtgtattactgtgctggaggcggcctagtagggggatatgatgagtacttctttgactactggggtcagggcaccctcgccacagttagttcc

SEQ ID NO: 27893 - RNA, 366 nt, synthetic construct
  misc_feature 1..366: note = derived and/or modified sequence opt3 from anti-influenza_Chain
  source 1..366: mol_type = other RNA
caggtgcaactggtccagagcggcgccgaggttaagaaacccggggcttccgtgaaggtatcttgcaaagcatcaggatacaccttcacaggttattacatgcactgggtgagacaggcccctggccaggggctcgaatggatgggatggatcaacccaaatagtggcgacactaactatgcgcaaaagtttcagggtagggtcacgatgacccgggatacaagcattactaccgcttacatggagctttcctctctgcgctcggacgatacagccgtgtattactgtgcacgagactcaccgtatagcagttcctggtctttctttgattactgggggcagggacccttggttaccgtgagctcc

SEQ ID NO: 27894 - RNA, 366 nt, synthetic construct
  misc_feature 1..366: note = derived and/or modified sequence opt3 from anti-influenza_Chain
  source 1..366: mol_type = other RNA
gaggtgcagctggtcgaaagcggcgggggactcgttcaacccggtggctcccttagactgtcttgcgccgcttcagggttcatctttaggaattactggatgagttgggtgcggcaggcacctggaaagggcttggagtgggtagccaatattaaacaggacggtcgcgaaaagtattacgtggatagcttacgagggcgtgtcaacatatccagagacaatgcggagaactctctgtatctacacatgaactcgctcagggtggaagataccgctgtttacttctgtgcccgggcacgcatggtggtcgtgacaggagacggctttgatgtatggggccatgggactatggttacggtgtcaagc

SEQ ID NO: 27895 - RNA, 366 nt, synthetic construct
  misc_feature 1..366: note = derived and/or modified sequence opt3 from anti-influenza_Chain
  source 1..366: mol_type = other RNA
gaggtgcagctgctcgaaagcggcgggggacttgtccaacccggtggctccctgagattgtcttgcgccgcttcagggttcgcatttagtagctacggaatgtcctgggttaggcaggcccctggcaagggtttagagtgggtgtctgcgttctcggggtcaggaaccagcacatattacgctgacagtgtaaaaggccggtttactatctcccgcgataagtctaaaaacacgctgtatctacagatgaatagcctccgagccgaagacaccgcaatttactattgtgccaagccaccgggcccctacatagtggtcgctgggctgttcgagaactggggacgtggtacacttgtgactgtttcc

SEQ ID NO: 27896 - RNA, 366 nt, synthetic construct
  misc_feature 1..366: note = derived and/or modified sequence opt3 from anti-influenza_Chain
  source 1..366: mol_type = other RNA
gaggtgcagctggtcgaaagcggcgggggagttgtgcaacccggtagatccctcaggctttcttgcgccgcttcaggcttcagttttagcaactacgcaatgcactgggtacggcaggcccctgggaagggactggagtgggtggcgttgatctccttcgacggctctgataaatattacgctgactcggtcaagggtcgctttaccatgtcacgagataatagcaaaaacacattatatctgcagatgaatagtctacgtgccgaagacactgcagtgtactattgtgccagagatgagccatactgcgggggagactgtttcgcttttgatgtttggggccagggcacgatggtgaccgtctcc

SEQ ID NO: 27897 - RNA, 366 nt, synthetic construct
  misc_feature 1..366: note = derived and/or modified sequence opt3 from anti-influenza_Chain
  source 1..366: mol_type = other RNA
caggtgcaactgcagcagagcggccccgggctcgtcaagccttcccagaccctttctctgacatgcactgtttcaggaggtccagtgagtggcgggggatacagctggaactggatcagacaaaggccgggccagggtttggagtgggtagggttcatgtttcactccggatctccccggtataatcctacgttaaaatcgcgcattaccatatcagtggacacaagcaagaacctggtcagtctaaaactctcctctgtgactgccgctgataccgcagtttacttctgtgcccgagtgggccagatggacaagtattacgcgatggatgtctggggccaggggacaaccgtgactgtaagctcc

SEQ ID NO: 27898 - RNA, 366 nt, synthetic construct
  misc_feature 1..366: note = derived and/or modified sequence opt3 from anti-influenza_Chain
  source 1..366: mol_type = other RNA
caggtgcaactggtccagagcggcgggggactcgttaagcccggtggctcccttagactgtcttgcgccgcttcagggttcacctttagtagctactccatgaactgggtgaggcaggcacctggaaaaggcttggagtgggtatcttcgatctcaagcagttcctcttatatttactatgtggacagcgtcaagggtcggttcacaatatcccgcgataatgccaaaaactcattatacctgcagatgaatagtctacgagcggaagacactgctgtgtattactgtgcccgtgggggaggcagctatggcgcatacgaggggtttgattactggggacaaggtacgctcgttaccgtgtcttcc

SEQ ID NO: 27899 - RNA, 366 nt, synthetic construct
  misc_feature 1..366: note = derived and/or modified sequence opt3 from anti-influenza_Chain
  source 1..366: mol_type = other RNA
caggtgcaactggtccagagcggcgggggagttgtgcagcccggtagatccctcaggctttcttgcgccgcttcaggcttcaattttagtagctacgggatgcactgggtacggcaggcacctggaaagggcctggagtggttgtccgtgatctggtctggtgggtcgaataaatattacgccgactcagtcaagggacgcttcaccattagccgagatgacagtaaaaacacagtgtatttacaaatgaactccctgcgtgatgaagacactgcggtttactattgtgctagagcccatacggcactaaccaggtttcggtggctcgatccatggggccagggcatactggtgacagtctctagc

SEQ ID NO: 27900 - RNA, 366 nt, synthetic construct
  misc_feature 1..366: note = derived and/or modified sequence opt3 from anti-influenza_Chain
  source 1..366: mol_type = other RNA
caggtgcaactggtccagagcggcgggggagttgtgcagagaggtaggtccctccggctttcttgcgccgcttcaggcttcacctttcgcacatacgggatgcactgggtacgacaggcacccggaaagggcctggagtgtgtggccttgatcagttatgacggtactaacaaatactatgcggatagcgtcaaggggcgtttcacgatttccagagacaattctaaagataccttatacctgcaaatgaactcgctaagggctgaagacacaggagtgtattactgcgcctcactcgattatgactttagctactactatcatcgggatgtttggggccctggcactaccgtgacagtcagttcc

SEQ ID NO: 27901 - RNA, 366 nt, synthetic construct
  misc_feature 1..366: note = derived and/or modified sequence opt3 from anti-influenza_Chain
  source 1..366: mol_type = other RNA
caggtgcaactggtcgagagcggcgggggactcgttcagcccggtggctcccttagactgtcttgcgccgcttcagggttcacctttagtgactactggatggtgtgggtaaggcaggcacctggaaagggcttggtgtgggtcagccggatctcctctgatggttcgacaacttcatatgccgacagcgtgaaagggccattcacgattagtcgcgataacgcgaagaataccttatacctgcagatgaactccctacgagctgaagacacagccgtttattactgtgcacgtgtggccactccgtattactatgagtctggatttgattactggggccaaggcgctctcgtcaccgtgagctcc

SEQ ID NO: 27902 - RNA, 369 nt, synthetic construct
  misc_feature 1..369: note = derived and/or modified sequence opt3 from anti-influenza_Chain
  source 1..369: mol_type = other RNA
cagttccaactggtgcagagcggccccgaggtcaagaaacctgggacctccgttaaggtgtcttgcaaagcctcaggatacacaagtactacgtatggtatcagctgggtaagacaggtgccaggccaggggctcgaatggatgggatggattaacccgtacaatggcaacccccactatggtcaaaagtttcaggggagggtcacccttacacgggacacttccaccaatacagcttacctggagatattgtctttacgctcggatgacaccgcagtgtattactgtgcccgagatggatggggccagcagctggttccttattacttcgactactggggccaagggactctagtgacagtctcaagc

SEQ ID NO: 27903 - RNA, 369 nt, synthetic construct
  misc_feature 1..369: note = derived and/or modified sequence opt3 from anti-influenza_Chain
  source 1..369: mol_type = other RNA
caggtgcaactggcccagagcggcgctgaggtcaagagacccgggtcctctgttaaagtgtcatgcaccgcaagtggaggtatcttcaggaagaacgccattagctgggtacggcaggcgcctggccaggggctcgaatggatgggaggcataatcgctgtgtttaatacagccaactacgcacaaaaattccagggtcgcgtcaagattactgccgacgagtccgggaatacggcttatatggaactttcttcgctgcgatcagatgacaccgcagtgtactattgtgccagccacccaaaatacttttatggaagtggctcctacccggatttctggggccaggggacattggttactgtgtctagc

SEQ ID NO: 27904 - RNA, 369 nt, synthetic construct
  misc_feature 1..369: note = derived and/or modified sequence opt3 from anti-influenza_Chain
  source 1..369: mol_type = other RNA
caggtgcaactgcaggagagcggccccgggctcgtcaagccttccgaaaccctttctctgacatgcactgtttcaagaggaagtatcggtcactacttctggagctggattaggcagccaccgggcaaagggttggagtggataggatatatctcctactctggctcgacgaagtataacccctcattacggagccgcgtgaccattagtgtagacacatccaaaaatcagttttctctgaacctaaatagcgtgactgccaccgatacagctctctactattgtgcacgagaagactacgatatcctgaccggtgccgggcctggaatggaggtctggggccaaggcactacagtgaccgtttcctca

SEQ ID NO: 27905 - RNA, 369 nt, synthetic construct
  misc_feature 1..369: note = derived and/or modified sequence opt3 from anti-influenza_Chain
  source 1..369: mol_type = other RNA
caggtgcaactgcaggagagcggccccgggctcgtcaagccttccgaaaccctttctctgacatgcactgtttcaggagccagtatcaacagccactactggtcctggattagacagccaccgggtaaaggcttggagtggatagggtatgtgtactattctggatcgacgacctacaatccctcattaaagagcagggtaacactgagtgtggacacttccaaaaaccagttctctctaaatctcagctccgtcaccgctgcagatacagccttttattactgtgcgcggcatccttatgacgtgctgaccggctcaggtgattggttcgacccatgggggcaaggaactcttgttacagtgagtagc

SEQ ID NO: 27906 - RNA, 369 nt, synthetic construct
  misc_feature 1..369: note = derived and/or modified sequence opt3 from anti-influenza_Chain
  source 1..369: mol_type = other RNA
caggtgcaactggtccagagcggcgccgaggttaagagacccgggtcctctgtgaaagtatcatgcaccgctagtggaggtatcttcaggaagaacgcaattagctgggtgcggcaggcccctggccaggggctcgaatggatgggaggcataatcgcggtctttaatacagctaactacgcccaaaaattccagaatcgcgtgaagattactgcagacgagtccggtaacacggcctatatggaactttcttcgctgacctcagatgacacagctgtttactattgtgcaagccacccaaaatacttttatgggagtggatcctacccggatttctggggccagggcactttggtgaccgtctctagc

SEQ ID NO: 27907 - RNA, 369 nt, synthetic construct
  misc_feature 1..369: note = derived and/or modified sequence opt3 from anti-influenza_Chain
  source 1..369: mol_type = other RNA
gaggtgcagctggtcgaaagcggcgccgaggttaagaaacccgggtcctctgtgaaggtatcatgcaaagctagtggaggtaccttcagaagctacgcagtgtcctgggtcaggcaagcccctggccaggggctcgaatggatgggaggcatcattgcgatatttggtacaactaactatgctcagaagttccaggaccgggtgacgatcaccgccgatgaccttccatctacagcatacatggagctgacttcgttgcgctcagaagataccgccgtttatttttgtgtgcgagggcgtggatactatttaggcggcgactacgggagcctggatagttggggacaaggtaccctagtcacagtgtcc

SEQ ID NO: 27908 - RNA, 369 nt, synthetic construct
  misc_feature 1..369: note = derived and/or modified sequence opt3 from anti-influenza_Chain
  source 1..369: mol_type = other RNA
gaggtgcagctggtcgaaagcggcgggggactcgttcaacccggtagatcccttaggctgtcttgcgtgggctcagggttcaactttgacggatacgccatgcagtgggtacgccaggtgcctggcaagggtttggagtgggtcagtgggatcagctggcactccgattctaccggatatgctgactcggtgcggggccgattcacaatttcacgtgataatgccaaaaacagcttatacctgcagatggacagtctaagaccagaagatactgcattttattactgtggcaagtccatagggcatgttggaggttcttataggcacccgatcgactactggggccaagggacgctcgtgaccgtcagc

SEQ ID NO: 27909 - RNA, 369 nt, synthetic construct
  misc_feature 1..369: note = derived and/or modified sequence opt3 from anti-influenza_Chain
  source 1..369: mol_type = other RNA
caggtgcaactgcaggccagcggccccgggctcgtcaagccttccgagaccctttctctgacatgcactgtttcaggagacagtatcacgagcggtgcttactattggacctggattagacagcacccaggcaaagggttggaatggataggatacatctattactccggcaacacatattacaatccgtctttaaagtcgagggtgactatttcactggataccagcaaaaaccagttcagtctaaaggtaaattccgtgacagcagccgacaccgcggtctattactgtgctcgggccgcatctactagcgtgctcggttacgggatggatgtttggggacaaggcacaaccgtgacggtctcctca

SEQ ID NO: 27910 - RNA, 369 nt, synthetic construct
  misc_feature 1..369: note = derived and/or modified sequence opt3 from anti-influenza_Chain
  source 1..369: mol_type = other RNA
caggtgcaactggtccagagcggcgccgaggttaagaaacccgggtcctctgtgagagtatcatgcaaggctagtggaagcatcttcaggaactacgcaatgtcctgggtgcggcaggcccctggtcagggcctcgaatggatgggagggattatagcgatctttggcaccccaaaatatgctcaaaagttccagggtcgcgtcacaattactgccgacgagtctacgtcgaccgtgtacatggaactttcagggctgcgaagcgaggatacagcaatgtattactgtgcccgtatcccgcactataattttggaagtggctcctacttcgactattggggccaggggactttggttaccgtgtctagc

SEQ ID NO: 27911 - RNA, 369 nt, synthetic construct
  misc_feature 1..369: note = derived and/or modified sequence opt3 from anti-influenza_Chain
  source 1..369: mol_type = other RNA
cagctgcaactccaggagagcggccccagacttgtgaagccttccgaaaccctgtctttgacatgctcagtcagtggggttagcatctcctcttcgaactactattggggatggattaggcagccaccgggtaaaggcttagagtggatagggactatctaccactcaggaagcacgtattacaatcccagtctgaagtcccggctaattatctctgtggacaccagcaaaaaccagttctatctccaactgacatcccttactgccgctgattcagcagtatactattgtgccaccggcggtgggtttggatggagtcagacatacttcggctactggggccaggggaccctggtgactgcgagctct

SEQ ID NO: 27912 - RNA, 369 nt, synthetic construct
  misc_feature 1..369: note = derived and/or modified sequence opt3 from anti-influenza_Chain
  source 1..369: mol_type = other RNA
gaggtgcagctgcaacagagcggccccgaactcgtcaagcctggggcctccgttaaaatgtcttgcaaggcttcaggatacaccttcacaagttttatcatgtattgggtgaaacagaagccaggtcagggccttgagtggctggggtacattgacccgtataacgatggaactaaatacaatgaaaagttcgagggcaaggcaacgttgaccagcgacaaatcctcttcgacagcctatatggaattatcaagcctgaccagtgaggattccgcggtatactattgtgctaagagaggtaactacgggaatggatttgcctactggggccaaggcactctagtgacagtctctgcagccaaaaccagc

SEQ ID NO: 27913 - RNA, 369 nt, synthetic construct
  misc_feature 1..369: note = derived and/or modified sequence opt3 from anti-influenza_Chain
  source 1..369: mol_type = other RNA
caggtgcaactgctcgagagcggcggggacgtcgttcagcccggaacctcccttagactgtcttgcgccgcttcaggtttcagtttgtggacaagcggcatgcactgggtgaggcaggcacctgggaagggattagaatgggtagccgtgatgtcctacgatgagactaaaaagtattacgcggactctgtccggggccgcttttcgatctcacgagataacagccgtaatacgctgtatctacagatgaacagtctcagagtggaagacaccgctgtttacttctgtgccaaaccaaggctggattatcttgactactttcatgcagccgattcctggggtcaagggacactggtgtctgtcagctcc

SEQ ID NO: 27914 - RNA, 369 nt, synthetic construct
  misc_feature 1..369: note = derived and/or modified sequence opt3 from anti-influenza_Chain
  source 1..369: mol_type = other RNA
caggtgcaactggtcgagagcggcgccgaagttagaaagcccggggagtccctcaggatctcttgcaaagctcacggagactcattcaccagttactggattggttgggtgcggcagcttcctggcaaggggctggaatggatggcagtaatatatccacgcgatagcgagacaaaattttccccggccttccatggacaggtgtctatctcggtcgacaagtcaactagcacggtgcacttgcagtggaacagtttaaaagcgtccgataccgctgtttactattgtgcccgatctcccggctacagcggttatctgtacgggtggtttgacccttggggacaaggcacaccagtgactgtctcctca

SEQ ID NO: 27915 - RNA, 369 nt, synthetic construct
  misc_feature 1..369: note = derived and/or modified sequence opt3 from anti-influenza_Chain
  source 1..369: mol_type = other RNA
caggtgcaactggtcgagagcggccccgggctcgttaagccttccgaaaccctttctctgacatgcactgtgtcaggagacagtgtaatcaacagcgcctactattgggattggattagacagccaccgggtaaaggcttggagtgggtggggtccgtctactattctggaataacgtactataatccctcgttaaagtcaagggtgaccatcagcgttgacacaagtaaaaaccagttctccctgcggctatcttacgtgactgctgcagataccgccctctattactgtgcgcgccgaggcggtgggtggcagtactattacggaatggacgtctggggccaaggcacaaccgtgactgtaagctcc

SEQ ID NO: 27916 - RNA, 369 nt, synthetic construct
  misc_feature 1..369: note = derived and/or modified sequence opt3 from anti-influenza_Chain
  source 1..369: mol_type = other RNA
caggtgcaactggtccagagcggcgccgaggttaagaaacccggggcttccgtgaaggtatcttgcaaagcatcaggatacatcttcaccggttattacattcactgggtgagacaggcccctggccaggggctcgaatggatgggaaggatagacccaaacggcagtggtacaacttatgcgcaaaagtttcaggggcgggtcacgcttaccatggatacaagcatcactaccgcttacatggagctgtcccgcttgcgattcgacgatacagccatttattactgtgcacgttgggactggaattttgatttatatctgggatggttcgacccgtggggccagggcacccccgtgactgttgcctct

SEQ ID NO: 27917 - RNA, 369 nt, synthetic construct
  misc_feature 1..369: note = derived and/or modified sequence opt3 from anti-influenza_Chain
  source 1..369: mol_type = other RNA
gaggtgcagctggtccaaagcggcgccgaagttaagaaacccggggcttccgtgaaggtatcttgcaaagcatcaggatacatcttcaccggttattacattcactgggtgagacaggcccctggccaggggctcgagtggatgggaaggatagacccaaacggcgcgggtacaacttatgctcagaagtttcaagggcgggtcacgcttaccatggatacaagtatcactaccgcctacatggaactgagccgcttgcgattcgacgatacagcaatttattactgtgcccgttgggactggaattttgatttatatctgggatggttcgacccgtggggccagggcacccccgtgactgttgcttcc

SEQ ID NO: 27918 - RNA, 369 nt, synthetic construct
  misc_feature 1..369: note = derived and/or modified sequence opt3 from anti-influenza_Chain
  source 1..369: mol_type = other RNA
caggtgcaactggtccagagcggcgccgaggttaagaaacccggggcttccgtgaaggtatcttgcaaagcatcaggatacaccttcaacgcccaccatatgcactgggtgagacaggcgcctggtcagggcctcgggtggatgggatggatcgacccaaataacgatggcacaatttatgctcaaaagtttcagggtagggtcactcttacgatggacaccagtatacatacagcctacatggaactgagcgggttgcggtatgatgacactgcaatctactattgtgtgcgctgggcctggaatttcgactttttcttaggatggtttgatccgtggggccagggcaccctggttacagtggcttcc

SEQ ID NO: 27919 - RNA, 369 nt, synthetic construct
  misc_feature 1..369: note = derived and/or modified sequence opt3 from anti-influenza_Chain
  source 1..369: mol_type = other RNA
gaggtgcagctggtccaaagcggcgccgaagttaagaaacccggggagtccctcaagatctcttgcaaagtgtcaggatacagtttcaccagccagtggattggttgggtaagacagatgcctggcaaggggcttgaatggataggaatgatgtatccaggcgactccgatacaatctactctccgtcgtttcagggtcaagtgactatttcagctgacaacagcatcagtacggcatatctgcagtggtcctctttgaaagccagcgataccgcgatttactattgtgcttccgggcccggatactcaggctatcactacggctggttcgacacatgggggcagggaactttagtcaccgtgagtagc

SEQ ID NO: 27920 - RNA, 369 nt, synthetic construct
  misc_feature 1..369: note = derived and/or modified sequence opt3 from anti-influenza_Chain
  source 1..369: mol_type = other RNA
gaggtgcagctggtccaaagcggcgccgaagttaagaaacccggggagtccctcaagatctcttgcaaagtgtcaggatacagtttcaccagccagtggattggttgggtaagacagatgcctggcaaggggcttgaatggataggaatgatgtatccaggcgacgctgatgcaatctactccccgtcttttcagggtcaagtgacaatttcggccgacaactcaatcagcactgcgtatctgcagtggagttccttgaaagcctctgatacggctatttactattgtgcaagcgggcccggatactccggctatcactacggctggttcgacacctgggggcagggaacattagtcactgtgtcaagt

SEQ ID NO: 27921 - RNA, 369 nt, synthetic construct
  misc_feature 1..369: note = derived and/or modified sequence opt3 from anti-influenza_Chain
  source 1..369: mol_type = other RNA
gaggtgcagctggtccaaagcggcgccgaagttaagaaacccggggagtccctcaagatctcttgcaaagtgtcaggatacagtttcaccagccagtggattggttgggtaagacagatgcctggcaaggggcttgaatggataggaatgatgtatccaggcgagtccgaaacaatctactctccgtcgtttcagggtcaagtgactatttcagctgacaacagcatcagtacggcatatctgcagtggtcctctttgaaagccagcgataccgcgatttactattgtgcttccgggcccggatactcaggctatcactacggctggttcgacacatgggggcagggaactttagtcaccgtgagtagc

SEQ ID NO: 27922 - RNA, 369 nt, synthetic construct
  misc_feature 1..369: note = derived and/or modified sequence opt3 from anti-influenza_Chain
  source 1..369: mol_type = other RNA
gaggtgcagctggtccaaagcggcgccgaagttaagaaacccggggagtccctcaagatctcttgcaaagtgtcaggatacagtttcaccagccagtggattggttgggtaagacagatgcctggcaaggggcttgaatggataggaatgatgtatccaggcgacgctgatacaatctactccccgtcttttcagggtcaagtgactatttcggcagacaactcaatcagcacggcctatctgcagtggagttccttgaaagcgtctgataccgctatttactattgtgccagcgggcccggatactccggctatcactacggctggttcgacacatgggggcagggaactttagtcaccgtgtcaagt

SEQ ID NO: 27923 - RNA, 369 nt, synthetic construct
  misc_feature 1..369: note = derived and/or modified sequence opt3 from anti-influenza_Chain
  source 1..369: mol_type = other RNA
gaggtgcagctggtccaaagcggcgccgaagttaagaaacccggggagtccctcaagatctcttgcaaagtgtcaggatacagtttcaccagccagtggattggttgggtaagacagatgcctggcaaggggcttgaatggataggaatgatgtatccaggctcctctgacacaatctactcgccgtcatttcagggtcaagtgactattagcgctgataacagtatctccacggcatatctgcagtggtctagcttgaaagcctccgacaccgcgatttactattgtgcttcagggcccggatacagtggctatcactacggctggttcgatacatgggggcagggaactttagtcaccgtgagctct

SEQ ID NO: 27924 - RNA, 369 nt, synthetic construct
  misc_feature 1..369: note = derived and/or modified sequence opt3 from anti-influenza_Chain
  source 1..369: mol_type = other RNA
gaggtgcagctggtccaaagcggcgccgaagttaagaaacccggggagtccctcaagatctcttgcaaagtgtcaggatacagtttcaccagccagtggattggttgggtaagacagatgcctggcaaggggcttgaatggataggaatgatgtatccaggcgactccgatgctatctactctccgtcgtttcagggtcaagtgacaatttcagcagacaacagcatcagtactgcctatctgcagtggtcctctttgaaagcgagcgatacggctatttactattgtgcctccgggcccggatactcaggctatcactacggctggttcgacacctgggggcagggaacattagtcactgtgagtagc

SEQ ID NO: 27925 - RNA, 369 nt, synthetic construct
  misc_feature 1..369: note = derived and/or modified sequence opt3 from anti-influenza_Chain
  source 1..369: mol_type = other RNA
gaggtgcagctggtccaaagcggcgccgaagttaagaaacccggggagtccctcaagatctcttgcaaagtgtcaggatacagtttcaccagccagtggattggttgggtaagacagatgcctggcaaggggcttgaatggataggaatgatgtatccaggcgacacagatactatctactccccgtcttttcagggtcaagtgacgatttcggctgacaactcaatcagcaccgcatatctgcagtggagttccttgaaagcctctgatacagcgatttactattgtgctagcgggcccggatactccggctatcactacggctggttcgacacttgggggcagggaaccttagtcacagtgtcaagt

SEQ ID NO: 27926 - RNA, 369 nt, synthetic construct
  misc_feature 1..369: note = derived and/or modified sequence opt3 from anti-influenza_Chain
  source 1..369: mol_type = other RNA
gaggtgcagctggtccaaagcggcgccgaagttaagaaacccggggagtccctcaagatctcttgcaaagtgtcaggatacagtttcaccagccagtggattggttgggtaagacagatgcctggcaaggggcttgaatggataggaatgatgtatccaggcgagtccgacacaatctactctccgtcgtttcagggtcaagtgactatttcagctgataacagcatcagtacggcatatctgcagtggtcctctttgaaagccagcgacaccgcgatttactattgtgcttccgggcccggatactcaggctatcactacggctggttcgatacatgggggcagggaactttagtcaccgtgagtagc

SEQ ID NO: 27927 - RNA, 372 nt, synthetic construct
  misc_feature 1..372: note = derived and/or modified sequence opt3 from anti-influenza_Chain
  source 1..372: mol_type = other RNA
caggtgcaactggtccagagcggcgccgaggttaagaaacccgggtcctctgtgaaggtatcatgcaaagctagtggaggtatcttcattagccaggcaatatcctgggtgagacaggcccctggccaagggctcgaatggatgggaggcatcattccaatgtttggtgcgaccaactacgctcagaagttccaggggagggtcacaatcactgccgacaaatctacgaataccgtgtatatggagctttcgtcactgacaagcgaagatactgcagtttactattgtgcccggttgggaagtggctcctaccacaacggcccgaattggtttgacccctgggggcagggaaccttagtgacagtctctagc

SEQ ID NO: 27928 - RNA, 372 nt, synthetic construct
  misc_feature 1..372: note = derived and/or modified sequence opt3 from anti-influenza_Chain
  source 1..372: mol_type = other RNA
caggtgcaactgcaggagagcggccccgggctcgtcaagccttccgaaaccctttctctgaactgcgccgtttcaggaggtagtatcagcaattactattggtcctggattagacagccaccgggcaaagggttggagtggataggatacatctcttataacggcaggcccaagtacaatccttcgttaacatcacgggtgactattagcgtagacacgagtaaagatcagttctccctggaactacgctctgtgaccgctgcagacacagccctctattactgtgcgcgagagactcgttttggtgaactgcttagcccatatgatgctttcgagatctgggggcaaggaaccatggtcacagtgtcctca

SEQ ID NO: 27929 - RNA, 372 nt, synthetic construct
  misc_feature 1..372: note = derived and/or modified sequence opt3 from anti-influenza_Chain
  source 1..372: mol_type = other RNA
caggtgcaactgcaggagagcggccccgggctcgtcaagccttccgaaaccctttctctgacatgcactgtttcaggaggtagtgtgagctccgagacgtactattggtcttggatcagacagccaccgggcaaagggttggaatggattggatacatatattacatcggcaacaccgactataggccctcgttaaagtcacgggtaacaattagcctggataccagtaaaaatcagttctccctaaagctctctagcgtgactgccgctgacacagcagtctactattgtgcccgcggtgcgtactacgattcctcagggtatcctgctttttacatctggggacaaggcaccatggtgactgttagtagc

SEQ ID NO: 27930 - RNA, 372 nt, synthetic construct
  misc_feature 1..372: note = derived and/or modified sequence opt3 from anti-influenza_Chain
  source 1..372: mol_type = other RNA
caggtgcaactgcaggagagcggccccgggctcgtcaagccttccgaaaccctttctctgacatgcgccgtttcaggagtgagtatcagcaacattgacttctactggggttggataagacagccaccgggcaaagggttggagtggatcggaaatatttattacactggcatcacgttttataacccctccttatcttcgagggtagctatttcaatcgataccagcaagaatcagttcagtctgacactaacttccgtgaccgcagccgacacagcgatgtactattgtgctcggcactacggtgattctgaagccataaacgacgcatttgatatctgggggcaaggaaccatgctcactgtcagctcc

SEQ ID NO: 27931 - RNA, 372 nt, synthetic construct
  misc_feature 1..372: note = derived and/or modified sequence opt3 from anti-influenza_Chain
  source 1..372: mol_type = other RNA
caggtgcaactggtcgagagcggcgccgaagttaagaaattcggggcttccgtgaaggtatcttgcaaagcatcaggatacaccctcatcgactattacatgcactgggtgagagtcgcccccggtcagggccttgagtggatggggtggattaaccctataaatggaggcacaaactatgcgcagaagtttcagggtagggtgactatgacgcgggataccagtatcaatacagcttacatggacctgagctccttgcgctctgatgacactgccatgtattactgtacccgagggcgtccaattggaagaaactgggaaccgagggataaagactattggggccaaggcacacccgttaccgtgtcgtca

SEQ ID NO: 27932 - RNA, 372 nt, synthetic construct
  misc_feature 1..372: note = derived and/or modified sequence opt3 from anti-influenza_Chain
  source 1..372: mol_type = other RNA
caggtgcaactggtccagagcggcgccgaggttaagaaacccgggtcctctgtgaccgtatcatgcaagacaagtggacacactttcatcagctacgctatttcctggctcagacaggcacctggtcagggccttgaatggatgggagggatagtgccaatctttggcacggtcaactatacccaaaaattccagggtaggctgacaattactgccgacgagtctacctcgacagcgtacatggatttgtcacggttaacctttgaagacactgctatctatttctgtgcccgcgaggcagggtaccatagcagtttttccggagtgtatttcgattactggggccagggcacactgctaaccgtttctagc

SEQ ID NO: 27933 - RNA, 372 nt, synthetic construct
  misc_feature 1..372: note = derived and/or modified sequence opt3 from anti-influenza_Chain
  source 1..372: mol_type = other RNA
gaggtgcagctgcaacagagcggccccgaactcgtcaagcctggggcctccgttaaaatctcttgcaaggcttcaggatacaccttcacagactataacatgcactgggtgaaacagagtcttggtaagagcctggagtggattggctacatatatccaaataacgggggaactggctacaatcagaaatttgaatccaaggcaacgttgaccgtagataactcttcgtcaacagcctatatggagttaagaactctgaccagcgaagacagtgcggtgtactattgtgtcaggtccggtgcttactacttcaattatctagtgccgtactttgattattgggggcaaggaacaaccctcactgtttctagc

SEQ ID NO: 27934 - RNA, 372 nt, synthetic construct
  misc_feature 1..372: note = derived and/or modified sequence opt3 from anti-influenza_Chain
  source 1..372: mol_type = other RNA
gaggtgcagctgcaacagagcggccccgaactcgtcaagcctggggcctccgttaaaatctcttgcaaggcttcaggatacaccttcacaggttataacatgcactgggtgaaacagagtcatggcaagagccttgagtggattgggaaaatatacccaaataacggagtaactggctataatcaggaatttagatccaaggcaacgctgaccgtggacaactcttcgtcaacagcctacatggagttgaggagcttaaccagtgaagattccgcgatctatttctgtgtccggtctggtgcttactatgtgaattacctggttccgtactttgactattgggggcaaggaactacactaaccgtgagctcc

SEQ ID NO: 27935 - RNA, 375 nt, synthetic construct
  misc_feature 1..375: note = derived and/or modified sequence opt3 from anti-influenza_Chain
  source 1..375: mol_type = other RNA
caggtgcaactggtccagagcggcgccgaggttaagaaacccgggtcctctgtgaaggtatcatgcaaagctagtggagtgaccagctccaactaccctatcacatgggtcagacaggcaccaggtcagggcctcgaatggatgggaggggtgcttccgctgttcggcgttactaattatgcccaaaagtttcagggtagggtgacgatttctgcggacaaatcgaccaacacagcttacatggagttgagctcattacggagtgaagatactgccgtctattactgtgcacgcgggaagcgacccggatattgctccggcggcgtgtgttctagcgactactgggggcagggaaccctggtaacagtttcctca

SEQ ID NO: 27936 - RNA, 375 nt, synthetic construct
  misc_feature 1..375: note = derived and/or modified sequence opt3 from anti-influenza_Chain
  source 1..375: mol_type = other RNA
caggtgcaactgcaggagagcggccccgggctcgtcaagccttcccagaccctttctctgacatgcactgtttcaggaggtagtatcagctccggcacgtactattggtcttggattagacaccatccagggaaaggattggaatggataggctacatctatcactcgggttcagcctactataacccgagcttagagagtagggtgaccatgtccgtagacacatctaagaatcagttcagcctgaaactatcctcagtgactgctgcagataccgccatttactattgtgcgcgggctgaaaacctcctgagtccctaccttgccgaggggtttgacccttggggacaaggcacactggtcaccgtgagctct

SEQ ID NO: 27937 - RNA, 375 nt, synthetic construct
  misc_feature 1..375: note = derived and/or modified sequence opt3 from anti-influenza_Chain
  source 1..375: mol_type = other RNA
gaggtgcagctggtccaaagcggcgccgaagttaagaaacccggggagtccctcaagatctcttgccaggcttcaggatacagtttcaccagcagatggattggttgggtgaggcagatgcctggcaaagggcttgaatgggtaggatttatatatccatccgactctgatgtgcggtactcgccgtcattccgcggccaggtcacaatcagcgcagacaagagtatttccactgcctatctgcaatggtctagcttgaaagcgtccgatacggctatgtacttttgtgcccgattaggtgggaacaaggactatggagattacctgtggtatttcgacctatggggccgtggcgcactcgtgaccgtttcaagt

SEQ ID NO: 27938 - RNA, 375 nt, synthetic construct
  misc_feature 1..375: note = derived and/or modified sequence opt3 from anti-influenza_Chain
  source 1..375: mol_type = other RNA
caggtgcaactggtcgagagcggcgggggagttgtgcagcccggtagatccctcaggctttcttgcgccgcttcaggcttcacctttagtagctacgggatgcactgggtacggcaggcacctggaaagggcctggaatgggtggccgtcatctggtatgacggtgataataaatactatggggactccgtgaagggacgcttcacaatttctcgagataattcgaaaaacactttgtttttacagatgaactcactgcgtgcggaggacacggctgtttactattgtgccaaggataccgcagaccatggcgattacgtggacctaggcttctttgatgcctgggggcaaggaacactcgtcactgtgagcagt

SEQ ID NO: 27939 - RNA, 375 nt, synthetic construct
  misc_feature 1..375: note = derived and/or modified sequence opt3 from anti-influenza_Chain
  source 1..375: mol_type = other RNA
gaggtgcagctggtccaaagcggcgccgaactcaagatgcccggggagtcccttaaaatctcttgcaaggcttcaggatacaccttcacaaactattggattggttgggttagacagactcctggcaaagggctggaatggatgggaataatctttccaccggacagtcagacgagctactccccctctttccagggccaagtgaccttttcggtagataattcaattagcgtggcatatatccagtggagttccttgaaggcctctgacacagcgatttactattgtgctaggagcggtatcttcgattggtccgcccctttagtcgaggcatttgacatatgggggcagggaactgtggttaccgtgtcaagt

SEQ ID NO: 27940 - RNA, 375 nt, synthetic construct
  misc_feature 1..375: note = derived and/or modified sequence opt3 from anti-influenza_Chain
  source 1..375: mol_type = other RNA
gaggtgcagctggtccaaagcggcgccgaagttaagaaacccggggagtccctcaagatctcttgcaaaggatcaggttacagtttcagcgactattggattggctgggtgagacagatgcctggggaaggacttgagtggatgggcataatctacccagcttcctctgaaattaggtattcgccgtcatttcagggtctggtaaccatcagcgcagataagagtattaacacagcctccttgcagtggtctagcttaaaagcgtccgacactgctatctactattgtgcccggcacgcatcatgcagtgcccgcagctgttactgggggcccgtggattattggggacaaggcacgctggtcaccgtgtcttcc

SEQ ID NO: 27941 - RNA, 375 nt, synthetic construct
  misc_feature 1..375: note = derived and/or modified sequence opt3 from anti-influenza_Chain
  source 1..375: mol_type = other RNA
caggtgcaactggtcgagagcggcgggggagttgtgcagcccggtagatccctcaggctttcttgcgccgcttcagaaatcaccttcattacatacgcaatgcactgggtacggcaggcccctggcaaggggctggagtgggtggcgttgataagtgacgatggaagcaataaattttatgctgactccgtcaagggccgcttcactatctctcgagataattcgaaaaacacgttatacctgcagatgaactcactacgtgccgaagacaccgcagcctattactgtgctagagagggtgtgtattttgatagcgggacatacaggggatatttcgactactggggccaagaaactctcgttaccgtgagttcc

SEQ ID NO: 27942 - RNA, 375 nt, synthetic construct
  misc_feature 1..375: note = derived and/or modified sequence opt3 from anti-influenza_Chain
  source 1..375: mol_type = other RNA
caggtgcaactgcaggagagcggccccgggctcgtcaagccttcccagaccctttctctgacatgcactgtttcaggaggtagtatcagctccggcaactactattggaattgggtgagacagcacccagggaaaggattggaatggattggctacatatattacaggggttctacgttctataacccgtcgttaaagtcacgggtaaccatcagcattgacacaagtaaaaatcaattttccctgcgcctatctagcgtgactgccgctgataccgcagtctactattgtgccaaggacacacgatcctcactcgataactaccagtacgggatggacgtgtggggacagggcaccactgttacagtgagtagc

SEQ ID NO: 27943 - RNA, 375 nt, synthetic construct
  misc_feature 1..375: note = derived and/or modified sequence opt3 from anti-influenza_Chain
  source 1..375: mol_type = other RNA
gaggtgcagctgctcgaaagcggcgggggacttgtccaacccggtggctccctgagattgtcttgcgccgcttcagggttcagttttagcacctacgcaatgtcctgggttaggcaggcccctggaaagggcttagagtgggtgtctggtatctcggggtcaggagaaagcacatattacgcggacagtgtaaaaggccggttcactgtgtcccgcgataactctaagaatacgctgtatctacagatgaacagcctccgagctgaggacaccgccgtctactattgtgcaaaacagggcgatcacattgcctggctgcttcgtgggataaattttgactactggggacaaggtgtgctggttacagtgtcctca

SEQ ID NO: 27944 - RNA, 375 nt, synthetic construct
  misc_feature 1..375: note = derived and/or modified sequence opt3 from anti-influenza_Chain
  source 1..375: mol_type = other RNA
caggtgcaactggtcgagagcggcgggggagttgtgcagcccggtagatccctcaggctttcttgcgccgcttcaggcttcgcatttcacaatcgggccatgcattgggtacgccaggcgcctgggaagggactggaatgggtggctttgatctacttcgacggcagtaaacagtattacgccgatagcgtcaagggtcgatttaccatttcccgtgacaattctaaaaacacagtgttcttacaaatgaactcgctgagaccagaggatactgcagtttattactgtgccgtgccggggcccatatttggaatcttccctccatggtcatattttgaccactggggccagggcattctagtcacggtgagcagt

SEQ ID NO: 27945 - RNA, 375 nt, synthetic construct
  misc_feature 1..375: note = derived and/or modified sequence opt3 from anti-influenza_Chain
  source 1..375: mol_type = other RNA
gaggtgcagctggtcgaaagcggcgggggagttgtgcaacccggtagatccctcaggctttcttgcgccgcttcaggcttcgcatttcacaatcgggccatgcattgggtacgccaggcgcctgggaagggactggagtgggtggctttgatctacttcgacggcagtaaacagtattacgccgatagcgtcaagggtcgatttaccatttcccgtgacaattctaaaaacacagtgttcttacagatgaactcgctgagaccagaagatactgcagtttattactgtgccgtgccggggcccatatttggaatcttccctccatggtcatattttgaccactggggccaaggcattctagtcacggtgagcagt

SEQ ID NO: 27946 - RNA, 375 nt, synthetic construct
  misc_feature 1..375: note = derived and/or modified sequence opt3 from anti-influenza_Chain
  source 1..375: mol_type = other RNA
gaggtgcagctggtccaaagcggcgggggagttgtgcagcccggtaaatccctcagactttcttgcgccgcttcaggcctgaccttcagtagctacgcagtacactgggtgaggcaggcccctgggaaaggattggaatgggtcacattaatctcctatgacggcgcgaaccagtactatgctgattctgtgaagggtcggtttactatttcgcgcgacaattcaaagaacacggtttacctgcaaatgaatagcctacgaccagaggataccgccgtgtattactgtgcagtcccggggcccgtgttcggaatatttcctccatggagttatttcgacaactggggccagggcatcctcgtaacagtttcctct

SEQ ID NO: 27947 - RNA, 375 nt, synthetic construct
  misc_feature 1..375: note = derived and/or modified sequence opt3 from anti-influenza_Chain
  source 1..375: mol_type = other RNA
caggtgcaactggtcgagagcggcgggggagttgtgcagcccggtaaatccctcagactttcttgcgccgcttcaggcctgaccttcagtagctacgcagtacactgggtgaggcaggcccctgggaaaggattggaatgggtcacattaatctcctatgacggcgcgaaccagtactatgctgattctgtgaagggtcggtttactatttcgcgcgacaattcaaagaacacggtttacctgcaaatgaatagcctacgaccagaggataccgccgtgtattactgtgcagtcccggggcccgtgttcggaatatttcctccatggagttatttcgacaactggggccagggcatcctcgtaacagtttcctct

SEQ ID NO: 27948 - RNA, 375 nt, synthetic construct
  misc_feature 1..375: note = derived and/or modified sequence opt3 from anti-influenza_Chain
  source 1..375: mol_type = other RNA
caggtgcaactggtcgagagcggcgggggagttgtgcagcccggtaaatcccctagactctcttgcgccgcttcaggcccaaccttcagtagctacgcagtacactgggtgaggcaggccccggggaaaggacttgaatgggtcacactgatctcctatgacggcgcgaaccagtactatgctgattctgtgaagggtcggtttactatttcgcgcgacaattcaaagaacacggtttacttgcaaatgaatagcttacgacccgaggataccgccgtgtattactgtgcagtccctgggccagtgttcggaatatttcccccttggagttatttcgacaactggggccagggcatcctggtaacagtttcctct

SEQ ID NO: 27949 - RNA, 375 nt, synthetic construct
  misc_feature 1..375: note = derived and/or modified sequence opt3 from anti-influenza_Chain
  source 1..375: mol_type = other RNA
gaggtgcagctggtcgaaagcggcgggggagttgtgcaacccggtaaatccctcagactttcttgcgccgcttcaggcctgaccttcagtagctacgcagtacactgggtgaggcaggcccctgggaaaggattggagtgggtcacattaatctcctatgacggcgcgaaccagtactatgctgattctgtgaagggtcggtttactatttcgcgcgacaattcaaagaacacggtttacctgcagatgaatagcctacgaccagaagataccgccgtgtattactgtgcagtcccggggcccgtgttcggaatatttcctccatggagttatttcgacaactggggccaaggcatcctcgtaacagtttcctct

SEQ ID NO: 27950 - RNA, 375 nt, synthetic construct
  misc_feature 1..375: note = derived and/or modified sequence opt3 from anti-influenza_Chain
  source 1..375: mol_type = other RNA
caggtgcaactggtccagagcggcgccgagctcaagagacccggggcttccgttaaagtgtcttgcaagacctcaggatacagtttcaacaattatggtatcaactgggtaaggcaggcacctggccaggggcttgaatggatgggatggattagcgcctacacaggcaatactcactatgcgaaaaactttgagggtcgggtgacgctgaccacagacacttccacctctacagcttacatggaagtccgctcgttgcgatcagatgacagcgccgtgtatttctgtgcacgtgccatgatacaaggggttgtgaccttatacctgagaccaggagattattggggccagggcactctagtcacagtgagttcc

SEQ ID NO: 27951 - RNA, 375 nt, synthetic construct
  misc_feature 1..375: note = derived and/or modified sequence opt3 from anti-influenza_Chain
  source 1..375: mol_type = other RNA
caggtgcaactggtccagagcggcgccgaggttaagcagcccggggcttccgtgaaagtatcttgcaaggcatcaggatacaccttcaacgcctattacatccactgggtgagacaggcgcctggtcaaggcctcgaatggatggggtggattaatccaaactttggaggcacacattatgctaggaaattccagggtcgggtcactatgacgcgcgacgccagtataaataccgcatacatggagcttgatcgactgatcagcgacgatacagccgtgtattactgtgttcgttggagagctgcagccgtgattatggaccagttttataagatggatgtctgggggcagggaactttggtgaccgtatcctct

SEQ ID NO: 27952 - RNA, 375 nt, synthetic construct
  misc_feature 1..375: note = derived and/or modified sequence opt3 from anti-influenza_Chain
  source 1..375: mol_type = other RNA
caggtgcaactggtccagagcggccccgagctcaagaaacctgggtcctctgttaaactttcatgcatggccaccggaggtacattcatcaactacgcttttagttgggtgagacaggcaccaggccaggggctggaatggttgggaggcattataccggtatatggtactagcaatcacgtggagaagttacaagggagggtcacgatcaccgccgacgcgtccacaaacactgcttacatggaactgtctggactacggttcgatgacaccgccgtgtatttttgtgcagcctcgacagctacctcaggcacttactatgcaatgcgccccttcgatttttggggccaggggacactcgttagcgtgagttcc

SEQ ID NO: 27953 - RNA, 378 nt, synthetic construct
  misc_feature 1..378: note = derived and/or modified sequence opt3 from anti-influenza_Chain
  source 1..378: mol_type = other RNA
gaggtgcagctggtcgaaagcggcgggggagttgtgcaacccggtggctccctcagactttcttgcatcgcctcagctttcaacctggggatttttggaatgcactgggtaaggcaggcacctggcaagggtttggagtgggtggccttcatacggtacgacgggggaaaaaccttttatgcggatagtgtcaagggccgcttcacaatcagccgagacaattccaaaaacactttatacctgcagatgaactctctacgtacggaagataccgctctctattactgtgccagagacgcaacagccgattattacggcccagggtcgtatccgaattggctggacccctggggacagggtactcttgtgaccgtttca

SEQ ID NO: 27954 - RNA, 378 nt, synthetic construct
  misc_feature 1..378: note = derived and/or modified sequence opt3 from anti-influenza_Chain
  source 1..378: mol_type = other RNA
gaggtgcagctggtcgaaagcggccccgccctcgttaagcctacccaaacacttactctgacgtgctccttctctgggttttcattgagtaccagcggaatgtccgtgtcttggatcagacagccaccgggtaaggctttagagtggctggcactaattgactgggatgacgatacatactatataacttactcgtcaagcctcaaaaccaggctgacaatcagtaaagacacctccaagtctcaggtagtgcttactatgacaaacatggatcccgtcgacaccgccacgtattactgtgcgcggactctgcgcgtgagcggcgattatgttcgagacttcgatttgtgggggcgtggaaccctcgtgacagtctcc

SEQ ID NO: 27955 - RNA, 378 nt, synthetic construct
  misc_feature 1..378: note = derived and/or modified sequence opt3 from anti-influenza_Chain
  source 1..378: mol_type = other RNA
caggtgcaactgcaggagagcggccccgggctcgtcaagccttccgaaaccctttctctgacatgcactgtttcaggaggtagtatcaacagctactattggaattggattagacagccaccgggcaaagggttggagtggataggatacatctatcactccggctctacgaactacaatccctcgttaaagtcaagggtgaccattagcgtagacacaagtaaaaaccagttctccctgcaactatctagcgtgactgccgctgataccgcagtctattactgtgcccggctccgcacagactatggtgatcctgactccgtgtactactatgggatggatgtttggggacagggcaccactgtgacagtctcaagt

SEQ ID NO: 27956 - RNA, 378 nt, synthetic construct
  misc_feature 1..378: note = derived and/or modified sequence opt3 from anti-influenza_Chain
  source 1..378: mol_type = other RNA
caggtgcacctggtccaaagcggcgccgaggttagaaagcccggggactccgtgaaagtatcttgcaagacctcaggatacacattcagtacttatcctgtggcttgggtcaggcaagtgccaggtcagggcctcgaatggatggggtggatcagcacgtacaacggaaataccaactttgcacagaatttccagggccgggttacacttactaccgatacaaccactaacacagcctatatggaggtgcgctccctgaaatttgacgataccgcggtctactattgtgctcgagtggaaggttcttaccgtgacttctggaataaccagaatagatttgatccgtgggggcagggaacgttggtaactgtttcgtca

SEQ ID NO: 27957 - RNA, 378 nt, synthetic construct
  misc_feature 1..378: note = derived and/or modified sequence opt3 from anti-influenza_Chain
  source 1..378: mol_type = other RNA
gaggtgcagctggtcgaaagcggcgccgaggttaagaaacccggggcttccgtgaaggtatcttgcaaagcatcaggatacaccttcacaagttttgacatcaactgggtgagacaagcccctggtcagggcctcgaatggatggggtggatgactccaacgagcggaaagaccggctatgcgcagaaattccagggtaggattacaatgactcggaatacctccataaacacagcttacatggagctttcttcgctgcgctcagaagataccgccgtctatttttgtgcacgagggccggagcgtagaactacaatcttcgacgtgattttggattggtttgacccctggggacaaggcaccttagttacggtgagc

SEQ ID NO: 27958 - RNA, 378 nt, synthetic construct
  misc_feature 1..378: note = derived and/or modified sequence opt3 from anti-influenza_Chain
  source 1..378: mol_type = other RNA
caggtgcaactggtccagagcggcgccgaggttaagaaacccgggtcctctgtgaaggtatcatgcaaagctagtggaggtttctttagctcctacgcaatctcttgggtgagacaggcccctggccaggggctcgaatggatgggaggcgtcattccaatattcaggaccgcgaactatgctcaaaattttcagggtcgggtgacaatcactgccgacgagttcacgtcgtacatggaactttcaagcctgcgcagtgatgacaccgcagtttattactgtgcccgattgaactatcacgattccgggacatactataatgctccgcgtggatggtttgacccctggggccagggcactttagtgaccgtctctagc

SEQ ID NO: 27959 - RNA, 378 nt, synthetic construct
  misc_feature 1..378: note = derived and/or modified sequence opt3 from anti-influenza_Chain
  source 1..378: mol_type = other RNA
caggtgcaactggtccagagcggcgccgaggttaagaaacccgggtcctctgtgaaggtatcatgcaaagctagtggaggtgcattcagcaactacgccatctcctgggtgagacaggcgcctggccaggggctcgaatggatgggaggcattataccaatctttggtaccacaaattatgctcaaaagttccaggggagggtcactattacggccgacaaatttaccacaatcgcatacatggagcttcggtctctgcgctcggaagatactgccgtgtattactgtgctcgacacggaggcgtttattactatggctcagcaagcagtgggtggttcgacccgtggggacagggtaccttggtgacagtctcctct

SEQ ID NO: 27960 - RNA, 378 nt, synthetic construct
  misc_feature 1..378: note = derived and/or modified sequence opt3 from anti-influenza_Chain
  source 1..378: mol_type = other RNA
caggtgcaactgctcgagagcggcgggggagtcgttagacccggtaggtcccttcggctggcctgcgctggctctgggttcaccttttcagcatacgccatgcactgggtgcgccaggcgcctggaaagggcttggaatgggtagctcatacaagttatgacggtcgagatagctactatgtggactccgtcaaagggcgtttcactatctctagagatgactcgaagaacacgttatacctgcagatgaactcactaaggccagaggataccgccgtgtattactgtgcaaaagttggaccgtatacaggctacgacgattacaattattacggcatggacgtgtgggggcacggaactaccgtcacagtgagcagt

SEQ ID NO: 27961 - RNA, 378 nt, synthetic construct
  misc_feature 1..378: note = derived and/or modified sequence opt3 from anti-influenza_Chain
  source 1..378: mol_type = other RNA
caggtgcaactggtcgagagcggcgggggagttgtgcagcccggtggctccctcagactttcttgcgccgcttcagggttcaactttgacgaatacgtaatgtattgggtgaggcagagtcctggaaagggcctggagtgggtcagcttgatcggtgcagatgggcggggaacctacaattccgactctgtgaaaggccgcttcacaatttcgcgagataaccgtaaaaattcattatatctgcagatgaacagcctaagaagtgacgatactgccctctactattgtgcgaaggttgaaaggtccttttacgacggctctgggtatggagatgctctggagatatggggtcaaggcacgatggtgaccgtcagctcc

SEQ ID NO: 27962 - RNA, 381 nt, synthetic construct
  misc_feature 1..381: note = derived and/or modified sequence opt3 from anti-influenza_Chain
  source 1..381: mol_type = other RNA
gaggtgcagctgctcgaaagcggcgggggacttgtccaccccggtggctccctgagattgtcttgcgccgcttcagggttcacctttagtaactacgcaatgagctgggttaggcaagcccctggaaagggcttagagtgggtgtcctctatcaattcgggtgggggagcgacatattacgctgactcagtaaaaggccggttcactattagccgcgataacagtaagaatacgctgtccctacagatgaactctctccgagccgaagacaccgcagtgtattactgtgccaaagagggcgggaatacaatatttggactggtcactatggcttattacttcgatagctggggtcagggcacccttgtgacagtttcctca

SEQ ID NO: 27963 - RNA, 381 nt, synthetic construct
  misc_feature 1..381: note = derived and/or modified sequence opt3 from anti-influenza_Chain
  source 1..381: mol_type = other RNA
cagccccaactgcaggagagcggccctgggctcgtgagaccatccgaaaccctttctctgacatgcactgtctcaggagacagtgttacgaggggtggcttctactgggggtggatccggcagccgcccggaaagggcttggagtggattggtagcatatattacaactataatatctaccactccccttctttaaaatcgcgcgtgtcactgagcgtagataccagtaagaaccaggtgtccctaaaactcgcctctgtcacagctgcagacactgccgtgtattactgtgcgcgacattatccatactacgatctgcccaccgggttttatagccaattcgacttttggggacagggcacacctgttaccgtgtcctca

SEQ ID NO: 27964 - RNA, 381 nt, synthetic construct
  misc_feature 1..381: note = derived and/or modified sequence opt3 from anti-influenza_Chain
  source 1..381: mol_type = other RNA
tggtggcagctggtgcaaagcggcgccgaggtcaagaaacccgggtcctctgttaaggtgtcatgcaaagctagtggaggtaccttcagctcctacgacatctcttgggtaagacaggcacctggccaggggctcgaatggatgggaggcattataccaatctatggtacagccaactacgcgcagaagtttcaagggagggtgactattacggctgatgagtcgacctcaacagcctatatggaacttagcagtctgcggtccgaggacactgcagtctactattgtgcccgcgctggaggcgattctagcggctactatggggcattgggacgattctttcagcactggggtcagggcaccttagtgacagtttcctca

SEQ ID NO: 27965 - RNA, 381 nt, synthetic construct
  misc_feature 1..381: note = derived and/or modified sequence opt3 from anti-influenza_Chain
  source 1..381: mol_type = other RNA
gaggtgcagctggtccaaagcggcggggccgttgtgcagcccggaagatccctcaggctttcttgcgctgcatcaggtttcacctttagtatctacgccatgcactgggtacggcagacacctggcaaggggctggaatgggtggcgttgattagctatgacggaaacaataaatactatgctgattccgtcaagggccgcttcactatatctcgagacaactacaaaaatacgttatatctgcagatgaagggtctacgtgccgaggataccgcactctactattgtgccagaaggatcacagaaaaagggtactacaacgactcgggacggccaaattggtttgatccgtggggccaaggcactctggtgaccgtttca

SEQ ID NO: 27966 - RNA, 381 nt, synthetic construct
  misc_feature 1..381: note = derived and/or modified sequence opt3 from anti-influenza_Chain
  source 1..381: mol_type = other RNA
caggtgcaactgcagcagagcggccccagactcgtcaagccttcccagaccctttctctgacatgcgccatctcaggggacagtgttagcggagattccggtacttggaactggattaggcaatctccatcgcggggcttggagtggttagggcgcacgtactatcgatcaaaatggtacaatgactatgctgaaagcgtgaagagtcgtatagtaatcaaagcagatacctccaagaacgagttctctctgcagctaaatagcgtgacaccggaagacactgccatttactattgtgcgagagctggagtcaaaatctttggcctcattgtgggtgccctggataactgggggaggggaacccttgttacagtgtcctca

SEQ ID NO: 27967 - RNA, 381 nt, synthetic construct
  misc_feature 1..381: note = derived and/or modified sequence opt3 from anti-influenza_Chain
  source 1..381: mol_type = other RNA
caggtgcaactgcagcagtggggcgccgggctccttaagcccagcgagaccctgtccttgacatgcactgtctctggaggttcattaacggactacagttggaactggatcagacagcctccaggcaaagggctggaatggattggagataccctacacaatggctatacaaactacaatccgagcctcaggggtcgggtttccatatctatcgacacttcgaagaaccaagtgtcactgcgccttaccagcgtaacagctgcagataccgccctgtattactgtgcgcgagggagtggaggctatggcgggttcgactactttggaaaattgcgtacttgggatttctggggtcagggcacactcgtgaccgtctcctct

SEQ ID NO: 27968 - RNA, 381 nt, synthetic construct
  misc_feature 1..381: note = derived and/or modified sequence opt3 from anti-influenza_Chain
  source 1..381: mol_type = other RNA
caggtgcaactggtccagagcggcgccgaggttagaaagcccggggaatccctcaggatctcttgccggggatcaggttacaacttccctaaatattggattggctgggtgcgccagatgccagggaagggacttgagtggatgggcatgatatacccgggtgacagtgatgtacgatataatcccagctttcaggggcaagtgaccatctccgctgacgaatctattaacacagcatacctgcagtggtcgtcattgcgtactagcgatacggccagatattactgtgcgaggcacttaggacagcagctggtcagtaatacctattactactatggcatggacgtgtggggccaagggacaactgttaccgtgtcctct

SEQ ID NO: 27969 - RNA, 384 nt, synthetic construct
  misc_feature 1..384: note = derived and/or modified sequence opt3 from anti-influenza_Chain
  source 1..384: mol_type = other RNA
cagatccaactgcaggagagcggccccgggctcgtgaagccttcccagaccctttctctgacatgcgccatttcaggagacagtgtcagctccaacaatgctgtttggaactggataagacagtctccatcgaggggtttggaatggttaggccggacttactatcgctcaaaatggtacaatgattatgcagagagcgtgaagagtcgaatcacggtaaacccggacacctccaaaaatcaattctctctgcacctaaagagcgtgacacccgaagatactgccgtcttttactgtgtgcgttccgggcatattaccgttttcggagtgaacgtcgacgcgtttgatatgtggggccagggtacaatggtgaccgtatcaagt

SEQ ID NO: 27970 - RNA, 384 nt, synthetic construct
  misc_feature 1..384: note = derived and/or modified sequence opt3 from anti-influenza_Chain
  source 1..384: mol_type = other RNA
caggtgcaactgcaggagagcggccccgggctcgtcaagccttcccagaccctttctctgacatgcgccatctcaggagacagtgttagctccaacaatgctgtgtggaactggattagacagtctccatcgaggggtttggaatggttaggccggacttactatcgctcaaaatggtacaatgattatgcagagagcgtaaagagtcgaataacggtgaacccggacacctccaaaaatcaattctctctgcacctaaagagcgtcacacccgaagatactgccgtgttttactgtgttcgttccgggcatatcaccgtgttcggagtcaacgtggacgcgtttgatatgtggggccagggtacaatggtaaccgtttcaagt

SEQ ID NO: 27971 - RNA, 384 nt, synthetic construct
  misc_feature 1..384: note = derived and/or modified sequence opt3 from anti-influenza_Chain
  source 1..384: mol_type = other RNA
caggtgcaactgcagcagagcggccccgggctcgtcaagccttcccagaccctttctctgacatgcgccatctcaggagacagagttagtagcaactccgctgtgtggaattggattaggcaatctccatcgcggggtttggagtggttaggccgcacttactatcgatcaaaatggtactatgattacgcagaaagcgtaaagagtcgtatagtgatcgacccggatacgtccaaaaaccaggtctctctgcagctaaatagcgtgacccccgaggactccgccatttattactgtgcgagagggggacacatcacagttttcggcctcaacattgatgcttatgacatctggggtcagggggccaaggtgactgtctcaagt

SEQ ID NO: 27972 - RNA, 384 nt, synthetic construct
  misc_feature 1..384: note = derived and/or modified sequence opt3 from anti-influenza_Chain
  source 1..384: mol_type = other RNA
caggtgcaactgcagcagagcggccccgggctcgtcaagccttcccagaccctttctctgacatgcgccatctcaggagacagagttagtagcaactccgctgtgtggaattggattaggcaatctccatcgcggggtttggagtggttaggccgcacttactatcgatcaaaatggtactatgattacgcagaaagcgtaaagagtcgtatagtgatcgacccggatacgtccaaaaaccaggtctctctgcagctaaatagcgtgacccccgaggactccgccatttattactgtgcgagagggggacacatcacagttttcggcctcaacattgatgcttatgacatctggggtcagggggccatggtgactgtctcaagt

SEQ ID NO: 27973 - RNA, 384 nt, synthetic construct
  misc_feature 1..384: note = derived and/or modified sequence opt3 from anti-influenza_Chain
  source 1..384: mol_type = other RNA
caggtgcaactgcagcagagcggccccgggctcgtcaagccttcccagaccctttctctgacatgcgccatctcaggagacagagttagtagcaactccgctgtgtggaattggattaggcaatctccatcgcggggtttggaatggttaggccgcacttactatcgatcaaaatggtactatgattacgcagaaagcgtaaagagtcgtatagtgatcgacccggatacgtccaaaaaccaggtctctctgcagctaaatagcgtgacccccgaggactccgccatttattactgtgcgagagggggacacatcacagagttcggcctcaacattgatgcttatgacatctggggtcagggggccatggttactgtgtcaagt

SEQ ID NO: 27974 - RNA, 384 nt, synthetic construct
  misc_feature 1..384: note = derived and/or modified sequence opt3 from anti-influenza_Chain
  source 1..384: mol_type = other RNA
caggtgcaactgcagcagagcggccccgggctcgtcaagccttcccagaccctttctctgacatgcgttatctcaggagacactgtgagtagcaacagagccacgtggaattggatgaggcaatccccattgcggggtttagagtggctgggccgcacctactatcgatctaaatggtacaacgattatgctgtatcggtgaagtcacgtgtcgtgattaatccggacacaagcaaaaaccaggttagtctacagctcaatactgtgacccccgatgactccggggtctacttctgtgcaagaggaggccacataacagtgtttggtgtaaacatcgatgccttcgacatttgggggctgggaaccaaggttactgtgtctagc

SEQ ID NO: 27975 - RNA, 384 nt, synthetic construct
  misc_feature 1..384: note = derived and/or modified sequence opt3 from anti-influenza_Chain
  source 1..384: mol_type = other RNA
caggtggagctgcaacagagcggccccgggctcgtcaagccttcccagaccctttctctgacatgcgccatctcaggagacagtgttagctccaactctgctacttggaattggattaggcagtcgccatcaaggggtttggaatggttaggccggacgtactatcgcagcaaatggtacaacgattatgcagacttcctgaagcgacgtataaccatcaatccggatacaagtaacaatgaggtgtccctaagactcacttctgtaacccccgacgatacagccctgtactattgtgcgagagggggacacattaccgtgtttggcgtcaacatcgacgctttcgatgtgtggggtcaagggactatggccacagttagctcc

SEQ ID NO: 27976 - RNA, 384 nt, synthetic construct
  misc_feature 1..384: note = derived and/or modified sequence opt3 from anti-influenza_Chain
  source 1..384: mol_type = other RNA
caggtgcaactgcagcagagcggccccgggctcgtcaagccttcccagaccctttctctgacatgcgccatctcaggagacagtgttagctccaactctgctacttggaattggattaggcaatcgccatcaaggggtttggagtggttaggccggacgtactatcgcagcaaatggtacaacgattatgcagacttcctgaagcgacgtataaccatcaatccggatacaagtaacaatgaagtgtccctaagactcacttctgtaacccccgacgatacagccctgtactattgtgcgagagggggacacattaccgtgtttggcgtcaacatcgacgctttcgatgtgtggggtcaggggactatggttacagtgagctcc

SEQ ID NO: 27977 - RNA, 384 nt, synthetic construct
  misc_feature 1..384: note = derived and/or modified sequence opt3 from anti-influenza_Chain
  source 1..384: mol_type = other RNA
caggtgcaactgcagcagagcggccccgggctcgtcaagccttcccagaccctttctctgacatgcgccatctcaggagacagtgttagctcctacaacgctgtgtggaattggattagacaatctccatcgaggggtttggagtggttaggccggacttattaccgctcagggtggtataacgattacgcagaaagcgtaaaaagtcgaataacgatcaatccggacacctccaagaaccagttctctctgcagctaaatagcgtgacacccgaggatactgccgtctattactgtgcgcgttccggacacattaccgtgtttggcgttaacgtggacgctttcgatatgtggggtcaggggacaatggtcaccgtgtcaagt

SEQ ID NO: 27978 - RNA, 384 nt, synthetic construct
  misc_feature 1..384: note = derived and/or modified sequence opt3 from anti-influenza_Chain
  source 1..384: mol_type = other RNA
caggtgcaactgcagcagagcggccccgggctcgtcaagccttcccagaccctttctctgacatgcgccatctcaggagacagtgttagctccaacaatgctgtgtggaactggattagacaatctccatcgaggggtttggagtggttaggccggacttactatcgctcaaaatggtacaatgattatgcagaaagcgtaaagagtcgaataacgatcaacccggacacctccaaaaatcagttctctctgcagctaaacagcgtgacacccgaggatactgccgtctactattgtgcgcgttccgggcacattaccgtgtttggagttaatgtggacgctttcgatatgtggggccagggtacaaccgtcactgtgtcaagt

SEQ ID NO: 27979 - RNA, 384 nt, synthetic construct
  misc_feature 1..384: note = derived and/or modified sequence opt3 from anti-influenza_Chain
  source 1..384: mol_type = other RNA
agaggccagctggtgcaaagcgggggaggtgtcgttcagcccggcaggtccctccggctttcttgcgccgcttcagggttcgtgtttaacgtattcggaatccactgggtgcgccaggcacctggcaagggtctggagtggttggccaccattagttacgacgggttaaataaatattacgcggatagcgtcaagggacgaataacaatctcccgtgacaactctaaaaatactctgtatctacagatgaactcgctcagagctgaagatacggccgtgtactattgtgttagggactcagaggaaagcacctactatggcgattacatgtgggtgtacaattggtttgacctgtggggccaagggacacttgtcactgtgagt

SEQ ID NO: 27980 - RNA, 384 nt, synthetic construct
  misc_feature 1..384: note = derived and/or modified sequence opt3 from anti-influenza_Chain
  source 1..384: mol_type = other RNA
caggtgcaactgcagcagtggggcagcgggctccttaagccctccgagaccctgtctttgacatgcgccgtctacggaggttcattcagagacgattattggacttggatcaggcagcctccaggcaaagggttagaatggattggagagataaaccacagtggccggacgaattacaacccgagcctgaagtcccgcgttaccatctctgtggacacatcgctaaaacaattttcactcaaggtaattagcgtgactgctgcagataccgccgtctattactgtgcgcgaggtacaagtcatgtgtcccgttatttcgactggctgccccctaccaattggtttgatccatgggggcagggaactcaggttacagtgtctagc

SEQ ID NO: 27981 - RNA, 384 nt, synthetic construct
  misc_feature 1..384: note = derived and/or modified sequence opt3 from anti-influenza_Chain
  source 1..384: mol_type = other RNA
caggtgcaactgcagcagtggggcgccgggctccttaagcccagcgagaccctgtccttgtcttgcgctgtcttcggaggttcatttagtgactactattggacatggatcagacagcctccaggcaaagggttagaatggattggagagataaagcacagcggcaggactaactacaatccgtccctggaatctcgggttacgatctcggtggataccagcaaaaaccaattctcactaaagctcagttccgtaacagcagccgacactgcgatttattactgtgctcgcggtaccgatcccgacacagaggggtattgccgatctggaagctgttccgcctttgatttctggggccagggcaccctggtgactgtctcaagt

SEQ ID NO: 27982 - RNA, 384 nt, synthetic construct
  misc_feature 1..384: note = derived and/or modified sequence opt3 from anti-influenza_Chain
  source 1..384: mol_type = other RNA
caggtgcaactgcagcagtggggcgccgggctccttaagcccagcgagaccctgtccttgacatgcggagtctacggtggctctttatcagactattactggagttggatcagacagcctccagggaaaggactggaatggattggcgagataaaccacagcggtgggactaattataacccgtccctaaagaggcgggttacgatctctgtggatacctcgaaaaagcaattctcactcaaaatgaatagcgtaacagctgcagacactgccgtgtactattgtgcgcgcggaaccgatcccgacacagaagtctactgccgagctggcaactgtgccgcatttgatttctggggccaggggaccctggtgactgttagttcc

SEQ ID NO: 27983 - RNA, 384 nt, synthetic construct
  misc_feature 1..384: note = derived and/or modified sequence opt3 from anti-influenza_Chain
  source 1..384: mol_type = other RNA
caggtgcaactgcaggagagcggccccgggctcgtcaagccttcccagaccctttctctgacatgcactgtttcaggagacagtatcagctccgtggatcactactggtcttggattagacagcatccagtaaaaggtttggaatggataggcttcatgtattactcggcctcaacgtattacaacccgagcttaaagagtagggtgaccatctccacagacacttctaaaaatcaatttagcctgcggctatcctcagtcaccgctgcagatacagccgtgtattactgtgcgcgcgggacctgcgctggagactgtagtctccactattactactatggcctggatgtttggggtcaggggcgaactgtgacagtcagctct

SEQ ID NO: 27984 - RNA, 384 nt, synthetic construct
  misc_feature 1..384: note = derived and/or modified sequence opt3 from anti-influenza_Chain
  source 1..384: mol_type = other RNA
gaggtggccctggtcgaaagcggcgctgaggttaagaaacccgggtcctctgtgaaggtatcatgcaaagcaagtggacacatcttcagcggttacgccatttcctgggtgagacaggcgcctggccaagggctcgaatggatgggaggcataatcccaatttttggtaccacaaactatgctcagaagttccaggggagggtcactatcacggccgaccagtctacctcgacagcatacatggatctttcaaatctgcggagcgaggacactgccgtgtattactgtgctcgcgttaaagatggatattgcaccttgacaagttgtccggtgggctggtactttgacttatggggccgagggaccctggtcactgtgtcctct

SEQ ID NO: 27985 - RNA, 384 nt, synthetic construct
  misc_feature 1..384: note = derived and/or modified sequence opt3 from anti-influenza_Chain
  source 1..384: mol_type = other RNA
gaggtgcagctggtcgaaagcggcgccgaggttaagaaacccgggtcctctgtgaaggtatcatgcaaagctagtggacacatcttcagcggttacgcaatttcctgggtgagacaagcccctggccaggggctcgaatggatgggaggcataatcccaatttttggtaccacaaactatgcgcagaagttccaggggagggtcactatcacggctgaccaatctacctcgacagcctacatggatctttcaaatctgcggagcgaggacactgcagtgtattactgtgcccgcgttaaagatggatattgcaccttgacaagttgtccggtgggctggtactttgacttatggggccgagggaccctggtcactgtgtcctct

SEQ ID NO: 27986 - RNA, 384 nt, synthetic construct
  misc_feature 1..384: note = derived and/or modified sequence opt3 from anti-influenza_Chain
  source 1..384: mol_type = other RNA
caggtgcaactggtccagagcggcgccgaggttagaaagcccggggcttccgtgaaagtatcttgcaaggcatcaggatacaccttcacaaggcacggtatcagttgggtgcggcaggcccctggccaggggctcgaatggatgggatggattagcgcgtatactggcgacacggattacgctcaaaaatttcagggtcgcgtcaccatgacaactgacacctccacaaacaccgcctatatggagcttcgatctctgcgttcggatgacgcagccgtgtactattgtgctagattgaggttacagggggaagttgtggtcccaccgtcacagagcaattggttcgatccctggggacaaggcactctggtgacagtaagttcc

SEQ ID NO: 27987 - RNA, 384 nt, synthetic construct
  misc_feature 1..384: note = derived and/or modified sequence opt3 from anti-influenza_Chain
  source 1..384: mol_type = other RNA
caggtgcaactggtcgagagcggccccgggctcatgaagccttccgaaaccctttctctgacatgcactgtttcaggaggtagtgtgagcaactactattggtcctggatcagacagccaccgggcaaagggttggagtggattggatacgtattctattctggctcgtcaaattacaaccccagcttaaataaccctagtctgaagtccagggtgacgatatctatcgacaccagcaataaccagttttccctaaaactctcaagtgtcacagccgctgatactgcagtgtattactgtgcccggggtcgcgttaatagcgggtatgactggggaccaaacttcgattcttggggccagggcgcgctggtgaccgtctcctca

SEQ ID NO: 27988 - RNA, 384 nt, synthetic construct
  misc_feature 1..384: note = derived and/or modified sequence opt3 from anti-influenza_Chain
  source 1..384: mol_type = other RNA
caggtgcaactggtccagagcggcgccgaggttaagaaacccgggtcctctgtgaaggtatcatgcaaagctagtggaggtaccttcagctactatgcaatctcctgggtgagacaggcccctggccaggggctcgaatggatgggaggcattataccaatcgtcggtacagcgcactacactcaaaagtttcaggggagggtgacgattaccgctgacgagtctacatcgactgcctatatggaactttcaagcctgcggagtgaggataccgcagtttacttctgtgcccgcgctgcagacgaatccgtggagtctttgacaatcaaagcctttcgaaccaactatcattggggacagggcactttagtcacagtgagctcc

SEQ ID NO: 27989 - RNA, 387 nt, synthetic construct
  misc_feature 1..387: note = derived and/or modified sequence opt3 from anti-influenza_Chain
  source 1..387: mol_type = other RNA
gaggtgcagctggtcgaaagcggcgggggagccgttcaacccggtgagtccctcaaacttccttgcgctgcatctggcttcaccttttcaaactacgggatgcactgggtgagacaggccccaggaaagggcctggaatgggtagcggtgatcagttatgacggtagcaataagtactatgctgattccgtcaaagggaggttcacaatttctcgggacaactcgaaggatactttgtacttacagatgaactcactgcgcgccgaggacacggcactattttattgtgccaaagaacgaccgctccgtctgcttagatacttcgattggctgagcggaggcgctaatgactattggggccaggggaccttggtgacagttagttcc

SEQ ID NO: 27990 - RNA, 387 nt, synthetic construct
  misc_feature 1..387: note = derived and/or modified sequence opt3 from anti-influenza_Chain
  source 1..387: mol_type = other RNA
gaggtgcagctggtcgaaagcggcgggggagccgttcaacccggtgagtccctcaaactttcttgcgctgcatcaggcttcacctttagtaactacgggatgcactgggtgagacaggcccctggaaagggcctggaatgggtagcggtgatcagctatgacggttccaataagtactatgctgattctgtcaaagggaggttcacaatttcgcgggacaactcaaaggatactttgtacttacagatgaatagcctgcgcgccgaggacacggcactattttattgtgccaaagaacgaccactccgtctgcttagatacttcgattggctgagtggaggcgctaacgactattggggccaggggaccttggtgacagtttcctct

SEQ ID NO: 27991 - RNA, 387 nt, synthetic construct
  misc_feature 1..387: note = derived and/or modified sequence opt3 from anti-influenza_Chain
  source 1..387: mol_type = other RNA
caggtgcaactggtcgagagcggcgggggagttgtgcagcccggtagatccctcaggctttcttgcgccgtatcaggcttcacctttagtagctacgctatgcactgggtgcggcaggcacctgggaagggactggaatgggtcgccgtgatctcctatgacggctctaaccagtactatgcggattcggttaaaggtcgcttcacaatttcacgagacaatagcaagaacactttgtacttacaaatgaatagtctgcgtgctgaggatacggccctatattactgtgcaaaagacccaagactcaggcatctgctttattttccgttcacctccatgatatactttgattactgggggcagggaacactggtgactgtctctagc

SEQ ID NO: 27992 - RNA, 387 nt, synthetic construct
  misc_feature 1..387: note = derived and/or modified sequence opt3 from anti-influenza_Chain
  source 1..387: mol_type = other RNA
caggtgcaactggtccagagcggcgggggagttgtgcagcccggtagatccctcaggctttcttgcgtagcctcaggcttcacctttagtacatacgctatgcactgggtgcggcaggcacctgggcgcggactggagtgggtcgccgtgatcagctatgacgcgaactacaagtattacgctgattccgttaaaggccgattctctatttcgcgtgacaattcacaaaacactttgcatttagaaatgaatacgctgagaaccgaggatacagccctatattactgtgcaaaggacagccagctcaggagtctgctttattttgaatggctgtcccagggttacttcgagccatgggggcagggaactttggtgaccgtcacatct

SEQ ID NO: 27993 - RNA, 387 nt, synthetic construct
  misc_feature 1..387: note = derived and/or modified sequence opt3 from anti-influenza_Chain
  source 1..387: mol_type = other RNA
caggtgcaactggtccagagcggcgggggagttgtgcagcccggtagatccctcaggctttcttgcgtagcctcaggcttcacctttagtacatacgctatgcactgggtgcggcaggcacctgggcgcggactggagtgggtcgccgtgatcagctatgacggcaactacaagtattacgcggattccgttaaaggtcgattctctatttcgcgtgacaattcaaacagcactttgcatttagaaatgaatacgctgagaaccgaggatacagctctatattactgtgccaaggacagtcaactcaggtccctgctttattttgaatggctgtctcaggggtacttcgatccatggggacagggcactttggtgaccgtcacaagc

SEQ ID NO: 27994 - RNA, 387 nt, synthetic construct
  misc_feature 1..387: note = derived and/or modified sequence opt3 from anti-influenza_Chain
  source 1..387: mol_type = other RNA
caggtgcaactggtccagagcggcgccgaggttaagaaacccgggtcctctgtgaccgtatcatgcaaggctagtggaggtacattcagcaactacggcatctcctgggtgagacaggcacctgggcagggactcgactggatgggcggtattataccactttttgggactgccaattatgcgcaaaaattccagggaagggtcacgatcaccgctgatgaatctacatcgtcaagcaacatggagctgagttccttgcggtctgaagacactgccgtgtactattgtgcacgcgatgttcacaattacgactttttaaccggctatccgctgcatctatacggcatggatgtgtgggggcagggaacaaccgtcactgtgagctcc

SEQ ID NO: 27995 - RNA, 387 nt, synthetic construct
  misc_feature 1..387: note = derived and/or modified sequence opt3 from anti-influenza_Chain
  source 1..387: mol_type = other RNA
caggtgcaactgcaggagagcggccccgggctcgtcaagccttccgaaaccctttctctgatctgcgccgtttcaggagctagtattagctcctcttactggtcgtggataagacagccaccgggtaaaggcttggagtggatcgggtatatttactattcaggagtgacaaagtacaaccccagcttaaaaagtagggtaactctgtccgtggacacgtctaagaatcacttcagcctaaaactctcctatgtcaccgcagccgatacagcggtgtactattgtgctcggaacctgcctgacatcgccgttgtgactgcagtccaggatgccaccccagtgtggtttgacccctggggccctggtacacttgtatcagttagtagc

SEQ ID NO: 27996 - RNA, 387 nt, synthetic construct
  misc_feature 1..387: note = derived and/or modified sequence opt3 from anti-influenza_Chain
  source 1..387: mol_type = other RNA
gaggtgcagctggtcgaaagcggcgggggactcgttcaacccggtagatcccttaggctgtcttgcgccgcttcaggcttcacctttagtgacttctggatgagctgggtgcggcaggcacctgggaagggattggagtgggtagccaacatcgatcaggacggcaatgaacgcttttacgcggattccgtgaaaggtcgattcacaatttctcgtgacaacgctaaaaattcgttatatctgcagatgacttcactaagagccgatgacacggcagtctactattgtgccagggatgggcgggagggatacttttatggcagcggcagtttctacaacctcaaggggctgaattggggacaaggtacccttctgacagtgtcctct

SEQ ID NO: 27997 - RNA, 387 nt, synthetic construct
  misc_feature 1..387: note = derived and/or modified sequence opt3 from anti-influenza_Chain
  source 1..387: mol_type = other RNA
gaggtgctgatggtcgaaagcggcgggggactcgttcagcccggtggctccgtgagactttcttgcgtagcctcagggttcagttttagctcccactggatgacctgggtgaggcaagctcctggaaagggcctggagtgggtcgcaaacatcgaagacgatggtggggacaaatactatgtggattctgttaagggacggttcattatatcgcgcgacaatgccaaaaactcagtgtacttgcagatgaatagcttacgagcggaggatacagctgtctatttttgtgcccgtggcagtggctcctctgacagaagcgattacgacccacattattactattacctggatgtgtgggggaagggagcaactgtaacggtttcctca

SEQ ID NO: 27998 - RNA, 387 nt, synthetic construct
  misc_feature 1..387: note = derived and/or modified sequence opt3 from anti-influenza_Chain
  source 1..387: mol_type = other RNA
gaggtgcagctggtcgaaagcggcggggacctcgttcaacccggaagatcccttaagctgtcttgcaccggttcaggcttcacatttggggattacggagtgacttgggtaaggcaggcccctggcaaaggtttggagtgggtggggttcatccggacgcgcccatggggaggcaccgctgacacagcagccagtgtcaagggccgatttactattagccgtgatgactccaaatctttagcgtatctgcagatgaactcgctaaagaccgaagatacagctgtgtactattgttgcagagacgccccgcccaatgttgaggtggcatcaatgaccaactggtacttcgatctctgggggaggggaactctggtcacagtgagcagt

SEQ ID NO: 27999 - RNA, 387 nt, synthetic construct
  misc_feature 1..387: note = derived and/or modified sequence opt3 from anti-influenza_Chain
  source 1..387: mol_type = other RNA
gaggtgcagctggtccaaagcggctccgaagttaagaaacccggggagtctctcaagatctcatgcaaaggaagtggttacagcttctccaactattggattggctgggtgagacacatgcctgggaagggacttgaatggatgggcataatctacccaggtgactctgataccaggtattcgccgtcatttcaggggcaggtaacaatgagcgccgacaaaagttcctctactgtgtacctgcagtggagctccttgaaggcttcagatacggcaatttattactgtgcccggcgcggaggccatagtttcggctatgggagcggaggtgacacccactctgagtttgattcctggggccaagggacattagtcactgtgtcaagc

SEQ ID NO: 28000 - RNA, 387 nt, synthetic construct
  misc_feature 1..387: note = derived and/or modified sequence opt3 from anti-influenza_Chain
  source 1..387: mol_type = other RNA
caggtgcaactgctcgagaccggcgggggacttgtcaagcccggtcagagcctgaaattgtcctgcgccgcttctggcttcacatttacttcatacgcaatgcactgggttagacagcctccagggaagggattagaatgggtggccgtagtgagttatgacggcaactacaaatattacgcggatagcgtccagggtaggttcacgatctcccgggacaattctaagaacaccctgtatctacaaatgaactcgctccgcgctgaggatacagccgtgtactattgtgcaaaagactcacgactgcgtagccttctgtactttgaatggttgagtcaggggtacttcaatccgtggggacagggcactaccctcacagtttcctct

SEQ ID NO: 28001 - RNA, 387 nt, synthetic construct
  misc_feature 1..387: note = derived and/or modified sequence opt3 from anti-influenza_Chain
  source 1..387: mol_type = other RNA
caggtgcaactggtcgagagcggcgccgaagttaagaaacccggggcttccgtgaagctctcttgcaccgcatcaggatacaacttcgccgcgtattacatccactgggtaagacaggctcctggtcagggccttgagtggatggggtggagtaatccaaacacaggaggcgccaattatgcacaggactttcaaggtagggtgactatgacggccgtcaccagcacatccactgcttacatggaactgtctcggttgacctcggatgacacagcattatatttctgtgcccgcgtgccgcgagatcgtctgctaaccctctactatgagtcaagcacttacgggtttgactactggggacagggcacactggttaccgtgagttcc

SEQ ID NO: 28002 - RNA, 387 nt, synthetic construct
  misc_feature 1..387: note = derived and/or modified sequence opt3 from anti-influenza_Chain
  source 1..387: mol_type = other RNA
caggtgcaactggtcgagagcggcgggggactcgttcagcccggtggctcccttagactgtcttgcaccgtgtcagggttcacatttaatagttacgccatgaattgggtaaggcaggctcctggaaagggcttggaatgggtgagcggtatccgggggtccggagagaacacttattacgcagaaacggtcaaaggccgcttcaccatttctcgagacaattcgaagaacacattatatctggagatgaactcactacgtgccgaagatactgcggtgtactattgtgctagaaaatggggcaggatgaccgtttttggggtggccacagaccagctctactatttcgattactggggacaaggtaccctggtcactgtgagcagt

SEQ ID NO: 28003 - RNA, 387 nt, synthetic construct
  misc_feature 1..387: note = derived and/or modified sequence opt3 from anti-influenza_Chain
  source 1..387: mol_type = other RNA
caggtgcaactggtcgagagcggccccgggctcgttaagccttcccagaccctttctctgacatgcactgtgtcaggaggtagtatcagcaacggcgggtaccactggtcctggattagacagcatccaggaaaaggcttggaatggataggtaatatctattacagggggtctacgttctatgacccgtcgttaaagtcacgggtaaccattagcgtggatacaagtaaatcccagttttctctgaagctaactagcgtcaccgccgctgacacagcagtgtactattgtgcccgcatgcccctcgcgaactacgatctgcttaccggactgtatatcggcgctttcgacttgtggggccaagggactatggttacagtgtcctca

SEQ ID NO: 28004 - RNA, 387 nt, synthetic construct
  misc_feature 1..387: note = derived and/or modified sequence opt3 from anti-influenza_Chain
  source 1..387: mol_type = other RNA
caggtgcaactggtcgagagcggcgccgaagttaagaaacccggggcttccgtgagagtatcttgcaagggatcaggttacaccttcacagcatatcacatgcattgggtgaggcaggcccctggccaggggtttgagtgggtcggatggatcaacccaaatagtggcgcgacttactatacgagcaccttcgaaggtcgggtgacaatgactcgcgacacctccattacaaccgcttacatggagctgtcttcgcttcgatcagatgacactgccgtttattactgtgcaacagatatagtggtcgaacgtgacgccagcctcgggggatttaacagttatggcatggatgtgtggggccaggggaccacggtaactgtttcctct

SEQ ID NO: 28005 - RNA, 390 nt, synthetic construct
  misc_feature 1..390: note = derived and/or modified sequence opt3 from anti-influenza_Chain
  source 1..390: mol_type = other RNA
caggtgcaactgcagcagtggggcgccgggctccttaagcccagcgagaccctgtccttgacatgcgctgtctacggaggttctttctcagttagtggctattactggagctggatcagacagcctccagggaggggattagaatggattggcgagatatcccacggtgggtctactaactataatccgtcgctgaaatcacgggtgacgatcagcgtagacaccacaaagaaccaatttagtctacgcctctcctctgtgactgcagccgataccgcggtctactattgtgctcgaggaacagaccccgataccgaagtgtactgccgtgttggcaattgtgccgcattcgactattggggccaggggagcctggtgactgtctcctca

SEQ ID NO: 28006 - RNA, 390 nt, synthetic construct
  misc_feature 1..390: note = derived and/or modified sequence opt3 from anti-influenza_Chain
  source 1..390: mol_type = other RNA
caggtgcaactgctcgagagcggccccgggcttgtcaagccttcccagaccctgttgttaacatgcactgtttctggagcctcaatcagtacgggtggcaactactggagctggattagacagcacccagggaaagacctggaatggataggatatatcttctactccggcaccacaaagtataatccgtctgtggataacccctcgctaaaatcaagggtaactatgagcgtggacaccagtgagaatcagttttccctcaagctgtctagcgtcacagctgcagataccgccgtgtacttctgtgcgcggggttcccctaactcagggtatgactggggaccacattttgattactggggccaaggcactcttgttacagtgagtagc

SEQ ID NO: 28007 - RNA, 390 nt, synthetic construct
  misc_feature 1..390: note = derived and/or modified sequence opt3 from anti-influenza_Chain
  source 1..390: mol_type = other RNA
gaggtgcagctggtcgaaagcggcgggcacctcgttcaacccggaagatcccttaggctgtcttgcgccgcttcaggtttcacctttgaggactacgcaatgaactgggtgcggcaggcccctggcaaggggttggaatgggtaagtgtgatcagctgggattccggacgcattggctatgcggactctgtcaaaggtcgattcacaatatcgcgtgataatgctaagaactcaagctacttacagatgaatagtctgagaccagaggacactgccctatattactgtgtgagggatatgctcgcatattactccgacaactctgggaaaaagtataatgtttacggaatggatgtgtggggccagggcacgaccgtcacagtgagctcc

SEQ ID NO: 28008 - RNA, 390 nt, synthetic construct
  misc_feature 1..390: note = derived and/or modified sequence opt3 from anti-influenza_Chain
  source 1..390: mol_type = other RNA
gaggtgcagctggtcgaaagcggcgggggactcgttcaacccggtagatcccttaggctgtcttgcgccgtgtcaggcttcatctttgaggactacgctattaactgggtacggcaggcacctgggaagggattggaatgggtgagtataatcagctgggattccggccgcattggttatgccgactctgtccgagggcgtttcaccatctcgagagataatgcgaaaaacagctcatttttacagatgaatagtctgaggccagaggacacagctgtgtactattgtgttaaggatatgctagcctactattacgacggatccggcattcggtataacctctacggcatggatgtgtgggggcagggaactacggtcaccgtgtctagc

SEQ ID NO: 28009 - RNA, 390 nt, synthetic construct
  misc_feature 1..390: note = derived and/or modified sequence opt3 from anti-influenza_Chain
  source 1..390: mol_type = other RNA
gaggtgcagctggtcgaaagcggcgggggactcgttcaacccggtagatcccttaggctgtcttgcgccgtgtcaggcttcatctttgaggactacgctattaactgggtacggcaggcacctgggaagtgtttggaatgggtgagtataatcagctgggattccggacgcattggctatgccgactctgtccgaggtcgtttcaccatctcgagagataatgcgaaaaacagctcatttttacagatgaatagtctgaggccagaggacacagctgtgtactattgcgttaaggatatgctagcctactattacgacgggtccggcattcggtataacctctacggaatggatgtgtggggccaggggactacggtcaccgtgtctagc

SEQ ID NO: 28010 - RNA, 396 nt, synthetic construct
  misc_feature 1..396: note = derived and/or modified sequence opt3 from anti-influenza_Chain
  source 1..396: mol_type = other RNA
cagatcaccctgaaggagagcggccccacactcgtgaaacctactcaaacgcttaccctgacatgcgtcttctccgggttttctttgtcaattactggagttagagtgggttggataaggcagccaccgggcaaggccttagaatggctggctctaatcagttgggacgatgagaaacactacagcccctccctccagtctcggctgaccattacaaaggacacctcgaaaaaccaggtagtgcttactatgacaaatctggatcctgtcgacaccgcaacgtattactgtgcccgctcaactgatcgagggcatgtgttgcgttatttcggatggatgctcccaggcgacgcgtttgatgtttggggtcaagggaccatggtgacagtcagcagt

SEQ ID NO: 28011 - RNA, 396 nt, synthetic construct
  misc_feature 1..396: note = derived and/or modified sequence opt3 from anti-influenza_Chain
  source 1..396: mol_type = other RNA
caggtgcaactgcaggagagcggccccgggctcgtcaagccttccgaaaccctttctctgacatgcactgtttcaagtggaccaatgagcgactactattggtcctggatcagacagccgcccggtaaaggcttggagtggattgggcacgtgtctgtatcgcatggaggcaggacgaagtcaaaccctagcgtgatgagtcgggtcaccatatccgtggaaacatctaaaaatcagttcagcttaaagctgacttccgttaccgccgctgatacagcagtgtactattgtgcccgcctaaactactatgaccgatcaggttaccacagtccagatgggcccagcaataactggtttgacccttggggacaaggcaccctcgtcactgtgtcttcc

SEQ ID NO: 28012 - RNA, 396 nt, synthetic construct
  misc_feature 1..396: note = derived and/or modified sequence opt3 from anti-influenza_Chain
  source 1..396: mol_type = other RNA
caggtgcaactggtccagagcggcgccgaggttaagaaacccggggcttccgtgaaggtatcttgcaaaacctcaggatacacattcactgcatatacgatccactgggtgagacaggcccctggtcagaggctcgaatggatgggctggattaacgcggggaatggacataccaagtacagtcaacggtttaaaggccgcgtcacaataactcgagacaccagcgctcgtacaacctatatggagcttagatccctgacttctgaagatacagccttgtacttctgtgcaaggggtccagagacctattactatgacaagacgaactggttaaattcgcacccggatgaatactttcagcattgggggcacggaactcaggtgaccgtttcaagc

SEQ ID NO: 28013 - RNA, 399 nt, synthetic construct
  misc_feature 1..399: note = derived and/or modified sequence opt3 from anti-influenza_Chain
  source 1..399: mol_type = other RNA
caggtgcaactggtccagagcggctccgaggttaagaaacccggggcctctgtgaaggtatcatgcaaagctagtggatacaccttcacaaactatgacatcaattggattagacaggcacctggtcagggcctcgaatggatggggtggataaacccaaatagcggaactacgggctccgcccaaaggtttcagggtcgggtgaccatcacagtcgatacttctattaccacagtgtacatggagctttcgtcactgcgcagcgacgataccgcgatctattactgtgctcgagggcgtgaattgttaagactgcagcacttcctaactgacagtcagtccgagaggcgggattgctttgacccgtggggacaaggcacactcgttaccgtgtctagc

SEQ ID NO: 28014 - RNA, 402 nt, synthetic construct
  misc_feature 1..402: note = derived and/or modified sequence opt3 from anti-influenza_Chain
  source 1..402: mol_type = other RNA
gaggtgcagctggtcgaaagcggcgggggactcgttaagcccggtggctcccttagactgtcttgcgccgcttcagggttgagtttcttaaacgcatggatgagctgggtgaggcaagcccctggaaaaggcctggagtgggtaggtcggatcaagtccaataccgacgggggaacaactgattacgcggctccagtgaaaggccgctttacgatttctcgagacgattcgaagaacaccctatatctccagatgtcaagcctgaaaacagaagacactgccgtctactattgtaccacagatggcccgtacagtgacgatttccgttccgggtatgcagccagatacaggtattttggaatggacgtgtggggtcagggcaccactgttacagtgtctagc

SEQ ID NO: 28015 - RNA, 402 nt, synthetic construct
  misc_feature 1..402: note = derived and/or modified sequence opt3 from anti-influenza_Chain
  source 1..402: mol_type = other RNA
gaggtgcagctggtcgaaagcggcgggggactcgttaagcccggtggctcccttagactgtcttgcgccgcttcagggttcagctttttgaacgcatggatgagttgggtgaggcaagcccctggaaaaggcttagagtgggtaggtcggatcaagtccaataccgacgggggaacaactgattacgcggctccagtgaaaggccgcttcacgatttctcgagacgattcgaagaacaccctgtatctacagatgtcaagcctcaaaacagaagacactgccgtctactattgtaccacagatggcccgtacagtgacgattttcgttccgggtatgcagccagatacaggtatttcggaatggacgtgtggggtcagggcaccactgttacagtgtctagc

SEQ ID NO: 28016 - RNA, 402 nt, synthetic construct
  misc_feature 1..402: note = derived and/or modified sequence opt3 from anti-influenza_Chain
  source 1..402: mol_type = other RNA
gaggtgcagctggtcgaaagcggcgggggactcgttaagcccggtggctcccttagactgtcttgcgccgcttcagggttgaccttcttaaacgcatggatgagttgggtgaggcaagcccctggaaaaggcctggagtgggtaggtcggatcaagagcaatacagacgggggaactacggattacgcggctccagtgaaaggccgctttaccatttcccgagacgattctaagaacacactatatctccagatgtcgtcactgaaaactgaagacaccgccgtctactattgtacaaccgatggcccgtacagcgacgatttccgtagtgggtatgcagccagatacaggtattttggaatggacgtgtggggtcagggcactacagttaccgtgtcctct

SEQ ID NO: 28017 - RNA, 402 nt, synthetic construct
  misc_feature 1..402: note = derived and/or modified sequence opt3 from anti-influenza_Chain
  source 1..402: mol_type = other RNA
gaggtgcagctggtcgaaagcggcgggggactcgttaagcccggtggctcccttagactgtcttgcgccgcttcagggttcagttttagcaacgcatggatgtcctgggtgaggcaagcccctggaaaaggcttggagtgggtaggtcggatcaagtctaataccgacgggggaacaactgattacgcggctccagtgaaaggccgcttcacgatttcgcgagacgattcaaagaacaccttatatctgcagatgagcagtctaaaaacagaagacactgccgtctactattgtaccacagatggcccgtactccgacgattttcgttctgggtatgcagccagatacaggtatttcggaatggacgtgtggggtcagggcaccactgttacagtgagctcc

SEQ ID NO: 28018 - RNA, 402 nt, synthetic construct
  misc_feature 1..402: note = derived and/or modified sequence opt3 from anti-influenza_Chain
  source 1..402: mol_type = other RNA
gaggtgcagctggtcgaaagcggcgggggactcgttaagcccggtggctcccttagactgtcttgcgccgcttcagggttgaccttcagtaacgcatggatgagctgggtgaggcaagcccctggaaaaggcttagagtgggtaggtcggatcaagtccaatacagacgggggaactacggattacgcggctccagtgaaaggccgctttaccatttctcgagacgattcgaagaacacactgtatctacagatgtcaagcctcaaaactgaagacaccgccgtctactattgtacaaccgatggcccgtacagtgacgatttccgttccgggtatgcagccagatacaggtattttggaatggacgtgtggggtcagggcactacagttaccgtgtctagc

SEQ ID NO: 28019 - RNA, 402 nt, synthetic construct
  misc_feature 1..402: note = derived and/or modified sequence opt3 from anti-influenza_Chain
  source 1..402: mol_type = other RNA
gaggtgcagctggtcgaaagcggcgggggactcgttaagcccggtggctcccttagactgtcttgcgccgcttcagggttcacctttagtaacgcatggatgagctgggtgaggcaagcccctggaaaaggcttggagtgggtaggtcggatcaagtccaatacagacgggggaactacggattacgcggctccagtgaaaggccgcttcaccatttctcgagacgattcgaagaacacattatatctgcagatgtcaagcctaaaaactgaagacaccgccgtctactattgtacaaccgatggcccgtacagtgacgattttcgttccgggtatgcagccagatacaggtatttcggaatggacgtgtggggtcagggcactacagttaccgtgtctagc

SEQ ID NO: 28020 - RNA, 402 nt, synthetic construct
  misc_feature 1..402: note = derived and/or modified sequence opt3 from anti-influenza_Chain
  source 1..402: mol_type = other RNA
gaggtgcagctggtcgttagcggcgggggactcgtgaagcccggtggctcccttagactgtcttgcgccgcttcagggttgagtttcttaaacgcatggatgagctgggtaaggcaagcccctggaaaaggcctggaatgggtgggtcggatcaagtccaataccgacgggggaacaactgattacgcggctccagtcaaaggccgcttttctatttcgcgagacgattcaaagaacatgctattcctccacatgagcagtctgcgtacggaggacaccgccgtgtattactgtgcaacagatggcccgtattccgacgattttagatctgggtacgccgctaggtatcggtacttcggaatggacgtttggggtcagggcactaccgtgacagtcagctcc

SEQ ID NO: 28021 - RNA, 402 nt, synthetic construct
  misc_feature 1..402: note = derived and/or modified sequence opt3 from anti-influenza_Chain
  source 1..402: mol_type = other RNA
gaggtgcagctggtcgttagcggcgggggactcgtgaagcccggtggctcccttagactgtcttgcgccgcttcagggttgagtttcttaaacgcatggatgagctgggtaaggcaagcccctggaaaatgtctggaatgggtgggccggatcaagtccaataccgacggtgggacaactgattacgcggctccagtcaaaggacgcttttctatttcgcgagacgattcaaagaacatgctattcctccacatgagcagtctgcgtacggaggacaccgccgtgtattactgcgcaacagatggcccgtattccgacgattttagatctggctacgccgctaggtatcggtacttcgggatggacgtttggggacagggtactaccgtgacagtcagctcc

SEQ ID NO: 28022 - RNA, 402 nt, synthetic construct
  misc_feature 1..402: note = derived and/or modified sequence opt3 from anti-influenza_Chain
  source 1..402: mol_type = other RNA
gaggtgcagctggtcgttagcggcgggggactcgtgaagcccggtggctcccttagactgtcttgcgccgcttcagggttgagtttcttaaacgcatggatgagctgggtaaggcaagcccctggaaaaggcctggaatgggtgggtcggatcaagtccaataccgacgggggaacaactgattacgcggctccagtcaaaggccgcttttctatttcgcgagacgattcaaagaacatgctattcctccacatgagcagtctgcgtacggaggacaccgccgtgtattactgtgcaacagatggcccgtattccgacgattttagatctgggtacgccgctaggtatcggtacttcggaatggacgtttggggttgcggcactaccgtgacagtcagctcc

SEQ ID NO: 28023 - RNA, 402 nt, synthetic construct
  misc_feature 1..402: note = derived and/or modified sequence opt3 from anti-influenza_Chain
  source 1..402: mol_type = other RNA
gaggtgcagctggtcgaaagcggcgggggactcgttaagcccggtggctcccttagactgtcttgcgccgcttcagggttcacctttttgaacgcatggatgagttgggtgaggcaagcccctggaaaaggcttagagtgggtaggtcggatcaagagcaatacagacgggggaactacggattacgcggctccagtgaaaggccgcttcaccatttcccgagacgattctaagaacacactgtatctacagatgtcgtcactcaaaactgaagacaccgccgtctactattgtacaaccgatggcccgtacagcgacgattttcgtagtgggtatgcagccagatacaggtatttcggaatggacgtgtggggtcagggcactacagttaccgtgtcctct

SEQ ID NO: 28024 - RNA, 402 nt, synthetic construct
  misc_feature 1..402: note = derived and/or modified sequence opt3 from anti-influenza_Chain
  source 1..402: mol_type = other RNA
gaggtgcagctggtcgaaagcggcgggggactcgttaagcccggtggctcccttagactgtcttgcgccgcttcagggttcacctttttgaacgcatggatgagttgggtgaggcaagcccctggaaaatgtttagagtgggtaggccggatcaagagcaatacagacggtgggactacggattacgcggctccagtgaaaggacgcttcaccatttcccgagacgattctaagaacacactgtatctacagatgtcgtcactcaaaactgaagacaccgccgtctactattgcacaaccgatggcccgtacagcgacgattttcgtagtggctatgcagccagatacaggtatttcgggatggacgtgtggggacagggtactacagttaccgtgtcctct

SEQ ID NO: 28025 - RNA, 402 nt, synthetic construct
  misc_feature 1..402: note = derived and/or modified sequence opt3 from anti-influenza_Chain
  source 1..402: mol_type = other RNA
gaggtgcagctggtcgaaagcggcgggggactcgttaagcccggtggctcccttagactgtcttgcgccgcttcagggttcacctttttgaacgcatggatgagttgggtgaggcaagcccctggaaaaggcttagagtgggtaggtcggatcaagagcaatacagacgggggaactacggattacgcggctccagtgaaaggccgcttcaccatttcccgagacgattctaagaacacactgtatctacagatgtcgtcactcaaaactgaagacaccgccgtctactattgtacaaccgatggcccgtacagcgacgattttcgtagtgggtatgcagccagatacaggtatttcggaatggacgtgtggggttgcggcactacagttaccgtgtcctct

SEQ ID NO: 28026 - RNA, 414 nt, synthetic construct
  misc_feature 1..414: note = derived and/or modified sequence opt3 from anti-influenza_Chain
  source 1..414: mol_type = other RNA
caggtgcaactgcaggagagcggcgggggactcgtccagcccggtgaatcccttagactgtcttgcgttggctcagggagtagcttcggagagtccaccttgtcttactatgccgtgtcgtgggtaaggcaggctcctggcaagggtttagaatggctgtcaatcattaacgcagggggaggcgacatagattacgccgacagcgtggagggccggtttacaatcagtcgcgataattccaaagaaactctatatctccaaatgacgaacctgcgagtcgaggacaccggggtgtactattgtgcgaagcacatgtctatgcagcaggttgtgagcgctggatgggagcgtgccgatcttgtcggtgacgcattcgatgtgtggggccaggggacaatggtaactgtttcctca

SEQ ID NO: 28027 - RNA, 465 nt, synthetic construct
  misc_feature 1..465: note = derived and/or modified sequence opt3 from anti-influenza_Chain
  source 1..465: mol_type = other RNA
ctgagcagaatcaaccacttcgagaagattcagataatccccaaatcctcttggtcagaccatgaagccagtagcggcgtgtcctctgcttgcccttaccaagggaccccatcgtttttcaggaatgtcgtttggctcattaagaaaaacaatacatatccgactatcaagcggtcatacaacaatacgaaccaggaggatcttctgattttgtggggaatccaccatagcaatgacgcagccgaacagaccaaattatatcagaaccccacaacttacataagtgtgggtacctccacactgaatcaacgcctagtacctaagatcgcgacccgatctaaggtgaacggccagaatgggcgtatggactttttctggactattctcaaaccaaacgatgctatcaattttgagagcaacggaaatttcattgcccccgaatatgcatacaagatcgtcaaaaag

SEQ ID NO: 28028 - RNA, 564 nt, synthetic construct
  misc_feature 1..564: note = derived and/or modified sequence opt3 from anti-influenza_Chain
  source 1..564: mol_type = other RNA
aacgtgcccgagtggagctacatcgtcgaaaaggccaatcctgctaacgacctgtgctatccaggcaatttcaacgattacgaggaactcaaacaccttctgtccagaattaatcattttgagaagatacagatcattccgaaatcttcatggagtgaccacgaagcaagctccggggtttcttcggcctgtccctatcaaggaaccccttcattctttaggaacgtggtatggttgatcaagaaaaataacacatacccaactattaagcggagctataataacacgaatcaggaggatttactgatcctatggggtatacatcacagtaacgacgcggctgagcagaccaagctctaccagaatcccacaacttatatctccgtgggcacctctacactgaaccaacgccttgtccctaaaattgccacccgaagcaaggtgaatgggcagaacggacgtatggatttcttttggactatcctgaaaccaaacgacgcaattaatttcgaatccaacggcaattttatcgcccccgagtacgcttacaagatagttaaaaag

SEQ ID NO: 28029 - RNA, 609 nt, synthetic construct
  misc_feature 1..609: note = derived and/or modified sequence opt3 from anti-influenza_Chain
  source 1..609: mol_type = other RNA
atgctgagaagcctcgtgcttaacgagaagctgagggcccgggtcttggaacgcgctgaggaatttttactgaataacaaagcagacgaggaagtttggtttcgagagctagtgctctgcatcctgacctccaattcttcattcattagtgcctacaagagcatgaactatatacttgataaaatcctgtacatggacgagaaggaaatttccatcttgctccaggagtctggctatcgtttttacaatctgaaagcgaagtatctgtacagagctaagaacctctatgggaaagtaaagaaaacaattaaggaaatcgccgataaagaccaaatgcaggcaagggagttcatagccactcacatctacggaattggttacaaggaggcttcgcatttcttacggaatgtgggctatctggatcttgcaatcattgaccgccacatcttgagattcataaacaatctggggattcccatcaagctaaaatcaaagagggaatacctcctggccgagagccttctgcggagtattgctaacaatttgaacgtccaggtgggactcctggatttatttatcttctttaaacagacgaataccatcgttaag

SEQ ID NO: 28030 - RNA, 615 nt, synthetic construct
  misc_feature 1..615: note = derived and/or modified sequence opt3 from anti-influenza_Chain
  source 1..615: mol_type = other RNA
ggcctgttcggggccatcgctggatttattgagggtggctggaccgggatggtggacggatggtacggctatcaccatcagaacgaacaaggtagcgggtacgcagccgatctcaagtccacacagaatgcgatagacgagatcactaacaaagtcaattctgttattgaaaagatgaacacgcagttcaccgctgtgggaaaagagtttaatcaccttgaaaagagaatcgagaacctgaataaaaagattgatgacggcttcttggatatctggacatataacgccgagttactggtactactcgaaaatgagaggactctggactaccatgattcaaacgtgaagaatctttatgaaaaagtccggagtcagctgaagaacaatgcaaaagagataggcaacgggtgctttgagttctaccacaagtgtgacaatacctgcatggaaagcgtgaaaaacggaacatatgattaccccaagtactccgaggaagccaagttgaaccgcgaggaaatcgacggtgttaaactcgagtctacccgaatttatcaaatcctggctatttactcgactgtggcatcaagcctggtcctcgtggtaagtttaggcgcc

SEQ ID NO: 28031 - RNA, 639 nt, synthetic construct
  misc_feature 1..639: note = derived and/or modified sequence opt3 from anti-influenza_Chain
  source 1..639: mol_type = other RNA
gagatcgtgctgacccagagccccggcacactctccctttctcctggggaaagagccactctgtcatgcagggctagtcaacgggtcagctcctacttggcatggtatcagcagaagccaggacaggccccgcgcttactgatttacggtgcgtctacgcgagctgccggcatacccgaccgtttctcggggtcaggaagcggcaccgattttacactaactatcagtagactcgagcctgaagactccgcagtttattactgtcaacagtatggtaggaccccactgacattcgggggaggcaccaaagtggagattaagcgggccgctgcaccctctgtatttatcttccctccaagcgatgaacagcttaaatccggcactgcctcagtggtctgcctgttgaacaatttttacccccgcgaggctaaggtgcagtggaaagttgacaacgccctccaaagtgggaatagccaggagtctgtgacagaacaggattccaaggactcaacctatagcctgagttctacgctgactctctccaaggcggattacgagaaacacaaggtctacgcatgtgaagtgacccatcagggattaagctcgcctgtaacaaaatctttcaacagaggtgagtgc

SEQ ID NO: 28032 - RNA, 639 nt, synthetic construct
  misc_feature 1..639: note = derived and/or modified sequence opt3 from anti-influenza_Chain
  source 1..639: mol_type = other RNA
gacatccagatgacccaaagcccctcctctctgtcagccagtctcggcgggaacgtgacaattacttgcaaggctagccaggatataaataaatacatcgcatggtatcagcacaagcctggaaaaggtccaagacttgtcattcattacacgtccaccctgcagccgggcatcccctctaggttctcggggtcaggaagcggcacagactatagtttttccatttctaacttggagcctgaagatatcgccacttactattgtttacaatacgacatactgtataccttcggtgggggaacaaagctagagatcaaacgggcggatgctgccccaaccgttagcatttttcccccttcctcagaacagctcacaagtggcggcgcaagcgtggtatgcttcctgaataacttttacccaaaggacatcaatgtgaagtggaaaattgatgggtctgagcgccagaacggagtccttaattcctggactgaccaggattcaaaggacagcacctacagtatgtcttccacgctgactttgaccaaagatgaatatgagcgacacaacagctacacatgtgaggccactcataagacctcgacatctcccatcgtgaaatccttcaatcgtaacgaatgc

SEQ ID NO: 28033 - RNA, 642 nt, synthetic construct
  misc_feature 1..642: note = derived and/or modified sequence opt3 from anti-influenza_Chain
  source 1..642: mol_type = other RNA
gacatccagatgacccaaagcccctcctctctgtcagccagtgtgggcgatagagtcacaattacttgcagggctagccaggggatatcctcttacctcgcatggtatcagcagaaacctggaaaagttccaacgcttctgatctacgacgcctcgaccttgcggtcaggtgtgccgagccgcttcagtggctccgggtctgcgacagattttactttaaccattagctccctgcaacccgaggacgtagctacatattactgtcagcgatataactcagcccctccaatcaccttcggacagggcactcgtctagaaattaagagagcagccgctcccagtgtgtttatcttccctccaagcgatgagcagctcaaatctggtacagcatccgtcgtgtgcctgcttaataacttttaccccagggaagccaaggttcaatggaaagtggacaatgctctgcagtcagggaacagccaggagagtgtcaccgaacaggattctaaggactccacgtatagcttgtcgtctactctcaccctgtccaaggccgattacgagaaacacaaggtgtacgcgtgtgaggtaacacatcaaggactgtcaagtcctgttactaagagcttcaatcggggcgaatgc

SEQ ID NO: 28034 - RNA, 642 nt, synthetic construct
  misc_feature 1..642: note = derived and/or modified sequence opt3 from anti-influenza_Chain
  source 1..642: mol_type = other RNA
gagatcgtgctgacccagagccccggcacactctccctttctcctggggaaagagccactctgtcatgcagggctagtcaaagcgtctcctcttcgtacttggcatggtatcagcagaaaccaggacaggccccgcggttactgatttacggtgcgtcaagccgcgctacgggcatacccgaccgattcagtgggtccggatctggcaccgattttacactaactatcagccgtctcgagcctgaagacttcgccgtttattactgtcaacagtatggttcctcaccaagaacctttgggggaggcacaaaagtggagattaagagggcagccgctcccagtgtattcatctttcctccaagcgatgaacagctgaaatctggcaccgcatccgtggtctgccttctgaacaatttctacccccgggaggccaaggtgcagtggaaagttgacaacgctttgcaatcagggaatagccaggagagtgtgactgaacaggattctaaggactccacatatagcctctcgtctaccctgacgctgtccaaggccgattacgagaaacacaaggtctacgcgtgtgaagtgactcatcagggactctcaagtcctgtaaccaagagctttaaccgcggtgagtgc

SEQ ID NO: 28035 - RNA, 642 nt, synthetic construct
  misc_feature 1..642: note = derived and/or modified sequence opt3 from anti-influenza_Chain
  source 1..642: mol_type = other RNA
agctacgtgctgacccagcccccttccgtctctgttgccccaggcgagacagctactgtgacgtgcgggggaaacaatatcggttcaaagagtgtacactggtatcaacagaaaccgggccaggcacccgtggtcgtgatttactatgacggggatagacctagcggaataccagaaaggttctccggctctaactcgggtgacaccgccacactcactatctcacgggttgaggcgggggatgaagctgactactattgtcttgtgtgggattacaccagcgtccattatgtgtttggaacaggcaccaaggtaactgttctgggccagcccaaagccaatcctacagtgaccttgttcccacccagttccgaggaattacaagcaaacaaggccacgctggtctgcctaatttctgacttttaccctggggctgtgactgtggcatggaaagccgatggaagcccagtcaaggctggtgttgagaccacaaagccgtccaaacagtcaaataacaagtacgccgcgagtagctatctctctctgactcccgagcagtggaaatcccaccgctcatacagctgtcaggtgacccatgaaggcagtacagtagagaagaccgtggcacctacggaatgctct

SEQ ID NO: 28036 - RNA, 642 nt, synthetic construct
  misc_feature 1..642: note = derived and/or modified sequence opt3 from anti-influenza_Chain
  source 1..642: mol_type = other RNA
gacatccagatgacccaaacaagctcctctctgtcagccagtctcggcgatagagtgactattagctgcagggcttcccaggacatacggaactaccttaattggtatcagcagaagcccgatgggacggtcaaactgttgatctactatacctctcgcttacactcgggagttccttcacgattcagcgacagtggttccggcacagattactctctgactattagcaacctagagcaagaagacctcgcaacctatttttgtcagcagacatacaccctgccatggactttcgggggaggcacaaaacttgagatcaagcgtgccgatgcggctccgaccgtgtccatttttcccccttcaagtgaacagctgacgagcggtggggcctctgtagtgtgcttcttgaataacttttatccaaaggacatcaatgtcaaatggaagatagatggatccgagagacaaaacggcgtgctcaattcatggactgaccaggatagcaaggacagtacctactctatgtccagcacactgactctgaccaaagatgaatacgagaggcataactcgtatacatgtgaggcaacccacaagacgtctacttcccccatcgttaaatcattcaatcggaacgaatgc

SEQ ID NO: 28037 - RNA, 645 nt, synthetic construct
  misc_feature 1..645: note = derived and/or modified sequence opt3 from anti-influenza_Chain
  source 1..645: mol_type = other RNA
gacggcgtgaagcccctgatcctcagagattgcagcgtcgccgggtggcttctgggaaaccctatgtgtgacgagttcattaatgttccagaatggtcctacatagtggagaaagctaacccggcaaatgatttgtgctatcccggtaactttaatgactacgaagagttaaagcatctgctatctaggatcaaccacttcgagaaaattcagatcattcctaagtcaagttggagcgatcacgaagcctcctctggcgtatcgtcagcgtgtccatatcaagggacccccagctttttccggaatgtggtctggctcatcaaaaagaacaatacataccctactataaagcgcagttataacaatacgaaccaggaggacctgcttatcctgtggggcattcatcactccaatgatgctgccgaacagaccaaattgtaccagaacccaacaacttatatctctgtgggaaccagcacactcaatcaacgactggttcccaagattgcaacccgttccaaagtgaacggtcagaacgggagaatggactttttctggactatcctgaagcctaatgatgccataaactttgagtcaaatggaaacttcattgctccagaatacgcatacaaaatcgtcaagaag

SEQ ID NO: 28038 - RNA, 645 nt, synthetic construct
  misc_feature 1..645: note = derived and/or modified sequence opt3 from anti-influenza_Chain
  source 1..645: mol_type = other RNA
gacatccagatgacccaaagcccctccacactgtctgcctcagtgggcgatagagtcactattacgtgcagggctagtcagaccataaacaattacctcgcatggtatcagcagaagcctgggaaagccccaaaacttctgatctacaaggcgagctccttggagtctggagttccgtcgcggttctcaggtagcggcagtgggacagaatttactttaaccatttcctctctgcaacccgacgatttcgctacatattactgtcaggagtataacaatgacagccctctaacctttggaggcggtactaaggtggaaatcaaacgcacagtagccgcaccatccgtgttcatttttcccccttcagatgagcagctcaagagtgggaccgccagcgtcgtgtgcctgcttaacaatttctacccacgagaagctaaggttcagtggaaagtggacaacgcactgcaatctggaaattcccaggagtcagtcacggagcaggatagcaaggacagtacttattctttgtccagcaccctcacactgtcgaaagccgattacgaaaagcacaaagtgtacgcttgtgaggtaactcatcagggcctgtcttcccccgttaccaagtcatttaaccgtggcgaatgc

SEQ ID NO: 28039 - RNA, 645 nt, synthetic construct
  misc_feature 1..645: note = derived and/or modified sequence opt3 from anti-influenza_Chain
  source 1..645: mol_type = other RNA
agcgtgctgacccagcccccttccgcctctggctcaagagggcaaagtatcacaattagctgcactggatccacgtctgacataggttcgtacaactatgtctcatggtaccagcagcacccaggcaccgctccgaaggttatcctctatgaggtgagccagaggcccagtggggtacctgatcggttctccggatctaaaagcggcaatacagcatttcttactgtgtccggtctgcaagccgaagacgaggcggattactattgtgcttcatacgccgggaacaatatttatgtcttcggaagtggcaccaaggtgacagttttgggccagccaaaagcaaaccccaccgtgactttatttcctccaagctctgaggaactgcaggccaataaggctaccctagtctgcctcatctccgacttctaccccggggcagtgacagtagcctggaaagctgattcaagccctgttaaggccggagtggaaacgactaccccaagtaagcagtctaacaataaatacgcggcatccagctatctgtcgcttacaccggagcaatggaagtctcataaatcctactcatgtcaggtcactcacgagggtagtaccgtggaaaagacagtggcccccaccgagtgcagc

SEQ ID NO: 28040 - RNA, 645 nt, synthetic construct
  misc_feature 1..645: note = derived and/or modified sequence opt3 from anti-influenza_Chain
  source 1..645: mol_type = other RNA
agcgccctgacccagcccccttccgcttctggctcaagagggcaaagtatcacaattagctgcactggatccacgtctgacataggttcgtacaactatgtgtcatggtaccagcagcacccaggcaccgcaccgaaggtcatcctctatgaggttagccagaggcccagtggggtgcctgatcggttctccggatctaaaagcggcaatacagcctttcttactgtatccggtctgcaagcggaagacgaggctgattactattgtgcctcatacgcagggaacaatatttatgtgttcggaagtggcaccaaggtcacagtgttgggccagccaaaagccaaccccaccgttactttatttcctccaagctctgaggaactgcaggctaataaggcaaccctagtgtgcctcatctccgacttctaccccggggccgtcacagtggcttggaaagccgattcaagccctgtaaaggcgggagttgaaacgactaccccaagtaagcagtctaacaataaatacgcagcctccagctatctgtcgcttacaccggagcaatggaagtctcataaatcctactcatgtcaggtgactcacgagggtagtaccgtcgaaaagacagtggctcccaccgagtgcagc

SEQ ID NO: 28041 - RNA, 648 nt, synthetic construct
  misc_feature 1..648: note = derived and/or modified sequence opt3 from anti-influenza_Chain
  source 1..648: mol_type = other RNA
cagagcgtgctgacccaacccccttccgagtctgtctcaccaggccagacagccagtgttacttgcagcgggcacaagctcggagacaaatacgtgtcctggtatcagcagaagccgggtcaatctcccgtacttctgatctaccaggataacagaaggccttcgggcattccagaacggttcatagggtcaaatagcggaaacacggctaccttgacaatcagtggcactcaggcattagacgaggccgattattactgtcaggcgtgggactcctctaccgctgtgtttggtgggggaacaaaactgaccgtcctaggcgccgcagccggccaacccaaggctgcacctagcgtgactctcttcccaccctcctcagaggaactgcaggccaataaagctacacttgtttgcctgattagtgatttttatcctggggccgtgaccgtcgcgtggaaggcagacagctctccagtgaaggccggagtagaaacgactaccccgtccaaacagtcaaacaataagtacgctgccagcagttatttgtctctcacacccgagcagtggaaatcccatcgcagctactcgtgtcaagttactcacgagggttctaccgtggaaaagacagtcgcacctaccgagtgctcc

SEQ ID NO: 28042 - RNA, 648 nt, synthetic construct
  misc_feature 1..648: note = derived and/or modified sequence opt3 from anti-influenza_Chain
  source 1..648: mol_type = other RNA
cagagcgccctgacccaacccgcttccgtgtctggctcacctgggcagagtatcacaattagctgcactggaacgtcctctgacgtcggttcgtacaacctcgtttcatggtatcagcagcacccaggcaaggcaccgaaacttatgatatacgaggtgagcaagagacccagtggggtatccaataggttctctggaagcaaatccggcaacaccgcctcactgacaatcagtggtttgcaagcggaagatgaggctgactattactgtcatttatatgtggggagctctaattgggtctttggaggcggcactaagctggccgtgctagggcagcctaaagcagccccatccgttaccctctttcccccttcaagcaaggaactgcaggctaacaaggcaacacttgtgtgcccaattagtgatttctaccccggagccgtcaccgtggcttggaaagccgactcttcccctgtaaaggcgggtgttgagactacaaccccaagcaaacagtcgaataacaagtatgcagcctcttcctacctgtcattgacgccggaacaatggaaaagtcacaagagctactcctgtcaggtgactcatgagggctctaccgtcgagaagacagtggctcccactgaatgcagc

SEQ ID NO: 28043 - RNA, 648 nt, synthetic construct
  misc_feature 1..648: note = derived and/or modified sequence opt3 from anti-influenza_Chain
  source 1..648: mol_type = other RNA
gagatcgtgctgacccagagccccgccacactctccgtctctcctggcgaaagagctactctttcatgcagggcaagtcaaagcgttgactccaacctggcctggtaccagcagaagccagggcaggcgccgcggttgttagtgtattctgcttcgacgcgcgccaccggtattcccgcacgattctcaggaagcggcagtgggacagagtttactctggccatatcctctctacaaagcgaagatttcgctgtatactattgtcagcactacaccaattggcctccacgtctcacatttggaggcggttccaaagtggagatcaagagaaccgtcgcagccccctcagtgttcatttttcctccaagtgacgaacagctgaaaagcgggactgcttctgttgtgtgccttctgaacaatttctatcccagggaggccaaggtccagtggaaagtggataacgcgttgcaatccggaaattcacaggagagcgtaacagaacaggacagtaaggattctacctactccctcagctcgacgctgactctgtctaaggcagactatgagaaacataaggtttacgcctgtgaagtgacccaccagggcctctcctcacctgtcacaaaaagttttaaccggggcgagtgc

SEQ ID NO: 28044 - RNA, 648 nt, synthetic construct
  misc_feature 1..648: note = derived and/or modified sequence opt3 from anti-influenza_Chain
  source 1..648: mol_type = other RNA
gagatcgtgctgacccagagccccgccacactctccgtctctcctggcgaaagagctactctttcatgcagggcaagtcaaagcgtttcccacaacctggcctggtaccagcagaagccagggcaggcgccgcggttgttagtgtattctgcttcgacgcgcgccaccggtattcccgcacgattctcaggaagcggcagtgggacagagtttactctggccatatcctctctacaaagcgaagacttcgctgtatactattgtcagcattacaccaattatcctccacgtctcacatttggaggcggttccaaagtggagatcaagagaaccgtcgcagccccctcagtgttcatttttcctccaagtgatgaacagctgaaaagcgggactgcttctgttgtgtgccttctgaacaatttctaccccagggaggccaaggtccagtggaaagtggacaacgcgttgcaatccggaaattcacaggagagcgtaacagaacaggatagtaaggactctacctattccctcagctcgacgctgactctgtctaaggcagattacgagaaacacaaggtttacgcctgtgaagtgacccatcagggcctctcctcacctgtcacaaaaagttttaaccggggcgagtgc

SEQ ID NO: 28045 - RNA, 648 nt, synthetic construct
  misc_feature 1..648: note = derived and/or modified sequence opt3 from anti-influenza_Chain
  source 1..648: mol_type = other RNA
gagatcgtgatgacccagagccccgccacactgtccgtctctcctggcgaaagagctactctctcatgcagggcaagtcaaagcgttgactccaaccttgcctggtaccagcagaagccagggcaggcgccgcggctgttggtgtattctgcttcgacgcgcgccaccggtattcccgcacgattctcaggaagcggcagtgggacagagtttactttagccatatcctctctgcaaagcgaagatttcgctgtatactattgtcagcactacaccaattggcctccacgtctaacatttggaggcggttccaaagtggagatcaagagaaccgtcgcagccccctcagtgttcatttttcctccaagtgacgaacagctcaaaagcgggactgcttctgttgtgtgcctgcttaacaatttctatcccagggaggccaaggtccagtggaaagtggataacgcgctgcaatccggaaattcacaggagagcgtaacagaacaggacagtaaggattctacctactccttgagctcgacgctcactctgtctaaggcagactatgagaaacataaggtttacgcctgtgaagtgacccaccagggcctgtcctcacctgtcacaaaaagttttaaccggggcgagtgc

SEQ ID NO: 28046 - RNA, 648 nt, synthetic construct
  misc_feature 1..648: note = derived and/or modified sequence opt3 from anti-influenza_Chain
  source 1..648: mol_type = other RNA
gagatcgtgctgacccagagccccgccacactctccgtctctcctggcgaaagagctactctttcatgcagggcaagtcaaagcgtttcctctaacctggcctggtaccagcagaaaccagggcaggcgccgcggttgttagtgtattcggcttcaacgcgcgccaccggtattcccgcacgattcagcggaagtggctccgggacagagtttactctggccatatctagcctacaatccgaagacttcgctgtatactattgtcagcactacaccaattggcctccacgtctcacatttggaggcggttcaaaagtggagatcaagagaaccgtcgcagcccccagtgtgttcatttttcctccaagcgatgaacagctgaaatctgggactgcttccgttgtgtgccttctgaacaatttctatcccagggaggccaaggtccagtggaaagtggacaacgcgttgcaatcaggaaatagccaggagagtgtaacagaacaggattctaaggactccacctacagcctctcgtctacgctgactctgtccaaggcagattatgagaaacataaggtttacgcctgtgaagtgacccaccagggcctctcaagtcctgtcacaaagagctttaaccggggcgagtgc

SEQ ID NO: 28047 - RNA, 648 nt, synthetic construct
  misc_feature 1..648: note = derived and/or modified sequence opt3 from anti-influenza_Chain
  source 1..648: mol_type = other RNA
gagatcgtgctgacccagagccccgccacactctccgtctctcctggcgaaagagctactctttcatgcagggcaagtcaaagcgttgaccacaacctggcctggtaccagcagaagccagggcaggcgccgcggttgttagtgtattccgcttctacgcgcgccaccggtattcccgcacgattctcgggatcaggcagcgggacagagtttactctggccataagttccctacaatctgaagatttcgctgtatactattgtcagcattacaccaattggcctccacgtctcacatttggaggcggtagcaaagtggagatcaagagaaccgtcgcagccccctccgtgttcatttttcctccatcagacgaacagctgaaaagtgggactgctagcgttgtgtgccttctgaacaatttctatcccagggaggccaaggtccagtggaaagtggataacgcgttgcaatctggaaattcccaggagtcagtaacagaacaggacagcaaggatagtacctactctctctccagcacgctgactctgtcgaaggcagactatgagaaacacaaggtttacgcctgtgaagtgacccatcagggcctctcttcccctgtcacaaaatcatttaaccggggcgagtgc

SEQ ID NO: 28048 - RNA, 648 nt, synthetic construct
  misc_feature 1..648: note = derived and/or modified sequence opt3 from anti-influenza_Chain
  source 1..648: mol_type = other RNA
gagatcgtgctgacccagagccccgccacactctccgtctctcctggcgaaagagctactctttcatgcagggcaagtcaaagcgtttcccacaacctggcctggtaccagcagaagccagggcaggcgccgcggttgttagtgtattctgcttcgacgcgcgccaccggtattcccgcacgattctcaggaagcggcagtgggacagagtttactctggccatatcctctctacaaagcgaagacttcgctgtatactattgtcagcattacaccaattggcctccacgtctcacatttggaggcggttccaaagtggagatcaagagaaccgtcgcagccccctcagtgttcatttttcctccaagtgatgaacagctgaaaagcgggactgcttctgttgtgtgccttctgaacaatttctatcccagggaggccaaggtccagtggaaagtggacaacgcgttgcaatccggaaattcacaggagagcgtaacagaacaggatagtaaggactctacctactccctcagctcgacgctgactctgtctaaggcagattatgagaaacacaaggtttacgcctgtgaagtgacccatcagggcctctcctcacctgtcacaaaaagttttaaccggggcgagtgc

SEQ ID NO: 28049 - RNA, 648 nt, synthetic construct
  misc_feature 1..648: note = derived and/or modified sequence opt3 from anti-influenza_Chain
  source 1..648: mol_type = other RNA
gagatcgtgctgacccagagccccgccacactctccgtctctcctggcgaaagagctactctttcatgcagggcaagtcaaagcgtttcccacaacctggcctggtaccagcagaagccagggcaggcgccgcggttgttagtgtattctgcttcgacgcgcgccaccggtattcccgcacgattctcaggaagcggcagtgggacagagtttactctggccatatcctctctacaaagcgaagacttcgctgtatactattgtcagcattacaccaattttcctccacgtctcacattcggaggcggttccaaagtggagatcaagagaaccgtcgcagccccctcagtgtttattttccctccaagtgatgaacagctgaaaagcgggactgcttctgttgtgtgccttctgaacaatttttatcccagggaggccaaggtccagtggaaagtggacaacgcgttgcaatccggaaattcacaggagagcgtaacagaacaggatagtaaggactctacctactccctcagctcgacgctgactctgtctaaggcagattatgagaaacacaaggtttacgcctgtgaagtgacccatcagggcctctcctcacctgtcacaaaaagtttcaaccggggcgagtgc

SEQ ID NO: 28050 - RNA, 648 nt, synthetic construct
  misc_feature 1..648: note = derived and/or modified sequence opt3 from anti-influenza_Chain
  source 1..648: mol_type = other RNA
gagatcgtgctgacccagagccccgccacactctccgtctctcctggcgaaagagctactctttcatgcagggcaagtcaaagcgttgactccaacctggcctggtaccagcagaagccagggcaggcgccgcggttgttagtgtattctgcttcgacgcgcgccaccggtattcccgcacgattctcaggaagcggcagtgggacagagtttactctggccatatcctctctacaaagcgaagatttcgctgtatactattgtcagcactacaccaattttcctccacgtctcacattcggaggcggttccaaagtggagatcaagagaaccgtcgcagccccctcagtgtttattttccctccaagtgacgaacagctgaaaagcgggactgcttctgttgtgtgccttctgaacaatttttatcccagggaggccaaggtccagtggaaagtggataacgcgttgcaatccggaaattcacaggagagcgtaacagaacaggacagtaaggattctacctactccctcagctcgacgctgactctgtctaaggcagactatgagaaacataaggtttacgcctgtgaagtgacccaccagggcctctcctcacctgtcacaaaaagtttcaaccggggcgagtgc

SEQ ID NO: 28051 - RNA, 648 nt, synthetic construct
  misc_feature 1..648: note = derived and/or modified sequence opt3 from anti-influenza_Chain
  source 1..648: mol_type = other RNA
gagatcgtgctgacccagagccccgccacactctccgtctctcctggcgaaagagctactctttcatgcagggcaagtcaaagcgttgactccaacctggcctggtaccagcagaagccagggcaggcgccgcggttgttagtgtattctgcttcgacgcgcgccaccggtattcccgcacgattctcaggaagcggcagtgggacagagtttactctggccatatcctctctacaaagcgaagatttcgctgtatactattgtcagcactacaccaattatcctccacgtctcacatttggaggcggttccaaagtggagatcaagagaaccgtcgcagccccctcagtgttcatttttcctccaagtgacgaacagctgaaaagcgggactgcttctgttgtgtgccttctgaacaatttctaccccagggaggccaaggtccagtggaaagtggataacgcgttgcaatccggaaattcacaggagagcgtaacagaacaggacagtaaggattctacctattccctcagctcgacgctgactctgtctaaggcagactacgagaaacataaggtttacgcctgtgaagtgacccaccagggcctctcctcacctgtcacaaaaagttttaaccggggcgagtgc

SEQ ID NO: 28052 - RNA, 648 nt, synthetic construct
  misc_feature 1..648: note = derived and/or modified sequence opt3 from anti-influenza_Chain
  source 1..648: mol_type = other RNA
gagaccacactgactcagagccccgccacgctctccgtgtctcctggcgaacgggctaccctttcatgcagggcaagtcaagtcatcagccacaacctggcctggtaccagcagaagccagggcaggcgccgcggttgttaatttatggagcttccacacgcgcctctggtatacccgcacgattctcgggctcagggagcggaactgactacaccctgacaatcaccagtctacaatccgaggattttgccgtttattactgtcagcattattctaattggcctccacgtctcactttcggcggtgggacaaaagtggaaattaagagaaccgtagctgcacccagcgtgtttatcttccctccatccgacgagcagctgaaatcaggaacggccagtgtcgtgtgccttctgaacaatttttaccccagggaagctaaggttcagtggaaagtggataacgccttgcaaagcggcaattctcaggagtccgtcactgagcaggactcaaaggatagcacctatagtctctcttccacactgactctgagcaaggcggactacgaaaaacacaaggtgtacgcatgtgaggtaacccatcagggcctctcgtctcctgttacaaaatccttcaacagaggggaatgc

SEQ ID NO: 28053 - RNA, 648 nt, synthetic construct; identical to SEQ ID NO: 23934
  misc_feature 1..648: note = derived and/or modified sequence opt3 from anti-influenza_Chain
  source 1..648: mol_type = other RNA

SEQ ID NO: 28054 - RNA, 648 nt, synthetic construct
  misc_feature 1..648: note = derived and/or modified sequence opt3 from anti-influenza_Chain
  source 1..648: mol_type = other RNA
gagatcgtgctgacccagagccccgccacactctccgtctctcctggcgaacgggctactctttcatgcagggcaagtcaagttattagccacaacctggcctggtaccagcagaagccagggcaggcgccgcggttgttaatatatggagcttccacgcgcgcctctggtatccccgcacgattctcgggctcagggagcggaaccgactacacactgactattaccagtctacaacctgaggattttgccgtgtattactgtcagcattattccaattggccaccccgtctcacattcggcggtgggaccaaagtagaaatcaagagaactgtggctgcaccttctgtcagcatttttccaccctccgacgagcagctgaaatcaggaacagccagtgtggtttgccttctgaacaatttctaccctagggaagctaaggtgcagtggaaagtcgataacgccttgcaaagcggcaattctcaggagtccgtgaccgagcaggactcaaaggatagcacgtatagtctctcttccactctgaccctgagcaaggcggactacgaaaaacacaaggtatacgcatgtgaggttacacatcagggcctctcgtctccagtgactaaatcctttaacagaggggaatgc

SEQ ID NO: 28055 - RNA, 648 nt, synthetic construct
  misc_feature 1..648: note = derived and/or modified sequence opt3 from anti-influenza_Chain
  source 1..648: mol_type = other RNA
gagatcgtgatgacccagagccccgccacactgtccgtctctcctggcgaacgggctactctctcatgcagggcaagtcaagttattagccacaaccttgcctggtaccagcagaagccagggcaggcgccgcggctgttgatatatggagcttccacgcgcgcctctggtatccccgcacgattctcgggctcagggagcggaaccgactacacattaactattaccagtctgcaatccgaggattttgccgtgtattactgtcagcattattctaattggcctccacgtctaacattcggcggtgggaccaaagtagaaatcaagagaactgtggctgcacccagcgtctttattttccctccatccgacgagcagctcaaatcaggaacagccagtgtggtttgcctgcttaacaatttttaccccagggaagctaaggtgcagtggaaagtcgataacgccctgcaaagcggcaattctcaggagtccgtgaccgagcaggactcaaaggatagcacgtatagtttgtcttccactctcaccctgagcaaggcggactacgaaaaacacaaggtatacgcatgtgaggttacacatcagggcctgtcgtctcctgtgactaaatccttcaacagaggggaatgc

SEQ ID NO: 28056 - RNA, 648 nt, synthetic construct
  misc_feature 1..648: note = derived and/or modified sequence opt3 from anti-influenza_Chain
  source 1..648: mol_type = other RNA
gagatcgtgctgacccagagccccgccacactctccgtctctcctggcgaacgggctactctttcatgcagggcaagtcaagttattagccacaacctggcctggtaccagcagaagccagggcaggcgccgcggttgttaatatatggagcttccacgcgcgcctctggtatccccgcacgattctcgggctcagggagcggaaccgactacacactgactattaccagtctacaatccgaggattttgccgtgtattactgtcagcattattctaatttccctccacgtctcacatttggcggtgggaccaaagtagaaatcaagagaactgtggctgcacccagcgtcttcatttttcctccatccgacgagcagctgaaatcaggaacagccagtgtggtttgccttctgaacaatttctaccccagggaagctaaggtgcagtggaaagtcgataacgccttgcaaagcggcaattctcaggagtccgtgaccgagcaggactcaaaggatagcacgtatagtctctcttccactctgaccctgagcaaggcggactacgaaaaacacaaggtatacgcatgtgaggttacacatcagggcctctcgtctcctgtgactaaatcctttaacagaggggaatgc

SEQ ID NO: 28057 - RNA, 648 nt, synthetic construct
  misc_feature 1..648: note = derived and/or modified sequence opt3 from anti-influenza_Chain
  source 1..648: mol_type = other RNA
gagatcgtgctgacccagagccccgccacactctccgtctctcctggcgaacgggctactctttcatgcagggcaagtcaagttattagccacaacctggcctggtaccagcagaagccagggcaggcgccgcggttgttaatatatggagcttccacgcgcgcctctggtatccccgcacgattctcgggctcagggagcggaaccgactacacactgactattaccagtctacaatccgaggattttgccgtgtattactgtcagcattattctaattaccctccacgtctcacattcggcggtgggaccaaagtagaaatcaagagaactgtggctgcacccagcgtctttattttccctccatccgacgagcagctgaaatcaggaacagccagtgtggtttgccttctgaacaatttttatcccagggaagctaaggtgcagtggaaagtcgataacgccttgcaaagcggcaattctcaggagtccgtgaccgagcaggactcaaaggatagcacgtacagtctctcttccactctgaccctgagcaaggcggactacgaaaaacacaaggtatatgcatgtgaggttacacatcagggcctctcgtctcctgtgactaaatccttcaacagaggggaatgc

SEQ ID NO: 28058 - RNA, 648 nt, synthetic construct
  misc_feature 1..648: note = derived and/or modified sequence opt3 from anti-influenza_Chain
  source 1..648: mol_type = other RNA
gagatcgtgctgacccagagccccgccacactctccgtctctcctggcgaaagagttactctttcatgcagggctagtcaaagcgtggcaaacaatctggcctggtaccagcagaagccagggcagtccccgcggttgttaatttatggagcgtctacgcgcgacaccggtatacccgctcgattctcgggctcagggagcggaacagagtttactctgaccatcagttccctacaatctgaagatttcgccgtatactattgtcagcagtacaacaattggcctccaatgtatacatttggccagggtaccaaactcgagattaagcgtactgtggcagcccccagcgtcttcatctttcctccatccgacgaacaactgaaatcagggacagctagtgtggtttgccttctgaacaatttctaccccagagaggcaaaggtgcagtggaaagtcgataacgccttgcagagcggaaattctcaggagtccgtgaccgaacaagactcaaaggatagcacgtatagtctctcttccactctgaccctgagcaaggctgactacgagaaacacaaggtatacgcctgtgaagttacacatcagggcctctcgtctcctgtgactaaatcctttaacaggggcgagtgc

SEQ ID NO: 28059 - RNA, 648 nt, synthetic construct
  misc_feature 1..648: note = derived and/or modified sequence opt3 from anti-influenza_Chain
  source 1..648: mol_type = other RNA
gacatcgtgatgacccagagcccctccacactgtctgcctcagtcggcgatagagttactattacgtgcagggctagtcaaagcatagggaactggctcgcatggtaccagcagaagcctggaaaagccccaaaacttctgatctataaggtgtccaccttggagtctggtgtaccgtcgcggttctcaggcagcgggagtggaacagaatttactttaaccattaattccctgcagcccgacgatttcgcgacatactattgtcaacgctacacctctaacagccagggctttactttcggtcaggggacaaagctagagatcaaacgaaccgtggctgccccttccgtctttattttcccaccctcagacgaacagctcaagagtggaacggcaagcgtggtttgcctgcttaataacttttatcctcgtgaggccaaggtgcaatggaaagtcgataatgctctgcagtctggcaactcccaggaatcagtgactgagcaggacagcaaggatagtacctactctttgtccagcacactcactctgtcgaaagcagactatgagaagcacaaagtatacgcctgtgaagttacccatcaaggcctgtcttccccagtgacaaagtcattcaatagaggggagtgc

SEQ ID NO: 28060 - RNA, 648 nt, synthetic construct
  misc_feature 1..648: note = derived and/or modified sequence opt3 from anti-influenza_Chain
  source 1..648: mol_type = other RNA
gacatccagctgacccaaagccccctctcccctccagtgacacttggccagccggcctctatttcatgcagaagtagccagtccctgttgtacactgatgggttcacgtatttatcttggtaccaccagaggcccggacaatcgcctcggcgcctgatatataagatctcaaaccgagacagcggtgtcccagatcgttttagtggctccgggtctggaaccgacttcacactaaaaattagcagagttgaggctgaagatgtgggcgtatactattgtatgcaggcaactcattggcccctcacctttggtgaggggacaaaggtggaaatcaaacctaaggccgcgccatccgtcaccctgtttcccccttcaagtgaggaacttcaggctaataaagccactctggtgtgcttgattagcgacttctacccaggagcagttacagtggcctggaaggctgattcttccccggtcaaggcaggcgtggagaccacgactccctcaaaacagagcaacaataagtatgccgctagttcttacctctccctgacccctgagcaatggaaaagccacaagtcgtactcttgtcaggtaacacatgaaggctccactgttgagaaaaccgtggccccaacagaatgctca

SEQ ID NO: 28061 - RNA, 648 nt, synthetic construct
  misc_feature 1..648: note = derived and/or modified sequence opt3 from anti-influenza_Chain
  source 1..648: mol_type = other RNA
gagatcgtgctgacccagagccccggcacactctccctttctcctggggaaagagccactctgtcatgcagggctagtcaaagcgtccggtccaacaatttggcatggtaccagcacaagccaggacaggccccgcgcttactgattttcggtgcgtcttcgcgagctacgggcatacccgaccgtttttcagggagcggaagtggcaccgatttcacactaactatctccagactcgagcctgaagactttgccgtttattactgtcagcaatatggttctagcccagcactgaccttcgggggaggcacaaaagtggagattaagaggaccgtagccgctccctccgtgtttatcttccctccatcagatgaacagcttaaaagtggcactgcaagcgtcgtgtgcctgttgaacaatttttacccccgggaggccaaggttcagtggaaagtggacaacgctctccagtctggaaattcccaagagtcagtcacagaacaggatagcaaggacagtacctattctctgtccagcacgctgactctctcgaaggccgattacgagaaacataaggtgtatgcgtgtgaagtaacccaccaggggttatcttcccctgttacaaaatcattcaaccgcggtgagtgc

SEQ ID NO: 28062 - RNA, 648 nt, synthetic construct
  misc_feature 1..648: note = derived and/or modified sequence opt3 from anti-influenza_Chain
  source 1..648: mol_type = other RNA
cagagcgtgctgacccaacccccttccgcctctggctcaagagggcagagtatcacaattagctgcactggatccacgtctgacataggttcgtacaactatgtctcatggtaccagcagcacccaggcaccgctccgaaggttatcctctatgaggtgagccaaaggcccagtggggtacctgatcggttctccggatctaaaagcggcaatacagcatttcttactgtgtccggtctgcagaccgacgatgaagccgactactattgtgcgtcatacgctgggaacaatatttatgtcttcggaagtggcacaaaggtgaccgttttgggccagccaaaagccaaccccactgtgacattatttcctccaagctctgaggaactgcaggcaaataaggccaccctagtctgcctcatctccgatttctaccccggggctgtgacggtagcatggaaagccgactcaagccctgttaaggctggagtggagactaccacaccaagtaagcaatctaacaataaatacgccgcgtccagctatctgtcgcttactccggaacagtggaagtctcataaatcctactcatgtcaggtcacccacgagggtagtacagtggagaagaccgtggcacccacggaatgcagc

SEQ ID NO: 28063 - RNA, 651 nt, synthetic construct
  misc_feature 1..651: note = derived and/or modified sequence opt3 from anti-influenza_Chain
  source 1..651: mol_type = other RNA
cagcccgtgctgacccaacctccaagcgcctccggctctccggggcagagagtcacaatctcatgcagtggaagctcctctaacattggttcgtacactgttaattggtatcagcagctccccggcacggctcctaaacttctgatatactcattgaaccaaaggccaagcggggtgcccgaccggttcagtggatccaagtctggcaccagcgcatccttagccatctcaggtctgcagagtgaggatgaagcggtatattactgtgctgcctgggacgatagcctatctgcacacgtggtctttgggggaggcacaaagctcactgtgctgggccagcctaaagccgctccatccgttaccctttttcccccttcaagcgaggaactgcaggcaaataaggccacattggtgtgcctcattagtgacttctatccaggggctgtcaccgtggcctggaaagcggattcttccccggtaaaggcaggagttgagactacaacccccagcaagcaatcgaacaataaatacgccgcttcttcctatctgtcactgacgcctgaacagtggaagagtcatcgcagctactcctgtcaggtgactcacgagggttctaccgtcgagaaaacagtggccccaactgaatgcagc

SEQ ID NO: 28064 - RNA, 651 nt, synthetic construct
  misc_feature 1..651: note = derived and/or modified sequence opt3 from anti-influenza_Chain
  source 1..651: mol_type = other RNA
cagcccgtgctgacccaacctccaagcgcctccggcacaccggggcagagagtcactatctcttgctcaggaagtagctccaacattggttctaatacggtttcgtggtaccaacaggtgcccggcaccgctcctaagctccttatatatgggaacaatgagaggccatcaggagtacccgaccggttcagcggcagtaaatccgcaacatctgccagcctggcgatctccggtttgcagtcagaagatgaggctgactactattgtgccgcatgggatgacagtttaaacgggttttgggtgttcggaggcggcactaagctgaccgtcctagggcagcctaaagccgctccaagcgtgacactctttcccccttcttccgaggaactgcaggcaaataaggccacccttgtttgcctgatttcagatttctacccaggagctgtgactgtcgcctggaaagcggacagcagtccggtgaaggccggtgtagaaacaaccacgccctctaagcagtccaacaataaatatgcagctagctcgtacttgtctctcactcctgagcaatggaagtcccacaaatcatatagttgtcaggttacccatgagggcagcacagtggaaaagactgtcgccccaaccgagtgctcc

SEQ ID NO: 28065 - RNA, 651 nt, synthetic construct
  misc_feature 1..651: note = derived and/or modified sequence opt3 from anti-influenza_Chain
  source 1..651: mol_type = other RNA
agctacgtgctgacccagcccccttccgtctctggcacaccagggcaaagagttatcatttcatgcagtggatatagctccaacataggttctaatactgtgaactggtaccagcagttcccgggcacggcccccaggctccttatctatgctaataaccagcggcctccaggggtacccgaccgcttttcgggatcaaagagcggcaccagtgcatccctggccatttctggtttgcaaagcgatgacgagtccgattactattgtgcggcttgggacgattcattaaatgggcactgggtgttcggaggcggcacaaaactgactgtcctagggcagcctaaggccgcaccaagtgtgaccctctttccccctagctctgaggaactgcaggccaacaaagctacacttgtttgcctgatctccgacttctacccaggagcagtgaccgtcgcctggaaggctgattcaagcccggtgaaagccggtgtagaaactacaacccccagtaagcagtctaataacaagtatgcggcatccagctacttgtcgctcacgcctgagcaatggaaatctcatcgatcctactcatgtcaggttactcacgaaggcagtaccgtggagaagacagtcgccccaactgagtgcagc

SEQ ID NO: 28066 - RNA, 654 nt, synthetic construct
  misc_feature 1..654: note = derived and/or modified sequence opt3 from anti-influenza_Chain
  source 1..654: mol_type = other RNA
agctacgtgctgacccagcccccttccgtctctgttgccccaggccaaacagctagaatcacttgcgggggaaacaatattggttcaaagagtgtgcactggtatcagcagaaaccgggccaggcacccgtactcgtggtctacgacgatagcgacaggccttccgggataccagagcggttctctggatcgaactcaggcaatacggccacccttacaatcagccgcgtggaagcgggtgatgaggctgactattactgtcaagtttgggatagttcctctgaccatgccgtgtttgggggaggcactcagctgaccgtcttgggcgcagccgctgggcagcccaaggcagcccctagcgtgacattattcccaccctcctcagaggaactgcaggctaacaaagccaccctagtatgcctcattagtgatttttatcctggagcggttactgtggcatggaaggccgacagctctccagtcaaagctggtgtggaaacaaccacgccgtccaagcaatcaaataacaagtacgccgcaagcagttatctgtctcttactcccgagcagtggaaatcccaccgaagctactcgtgtcaggtgacccatgagggctctacagtcgaaaagactgttgctcctaccgagtgctcc

SEQ ID NO: 28067 - RNA, 654 nt, synthetic construct
  misc_feature 1..654: note = derived and/or modified sequence opt3 from anti-influenza_Chain
  source 1..654: mol_type = other RNA
cagagcgtggtcacccaacccccttccgtttctgtggccccaggccagacagctagaatcacttgcgggggaaacaatattggttcaaagagtgtacactggtaccagcagaaaccgggccaagcacccgtgctggtcgtgtatgacgatagcgacaggccttccgggataccagagcggttctctggatcgaactcaggcaatacggccaccctcacaatcagccgcgttgaagcgggtgatgaggctgactactattgtcaggtgtgggatagttcctctgaccattacgtctttgggactggaaccaaggtgacagtacttggcgccgcagccggccagcccaaagctgcacctagcgttaccctgttcccaccctcctcagaagagttgcaggccaacaaggctactttagtgtgcctgattagtgatttttatcctggggccgtcacagtggcgtggaaagcagacagctctccagtgaaggccggagtcgaaaccacgactccgtccaagcaatcaaataacaaatacgctgccagcagttatctatctctcacccccgagcagtggaagtcccaccgaagctactcgtgtcaggttacacatgagggttctactgtggagaaaaccgtagcacctacagaatgctcc

SEQ ID NO: 28068 - RNA, 654 nt, synthetic construct
  misc_feature 1..654: note = derived and/or modified sequence opt3 from anti-influenza_Chain
  source 1..654: mol_type = other RNA
ctgagcagaatcaaccacttcgagaagattcagataatccccaagtcctcttggtcagaccatgaagccagtagcggcgtgtcctctgcttgcccttaccaagggaccccatcgtttttcaggaatgtcgtttggctcattaagaaaaacaatacatatccgactatcaagcggtcatacaacaatacgaaccaggaggatcttctgattttgtggggaatccaccatagcaatgacgcagccgaacagaccaaattatatcagaaccccacaacttacataagtgtgggtacctccacactgaatcaacgcctagtacctaagatcgcgacccgatctaaggtgaacggccagaatgggcgtatggactttttctggactattctcaaaccaaacgatgctatcaattttgagagcaacggaaatttcattgcccccgaatatgcatacaagatcgtcaaaaagggcgattccgccatagtgaaatcagaggttgagtatggtaactgtaacacaaagtgccagacccctattggggctatcaatagtagcatgccatttcacaacattcatcccctgacgatcggagaatgtcctaagtacgtgaaatctaataaacttgtcctggcaactggcttgagaaactccccactc

SEQ ID NO: 28069 - RNA, 657 nt, synthetic construct
  misc_feature 1..657: note = derived and/or modified sequence opt3 from anti-influenza_Chain
  source 1..657: mol_type = other RNA
agctccgagctgacccagcccccttctgcctcaggcacaccagggcaaagagtgactatcagttgcagcggatccacgtctaacattggttacaatccggtctcgtggtatcagcaggttcccggcaccgctcctaagctccttatatactcaaacacagaaaggccaagcggggtgcccgaccggttcagtggatccaaatctggcactagcgcatccctggccatctcaggtttgcagagtgaggatgaagcggactattactgtgctgcctgggatgacaccttaaatgggcctgtatttggaggcggcacaaaggtgaccgtcctggggcaacgcactgtggcagccccaagcgttttcatttttcccccttctgatgagcagctaaaatccggaacagcttcagtggtctgcctcctgaacaatttctatccacgagaagcaaaggtgcagtggaaagtagacaacgcccttcagagcggtaatagtcaagagtctgttaccgagcaggattccaaggacagcacgtactcgctgtcttccactttgaccctctcaaaggctgattatgaaaaacacaaggtgtacgcctgtgaggtcacacatcagggcctgagtagcccggtgactaaatcctttaaccgtggggaatgc

SEQ ID NO: 28070 - RNA, 657 nt, synthetic construct; identical to SEQ ID NO: 23950
  misc_feature 1..657: note = derived and/or modified sequence opt3 from anti-influenza_Chain
  source 1..657: mol_type = other RNA

SEQ ID NO: 28071 - RNA, 660 nt, synthetic construct
  misc_feature 1..660: note = derived and/or modified sequence opt3 from anti-influenza_Chain
  source 1..660: mol_type = other RNA
agctacgtgctgacccagcccccttccgcctctggcacaccagggcaaagagtcactatctcatgcagtggaagcacgttcaacattggttccaatgctgttgactggtataggcagctcccgggcaccgcacccaaacttctgatatactctaacaatcagcggccttcgggggtgccagatcgcttttcaggaagccgaagtggcacatccgcctctttggcgatcagcggtttacagtccgaggacgaagctgattattactgtgccgcatgggacgatattctgaacgtacccgtgttcgggggaggcactaagctaaccgtcctcggcgccgctgcagggcaacctaaggccgctccatcagtgacactgtttccccctagtagcgaggaacttcaggccaataaagcgaccctggtttgcttgatctctgacttctatccaggagcagtgactgtcgcctggaaggctgattcctcaccggtgaaagccggtgtagagacaaccacgcccagcaagcagagtaacaataagtacgcagcttcttcctatctcagcctgactcctgaacagtggaaatcgcaccgttcttactcctgtcaagttacccatgagggctcaacagtggagaagactgtcgccccaaccgaatgcagt

SEQ ID NO: 28072 - RNA, 660 nt, synthetic construct
  misc_feature 1..660: note = derived and/or modified sequence opt3 from anti-influenza_Chain
  source 1..660: mol_type = other RNA
cagagcgccctgacccaacccgctgcagtgtccggctctcctgggcagtcaatcacaattagttgcactggaacgagctccgacgtcggtggctacaactatgtttcttggtaccagcagcacccagggaaggccccgaaactcatgatatatgaggtgtcgaatagaccctcaggagtaagcaacaggttcagtggctccaagtctggtaataccgcgagccttacaatctccgggctgcaagctgaagatgaggccgactactattgttcaagttacacttctagctccacctatgtgtttggaacaggcaccaaagtcactgtgttgggcgcagccgctgggcagcctaaggcagccccatcagttacattatttccccctagcagtgaggaactgcaggctaacaaagccaccctagtgtgcctcatttctgatttctacccaggagcggtcacggtggcatggaaggccgactccagccccgtaaaggctggtgttgaaactaccacaccttcgaaacagtctaataacaagtacgccgcatcctcatatctgagtcttactccagagcaatggaaaagccatcggtcctactcttgtcaggtgacccacgagggcagcacagtcgaaaagaccgtggctccgacggagtgctca

SEQ ID NO: 28073 - RNA, 660 nt, synthetic construct
  misc_feature 1..660: note = derived and/or modified sequence opt3 from anti-influenza_Chain
  source 1..660: mol_type = other RNA
agctacgtgctgacccagcccccttccgtctctggcacaccagggcaaagagttactatctcatgcagtggaagcaggtccaacgtgggtgacaattctgtatattggtaccagcacgtgccggagatggcccccaagctccttgtctataaaaacacgcagcggccttcgggcgtgccagctcgcttctcagggagcaagagtggaacctccgcatctctggccattataggcttgcagagcggtgatgaagcggactactattgtgttgcttgggatgactccgtggatgggtacgtctttggatcaggcacaaaagtgactgtattaggcgccgcagccgggcaacccaaggctgcacctagtgttaccctgttcccacccagctctgaggaactacaggccaataaagctacactcgtgtgcctgatctccgacttttatcctggagccgtcaccgtggcgtggaaggcagattcaagcccagtgaaggccggtgtcgagactacaaccccgagtaaacagtctaacaataagtacgctgcctccagctacctttcgctgacgcccgaacagtggaaatctcatcgatcctattcatgtcaagttactcacgagggcagtaccgtggagaagacagtagcacctactgaatgcagc

SEQ ID NO: 28074 - RNA, 660 nt, synthetic construct
  misc_feature 1..660: note = derived and/or modified sequence opt3 from anti-influenza_Chain
  source 1..660: mol_type = other RNA
agctacgtgctgacccagcccccttccgcctctggcacaccagggcaaagagtcactatctcatgcagtggaagctcctctaacattggttcgaattatgtttactggtatcagcagctcccgggcacggctcccaagttgctgatatacagggacgggcagcggccttcaggagtgccagatcgcttcagcggcagtaaatccggtacctctgcaagccttgccatctccgggttacgatcagacgatgaggcggactattactgtgctacatgggatgacaacctgagtggacccgtatttggcggcgggactaagctaaccgtgctcggagccgcagccggtcaacctaaagctgcaccaagcgtcacactgtttcccccttcttccgaggaacttcaggccaataaggctaccctggtgtgcttgatttcagatttctatccaggcgccgttactgtggcgtggaaagcagacagcagtccggtcaaggccggggtggaaacaaccacgccctctaagcagtccaacaataaatacgctgccagctcgtacctctctctgactcctgagcagtggaagtcccaccgttcatatagttgtcaagtaacccatgaaggaagcacagttgagaaaactgtggcaccaaccgagtgctcc

SEQ ID NO: 28075 - RNA, 660 nt, synthetic construct
  misc_feature 1..660: note = derived and/or modified sequence opt3 from anti-influenza_Chain
  source 1..660: mol_type = other RNA
cagagcgccctgacccaacccgcttccgtgtctggctcacctgggcagagtatcacaattagctgcactggaacgtcctctgacgtcggtggctacaactatgtttcgtggtaccagcagcacccagggaaggcaccgaaactcatgatatatgaggtgtcaaatagacccagcggagtaagtaacaggttctccggctctaagagcggtaataccgcctcccttacaatctcagggctgcaagcggaagatgaggctgactactattgtagtagctacacttcttcctcaaccttggtgtttggaacaggcaccaaagtcactgtgttaggcgccgcagccgggcagcctaaggctgcaccaagcgttacactgtttccccctagttctgaggaactacaggccaacaaagctaccctcgtgtgcctgatttccgatttctatccaggagccgtcacggtggcgtggaaggcagacagctcgcccgtaaaggccggtgttgaaactaccacaccttctaaacagtccaataacaagtacgctgcctcaagttaccttagcctgactccagagcaatggaaatcccatcggtcttatagctgtcaggtgacccacgagggctcaacagtcgaaaagaccgtggcaccgacggagtgcagt

SEQ ID NO: 28076 - RNA, 660 nt, synthetic construct
  misc_feature 1..660: note = derived and/or modified sequence opt3 from anti-influenza_Chain
  source 1..660: mol_type = other RNA
accgtgctgacacagccccctagcgtctccggcgccccagggcaaagagttactatctcttgcacgggatcaagtagcaacattggtgctggctacgacgtgcactggtatcagcagctcccggggaccgcacccaagctcctgatatacggaaattccaacaggccttctggcgtaccagatcggttctcgggttcaaaaagcgggacaagtgccactttgggaatcaccggcttacagacaggcgacgaggcggattattactgtgggacctgggactcctctctgagcgcttatgtgtttggaactggtacaaaggtcaccgtgctaggcgccgcagccgggcaacccaaagctgcaccttccgttacgcttttcccaccctcaagtgaggaactgcaggccaataaggctactcttgtgtgcctgattagcgatttttaccctggagccgtcaccgtggcgtggaaagcagactcttccccagtaaaggccggcgttgaaacaactaccccgtcaaagcagagcaacaataaatatgctgccagttcttacttgtccctcacacccgagcagtggaaaagccatcgctcgtactcttgtcaagtgacccacgaaggttccacggtcgagaagactgtggcacctacagagtgctca

SEQ ID NO: 28077 - RNA, 663 nt, synthetic construct
  misc_feature 1..663: note = derived and/or modified sequence opt3 from anti-influenza_Chain
  source 1..663: mol_type = other RNA
cagagcgtgctgacccaacccccttccgtctctgccgctccaggccagaaggttacaatctcatgcagtgggagctcctctaacattggaaatgactacgtgtcgtggtatcagcagctcccgggtactgcacccaaacttctgatatacgataacaataagagaccttcaggcatcccagacaggttcagcgggagtaaatccggaacgtctgccaccttgggcattacaggtttacaaactggggatgaggcgaactattactgtgctacctgggaccggcgccccacagcctatgtagtgtttggaggcggcaccaagctgactgtcctaggggcagccgctggacagcctaaagcagccccaagcgtgacactctttcccccttcctcagaggaactgcaggctaataaggccacccttgtttgcctgatcagtgatttctacccaggtgcggtgacggtcgcatggaaggccgacagctctccggtgaaagctggcgtagaaactaccacaccctccaagcagtcaaacaataaatatgccgcaagcagttacttgtctctcactcctgagcaatggaagtcccaccgaagctactcgtgtcaggttacccatgaagggtctacagtggagaaaaccgtcgctccaacggagtgctcc

SEQ ID NO: 28078 - RNA, 675 nt, synthetic construct
  misc_feature 1..675: note = derived and/or modified sequence opt3 from anti-influenza_Chain
  source 1..675: mol_type = other RNA
atggtgggcttcacccccgtcgccctggctgcactcgccgcgacaggggctcttgcctttcctgcaggaaacgccactgagctggaaaagagacagacgaccccaaatagcgagggttggcacgacggctactattactcctggtggtctgatgggggagctcaagcaacatatactaacttggaaggcggtacctacgagatctcatggggagacgggggcaatttagttggcgggaaaggatggaacccgggtctgaatgccagggctattcatttcgaaggcgtgtatcagcccaacgggaatagttacctagccgtatatggatggacacggaaccctctcgtggagtactacatagtcgagaattttggcacctatgatccaagctccggtgcgactgacctggggacagtggaatgcgatggatctatctaccgccttggcaagaccacgcgagttaacgcaccctcgattgacggcactcagaccttcgatcagtattggtcagtgcgtcaagacaaaagaacaagcgggactgtccagaccggatgtcactttgatgcctgggctagggccggtctgaatgtgaacggcgaccattactatcagatcgtagcaacagaggggtacttcagttccggatatgctcggattaccgttgccgatgtgggc

SEQ ID NO: 28079 - RNA, 687 nt, synthetic construct
  misc_feature 1..687: note = derived and/or modified sequence opt3 from anti-influenza_Chain
  source 1..687: mol_type = other RNA
agaagcgacaagacccacacatgtcccccttgcccagccccggagctgctcggcgggccctccgtgttcctttttcctccaaaacccaaggatactctgatgatctctaggacgcctgaagttacctgcgtcgtggtagacgtgtcacatgaggatccagaagtcaaattcaactggtacgtggacggagttgaggtgcacaatgctaagacaaaaccccgggaagaacagtataacagtacttaccgcgtcgtgagcgtattgaccgttttacatcaggattggctgaatggtaaggagtataagtgtaaagtgtccaacaaggcactacctgccccaattgagaaaacaatatctaaggcgaaaggccagccgcgagagccccaggtctacaccctccctccatcgcgtgaagagatgactaagaatcaggtgtcactgacatgccttgtgaaggggttttatcccagcgacatcgctgtcgagtgggaaagtaacggacaacctgagaataactacaaaaccacgccacccgttctggattccgacggctctttctttttgtatagcaagctcactgtggataaatccagatggcagcagggtaatgtattctcatgtagtgtgatgcacgaagccctgcataaccactacacccaaaagagcctgtctctctccccggggaaa

SEQ ID NO: 28080 - RNA, 696 nt, synthetic construct
  misc_feature 1..696: note = derived and/or modified sequence opt3 from anti-influenza_Chain
  source 1..696: mol_type = other RNA
cacgcccaggacatcctggagaagacccataacggcaaactctgcgatcttgacggggtgaagcccctgattttgagagattgtagcgtcgctggatggttactgggtaatcctatgtgcgacgagttcataaacgttccagaatggtcctacatcgtggaaaaagcaaatccggccaacgatctatgttatcccggcaattttaacgactacgaggaactcaagcatctgctttctaggattaatcacttcgagaaaatccaaattatccctaagtcaagttggagcgatcacgaggcgtcctctggggtatcgtcagcttgcccatatcagggaacacccagctttttccggaacgtggtctggctgataaagaaaaataacacttaccctacgatcaagcgcagttataataacaccaatcaggaagacttgctcattctgtggggcatccatcactccaacgatgccgcagagcagacaaaactgtaccaaaatccaactacctatatttctgtgggtacaagcaccctcaaccagcgattagttcccaagatcgccactcgttccaaagtgaacgggcagaatggaagaatggactttttctggacaatactgaagcctaacgatgctattaattttgaatcaaacggcaatttcatcgcaccagagtacgcctacaagattgtcaaaaag

SEQ ID NO: 28081 - RNA, 699 nt, synthetic construct
  misc_feature 1..699: note = derived and/or modified sequence opt3 from anti-influenza_Chain
  source 1..699: mol_type = other RNA
atgagacccagcatccagttcctgggcctccttctgttttggttgcacgggggacaatgcgacattcagatgacccagtccccttcttcattaagtgccagcctgggtggcaacgtgacaataacttgtaaggcttcccaggatatcaataaatacattgcatggtatcaacataagccagggaaaggaccgaggctagtcatccactacacgtctaccctccagcccggcattccttcgcggttctcaggtagcgggagtggaacagactattccttttctatcagcaacctggagccagaagatatagccacttactattgccttcagtacgacatcctgtataccttcggcggcgggacaaagttggagattaaacgcgcggatgctgcccccaccgtttccatctttcctccatcaagtgaacagctcactagcggaggtgcatctgtggtatgtttcctgaataacttttaccccaaggacattaatgtgaagtggaaaatcgatggctccgagcgacaaaacggggtcctcaattcatggacagaccaggatagcaaggacagtacctactctatgtccagcacgctgactttaaccaaagatgaatatgagcgtcataactcgtacacatgcgaggccactcacaagacctctacatcccctatagtgaaatcattcaatagaaacgaatgt

SEQ ID NO: 28082 - RNA, 702 nt, synthetic construct
  misc_feature 1..702: note = derived and/or modified sequence opt3 from anti-influenza_Chain
  source 1..702: mol_type = other RNA
atgatgagctccgcccagttcctgggcctccttctgttgtgctttcaagggaccagatgtgacatccagatgacacagacttcttcaagtttaagcgcttccctgggagatagggtgacgatttcttgccgggcatcgcaggacatacgcaactacctaaattggtatcaacagaaacccgatggtaccgtcaaactcctgatctactatacatcacgacttcacagcggcgttcctagtcgtttctccgactctgggagcggaactgattactccctgaccatttcaaacttggagcaggaagacctcgccacatatttttgtcagcaaacctacactctgccatggacattcggcggtgggaccaagctggagatcaaaagagcggatgctgccccgacggtgagtatttttccccctagctctgaacagctcacttccggaggcgcatcagtagtgtgcttcttaaataacttttatccaaaggacatcaatgtcaaatggaagatagatggcagcgagaggcagaacggggtgctgaatagttggaccgaccaggattctaaggactccacatacagcatgtcgtctactcttaccttgacaaaagatgaatacgagcggcataactcctatacctgtgaggccacgcacaagacttcaacaagtcccatcgttaagagcttcaatcgcaacgaatgc

SEQ ID NO: 28083 - RNA, 702 nt, synthetic construct
  misc_feature 1..702: note = derived and/or modified sequence opt3 from anti-influenza_Chain
  source 1..702: mol_type = other RNA
atggaggcccccgctcagctcctgttccttctgttgttatggctgcctgacaccacaggcgaaatcgtgctaactcaaagcccagcaacgctctccctgtctccgggggagagagccaccctttcatgcagggcgagtgaaaacatttggaataacctggcttggtaccagcagaagcccggacaggcccctcggttgctcataagcggtgcatccacaggcgccactggggtcccatctcgctttcgaggatcgggctcacgtaccgagttcacactgaccatcagcagtctgcaatccgaagattttgctatttatttctgtcagcagtacaattcttggcccagaacttttggtcctgggacaaaagttgagatcaagaggaccgtggcagccccaagcgtattcatttttcccccttccgacgagcagctcaaatcaggaacggctagtgtggtctgcttactgaacaatttctatccacgggaagccaaggtgcaatggaaagttgataacgcgcttcagagcggcaattctcaggagtccgtgactgaacaggactcaaaggatagcacctacagtttgtcttccacactgactctaagcaaggcagactatgagaaacacaaggtctacgcctgtgaggtgacccatcaaggcctctcgtctccggtaacaaaatcctttaaccgcggggaatgc

SEQ ID NO: 28084 - RNA, 705 nt, synthetic construct
  misc_feature 1..705: note = derived and/or modified sequence opt3 from anti-influenza_Chain
  source 1..705: mol_type = other RNA
atggagacccccgcccagctcctgttccttctgttgttatggctgcctgacacaactggcgaaatcgtgctaacgcaaagcccagggaccctctccctgtctccgggagagagagctacactttcatgcagggcaagtcagagcctgtcctcttcgtcattggtctggtaccagcagaagcccggtcaagcccctcggctcctgatttatggcgcgagcagtcgcgctactgggataccagatcgattttccggatctggcagcggtaccgacttcacactgaccatctcccgtctcgaacccgaggattttgccgtttactattgtcagcagtacgggaactcaccttatactttcggacagggcacacaagtggaaattaaaagaaccgtagcagccccaagtgtgtttatctttccccctagcgacgagcagttaaagtctggcacggcttccgtcgtgtgcctgcttaataacttctacccaagggaggcaaaagttcagtggaaggtggataatgccttgcagtcagggaacagccaagaaagtgtcactgagcaggactctaaagattccacctatagcctgtcgtctacactaactctctccaaggctgactacgaaaagcacaaagtgtacgcctgtgaggtaacccatcagggactgtcaagtccggttacaaagagcttcaatcggggtgagtgc

SEQ ID NO: 28085 - RNA, 705 nt, synthetic construct
  misc_feature 1..705: note = derived and/or modified sequence opt3 from anti-influenza_Chain
  source 1..705: mol_type = other RNA
atggagacccccgcccagctcctgttccttctgttgttatggctgcctgacacaactggcgaaacggtgctaacccaaagcccagggacactctccctgtctccgggagagagagctactctttcatgcagggcaagtcagagcgtctccatctcttacctggcctggtatcagcggaagcccggtcaggcgcctcgcttgctcatttacggcgcttcgcgacgtgccaccgggataccagatagattttcaggaagcggcagtggtacagacttcaccctgactatctccaggctggaacccgaggattttgcagtttattactgtcaacagtatgggtctagcccttacacattcggacagggcaccaaactcgaaattaagcggacggtggccgctccatccgtatttatctttcccccttcagacgagcagttaaaaagtggcactgcaagcgtggtctgcctgcttaacaatttctatccacgcgaggccaaggtgcaatggaaagttgataacgctttgcagtctggaaattcccaggaatcagtgaccgagcaggacagcaaggatagtacatactctctgtccagcactctaaccctctcgaaggccgactacgaaaaacacaaggtctatgcgtgtgaggtgacacatcaagggctgtcttccccggtaaccaaatcattcaacagaggtgagtgc

SEQ ID NO: 28086 - RNA, 705 nt, synthetic construct
  misc_feature 1..705: note = derived and/or modified sequence opt3 from anti-influenza_Chain
  source 1..705: mol_type = other RNA
atggcctggatgatgctgctccttaccctgttgatccactgcacaggcagctgggctcagtccgtgttaactcaacccccttctgtctcagcagccccagggcagaaggttacgattagttgtagcggatcctcttcgaacataggtaaaaattacgtgtcatggtatcagcagctgccgggcaccgcgcccaagctactcatctacgacaacgataaaagacctagcgggattccagacaggttcagtggatccaagtctggcacaagcgctactctgggtatcaccgggcttcaaacaggagatgaggccgactatcattgcggcgcatgggattcctcactgaatggcggggtatttggaggtggcaccaaagtgactgtcttggggcagcccaaggccgctcctagtgtgacactcttcccacccagctctgaggaactgcaggcaaacaaggccaccctggtttgtctcatttccgacttttaccctggagctgtgacggtcgcctggaaagcggattcaagcccagtgaaggcaggcgtagaaactaccacaccgagtaaacagtctaataacaagtatgccgcttccagctacttatcgctgactcccgagcaatggaaatctcaccggtcctattcatgccaggttacccatgaaggtagtacagtggagaagaccgtcgcccctacggagtgtagc

SEQ ID NO: 28087 - RNA, 714 nt, synthetic construct
  misc_feature 1..714: note = derived and/or modified sequence opt3 from anti-influenza_Chain
  source 1..714: mol_type = other RNA
atgatgaagaaaaagagctggttcaccctgatgatcacaggcgtgatttccctctttttctctgtctcagcctttgctgggaacgttttctgggagccccttagttactttaatagctccacttggcagaaagcagacggatattctaacggtcaaatgttcaattgcacgtggagagccaacaatgtgaactttaccaatgatggcaagctgaaattgtcgttaacatctcctgcgaacaataagttcgactgtggggaatacaggagcactaacaattatggatacggcctgtatgaggtaagtatgaagccagctaaaaacaccggtatagtgtcctcatttttcacatacaccgggccgagccacggaactcagtgggatgaaatcgacattgagtttctaggcaaggatacaaccaaagtccagttcaattattacacgaacggcgttgggggacatgaaaagatcattaatctcggttttgacgcctccacttcattccacacctacgcattcgattggcagcccggctatatcaaatggtacgtggacggggtgctgaagcatacagccactaccaacatacctagtacaccaggaaagatcatgatgaacctttggaatggcaccggtgtcgatagctggctggggtcttataacggagctaatcccttgtacgcagagtatgactgggtgaaatacacgtccaac

SEQ ID NO: 28088 - RNA, 729 nt, synthetic construct
  misc_feature 1..729: note = derived and/or modified sequence opt3 from anti-influenza_Chain
  source 1..729: mol_type = other RNA
caggtgcaactggtccagagcggcgccgaggttaagaaacccgggtcctctgtgaaggtatcatgcaaagctagtggaggtaccttcagctcctacgcaatctcttgggtgagacaggcccctggccaggggctcgaatggatgggaggcattatgggtatgtttgggacaactaactatgcgcaaaagttccagggaagggtcacgataaccgctgacgagtttacatcggccgcatacatggaacttcggtcactgcgcagcgaggatactgccgtgtattactgtgctcgaagttccggctattacccagaatatttccaggactggggccaggggaccttggttacagtgtctagcggaaccggtggctccgggggaactggctcaggtacagggggaagtacccaaagcgtcttaacgcagccgccctctgagtccgtgtcacctggccagactgcaagcgtaacctgcagtggccacaaactgggggataagtacgtttcttggtaccagcaaaagccaggacagtcccccgtgctactcatctatcaggacaatcgtagacctagcggtattccagagaggtttatcggctcgaactctgggaatacagccactctgaccatttccggaacacaagctcttgatgaagccgactactattgtcaggcgtgggattcaagtaccgcagtcttcggcggtgggacgaaactgactgtgttgggc

SEQ ID NO: 28089 - RNA, 729 nt, synthetic construct
  misc_feature 1..729: note = derived and/or modified sequence opt3 from anti-influenza_Chain
  source 1..729: mol_type = other RNA
caggtgcaactggtccagagcggcgccgaggttaagaaacccgggtcctctgtgaaggtatcatgcaaagctagtggaggtcctttcagaaactttgcaatcaattgggtgaggcaggccccaggccaggggctcgaatggatgggaggcattatagcggtcttcggtaccacaaagtacgctcacaaatttcaagggcgggtgactatcacggccgacgatagcaccaacacagcatatatggagcttggatccctgaagtctgaagacactgccgtttactattgtgctcgcggcccgcattactattcgtcatacatggatgtgtggggcgaggggaccacagtcaccgtgagcagtggaactggtggctccgggggaacaggctctggtaccgggggaagcacggacattcagttgactcagtccccctcaagtttaagcgcatctgtaggcgatcgagttaccatcacatgccgtgcctcccagggcatttcaacttatctggcttggtaccaacagaagcctgggaaagtgccaaagctactcatctacgccgcgagcaccctgcagagtggagtcccctctagattctccggtagcggctcggggacagactttacccttacgatatcttccctgcagcctgaagatgtggcaacttattactgtcaaaaatataattcagccccaagtttcggacccggcacaaaggtggacatcaaaagg

SEQ ID NO: 28090 - RNA, 729 nt, synthetic construct
  misc_feature 1..729: note = derived and/or modified sequence opt3 from anti-influenza_Chain
  source 1..729: mol_type = other RNA
atgagctacagagtgaagaggatgctgatgctccttgtcaccggcctgttcttgtccttatctacatttgccgcttcagcaagtgcccagactgggggtagcttctatgagccctttaacaattacaacacgggactgtggcaaaaagcggacggctattccaatgggaacatgttcaattgcacctggcgggctaacaatgtttctatgacatcgctaggagaaatgcgcctctcactgactagccctagttacaacaagtttgattgtggcgagaatcgatccgtgcagacctatggttacgggctttatgaagtaaacatgaaaccagccaagaatgtgggaatcgtctctagcttctttacatacaccggcccgactgacggcacaccctgggatgagattgacatagagttcctggggaaagataccacgaaggtgcagtttaactactatactaatggagttggtaaccacgaaaagatcgtgaatttgggcttcgacgcagccaactcctaccatacctatgcttttgattggcagcctaactcaattaaatggtacgtcgacgggcaactcaagcacacagcaactacccagatcccacagacacccggaaaaattatgatgaatctgtggaacggcgccggtgtggatgagtggctggggagttataatggagtaacccctctcagccgttctttacattgggttagatacacgaagagg

SEQ ID NO: 28091 - RNA, 735 nt, synthetic construct
  misc_feature 1..735: note = derived and/or modified sequence opt3 from anti-influenza_Chain
  source 1..735: mol_type = other RNA
caggtgcaactgcagcagagcggcgccgaggtcaagaaacccgggtcctctgttaaggtgtcatgcaaagtaagtggagtgatcttcagcggttccgctatttcttgggtcagacaggcacctggccaagggctcgaatggatgggaggcatatcgccactttttggtaccacaaactacgcccagaagttccaggggagggtgactatcacggcggaccagtcaaccaatacaacttatatggaggttaacagcctgcggtacgaagataccgctgtgtatttttgtgcccgcggaccgaaatactatagtgagtacatggacgtctggggcaagggcacaaccgtgactgtatcctctgggacaggaggtagcggcgggaccggatccggcacgggtgggtcaactgatattcaaatgacccagagtcccagctctttgtccgcatcagttggagaccgagtgacaatcacttgccgtgccagccagggcattagttcttatttagcttggtaccagcaaaagcctggcaaagtcccaaccctgctaatctacgatgcatccacactcagaagcggggtgccctcgaggttctctggatccggttcagccaccgactttacgctgactataagtagccttcagcctgaagatgtggctacatattactgtcagcggtataattccgccccacccatcaccttcggccaagggactcgcctggagattaagaga

SEQ ID NO: 28092 - RNA, 735 nt, synthetic construct
  misc_feature 1..735: note = derived and/or modified sequence opt3 from anti-influenza_Chain
  source 1..735: mol_type = other RNA
gaggtgcagctggtcgaaagcggcgccgaggttaagaaacccgggtcctctgtgaaggtatcatgcaaagctagtggaggtaccttcagctcctacggcatctcttgggtgagacaagcacctgggcagggactcgaatggatgggcgacattataggtatgtttgggtcgacaaactatgcccagaatttccagggaaggcttactatcacggcggatgagtcaaccagcacagcttacatggaactgagttccttgcggtctgaggacactgccgtctattactgtgcacgcagctccggctattacccagcctatttaccgcactggggccaagggaccctggtgacagtttcaagtggaaccggtggcagcgggggaactggctctggtacagggggatccaccgagattgtgctaacgcagtcacccggcactctcagcctgagtcctggcgaacgagctaccctttcttgccgtgcatcccagagcgtctcgtcttcctacctggcctggtaccagcaaaagccagggcaggctcccagattgctcatctatggagcctcaagtagggcgacaggtattcctgatcggtttagcggctccgggtctggaactgacttcaccctgacaatcagccgcctggagccagaagattttgcagtgtactattgtcagcagtacggctcaagtcccagaaccttcggtgggggcacgaaagtagagataaagagg

SEQ ID NO: 28093 - RNA, 735 nt, synthetic construct
  misc_feature 1..735: note = derived and/or modified sequence opt3 from anti-influenza_Chain
  source 1..735: mol_type = other RNA
gaggtgcagctggtcgaaagcggcgccgaggttaagaaacccgggtcctctgtgaaggtatcatgcaaagctagtggaggtaccttcagctcctacgcaatctcttgggtgagacaagcccctggccaggggctcgaatggatgggaggcattataggtatgtttgggacagcgaactatgctcagaagttccagggaagggtcactatcacggccgacgagtttacctcgacagcatacatggaactttcaagcctgcggagtgaggatactgccgtgtattactgtgctcgcggcaattattactatgagtcctctttggactactggggccaagggaccttagttacagtgagctccggaaccggtggctcagggggaactggcagtggtacagggggaagcacccagtctgtcgtgacgcagccaccgtccgtatcagttgcacccggccagactgcccgaattacctgcggcgggaacaatatcggaagcaaaagtgtgcactggtaccaacagaagcctggtcaggctccagtcctggtggtgtatgatgactctgatcgtccctccggcattcctgaaagattcagcgggtcgaactctggaaatacagccactctaaccatctccagggtcgaggcgggcgacgaagcagattactattgtcaggtttgggactcaagtagcgatcattacgtgtttggtacagggaccaaggtaacggtgctcggc

SEQ ID NO: 28094 - RNA, 735 nt, synthetic construct
  misc_feature 1..735: note = derived and/or modified sequence opt3 from anti-influenza_Chain
  source 1..735: mol_type = other RNA
gaggtgcagctggtccaaagcggcgccgaagttaagaaacccggggcttccgtgaaggtatcttgcaaagcatcaggatacaccttcacaggttattacgtgtattgggtcagacaggcccctggccaggggctcgagtggatgggatggatcagtgcgtacaacggcaatactaactatgctcagaagtttcaaggtagggtgacgattaccgccgacaaaagcacatccactgcatacatggaactttcttcgctgcggtcagaggataccgccgtttattactgtgctcgcagccgaagtttggacgtgtgggggcagggaacaaccgtcactgtgtcctctggcacaggcgggagcggaggtaccggctccgggacgggaggctcaactgatgtagttatgacccagagtccagacagcttagcagtgtctctgggtgaacgtgccacaataaattgcaagtcctcacagagcgtcctatacagttctaacaataagaactatctcgcttggtaccaacagaaaccggggcagccccctaagctgcttatctattgggcctccactagagagagcggagtgccagataggttctcgggctctggctccgggaccgactttacactgaccatttcaagtttgcaggcggaggatgtggcagtctactattgtcaacagtactatagcacgcccctcactttcggaggtggcacaaaagttgacatcaagcgg

SEQ ID NO: 28095 - RNA, 735 nt, synthetic construct
  misc_feature 1..735: note = derived and/or modified sequence opt3 from anti-influenza_Chain
  source 1..735: mol_type = other RNA
gaggtgcagctggtcgaaaccggcgccgaggttaagaaacccgggagctccgtgaaggtaccttgcaaatcttcaggaagtccattcagaagcaacgctgtgtcctgggtcaggcaagcaccgggtcagggcctcgaatgggttgggggaatccttggcgtgtttggttctccctcgtacgcccagaagttccaggggcgggtgacaattactgcggacgagtcaacgaataccgtccacatggaactgcgcggattgcgaagcgaggatacagctgtgtattactgtgcccgtggccctacttattactatagttacatggacgtatggggcaaagggaccacagttaccgtgtcctctggaactggtggcagcgggggaacaggctccggtaccgggggatcaacgagttatgtcttaactcaaccacccagcgagtctgtggcacctggccagaccgccagaataacatgcggcgggaacaatatcggaaggaactccgtgcattggtaccagcagaagccaggtcaagctcccgtcctggttgtgtacgatgactcagatcggcctagcggcattccagaacgctttagtgggtctaagtccggaaatactgcaaccctaatcattagcagagtagaggtgggcgacgaagccgattattactgtcaggtctggcactcgtcttccgaccattatgtgttcggtacagggaccaaagttacggtgctcggc

SEQ ID NO: 28096 - RNA, 735 nt, synthetic construct
  misc_feature 1..735: note = derived and/or modified sequence opt3 from anti-influenza_Chain
  source 1..735: mol_type = other RNA
cagatgcaactggtgcagagcggcgccgaggtcaagaaacccgggtcctctgttaaggtgtcatgcaaagctagtggaggtaccttcagctcctacgcaatctcttgggtaagacaggcccctggccaggggctcgaatggatgggaggcatttttggtatgttcgggacagcgaactatgctcaaaagtttcagggaagggtgactataacggccgacgagttcacctcggcagcctacatggaactttcaagcctgggcagtgaggatacagctatgtattactgtgcacggtcctctggctattacccacagtattttcaggactgggggcaaggaactttggtcaccgtgagctccggtacaggcgggtcaggaggcaccggtagtgggactggaggcagcacagaaatcgttatgacccagtctccgggcacgttatccctgtcacccgggcagcgcgccactctaagctgccgagctagtcagtctgtgtccagctcgtacctcgcctggtaccaacagaaacctggacaggcgccacgtctgcttatgtatggtgcatcttccagagccaccggcattcccgataggttctcagggagtggaagcggcacagactttactctgaccatctcccggttggagcctgaggatttcgctgtctactattgtcaacagtacggttctagctcactcacatttgggggcggaaccaagctggaaattaagcgc

SEQ ID NO: 28097 - RNA, 735 nt, synthetic construct
  misc_feature 1..735: note = derived and/or modified sequence opt3 from anti-influenza_Chain
  source 1..735: mol_type = other RNA
caggtgcaactggtccagagcggcgccgaggttaagaaacccgggtcctctgtgaaggtatcatgcaaagctagtggagtgaccttcagctactatgcaatgtcctgggtcagacaggcccctggtcagggcctcgaatggatgggagggatctctccaatgtttggcacaactacgtacgcgcaaaagttccagggtagggtgaccattacagctgacgattcgacttcaaccgcctatatggaggttcggagccttcgcagtgaagacacagcagtgtactattgtgcccgatcctctaactactatgatagcgtctacgactactgggggcagggaaccctggtgactgtatcctcaggcacaggcgggagtggaggtaccggcagcgggacgggaggctctactcagtccgttgtgacccaaccgccctcagagagcgtcgctcctggtcagacagcacgtataacttgcgggggacacaatatcggcagtaactctgtgcattggtatcagcagaaaccaggccaagcccccgtgttggtcgtttacgataattccgacagacctagcgggattccagaaaggttttcgggatctaactccggtaataccgctacattaaccatctcacgggtggaggccggcgatgaggcggactattactgtcaggtatgggggagtagctccgatcactatgtgttcggaacgggcactaaggtcacagtgctgggt

SEQ ID NO: 28098 - RNA, 738 nt, synthetic construct
  misc_feature 1..738: note = derived and/or modified sequence opt3 from anti-influenza_Chain
  source 1..738: mol_type = other RNA
caggtgcaactggtccagagcggcgggggactcgttaagcccggtggctcccttagactgtcttgcgccgcttcagggttcacctttagtagctactccatgaactgggtgaggcaggcacctggaaaaggcttggagtgggtatcttcgatctcaagcagttcctcttatatttactatgtggacagcgtcaagggtcggttcacaatatcccgcgataatgccaaaaactcattatacctgcagatgaatagtctacgagcggaagacactgctgtgtattactgtgcccgtgggggaggcagctatggcgcatacgaggggtttgattactggggacaaggtacgctcgttaccgtgtcttccggcacagggggatcaggcggtactgggagcggaaccggcggcagtacagaaatcgtcctgacccagtctccagggactctttccctgagcccgggagagagagccacattgtcgtgcagggcttctcagcgggtgtcctcatatctcgcatggtaccagcaaaagcccggtcaggcccctcgcctgctgatttatggcgctagtaccagagccgcggggatcccagacaggttcagcggatccggctctggtacggattttactctcaccattagccggttagaacccgaggactcagcagtatactattgtcagcagtacgggcgcacacctctgactttcggcggaggcaccaaagttgagatcaagcga

SEQ ID NO: 28099 - RNA, 738 nt, synthetic construct
  misc_feature 1..738: note = derived and/or modified sequence opt3 from anti-influenza_Chain
  source 1..738: mol_type = other RNA
gaggtgcagctggtcgaaagcggcgccgaggttaagaaacccgggtcctctgtgaaggtatcatgcaaagctagtggaggtcctttcagaagctacgcaatctcctgggtgaggcaagccccaggccaggggccggaatggatgggaggcattatacccatctttggtaccacaaagtatgcgcctaaattccaggggcgggtcactattacggctgacgattttgccggaaccgtgtacatggagctctcttcgcttcgctcagaagacacagcaatgtattactgtgccaagcacatgggctatcaggttcgagagactatggatgtgtggggcaaggggaccacagtcaccgtgagcagtggaactggtggctccgggggaacaggctctggtaccgggggaagcacgtcctacgtactgactcaaccaccctcagttagtgtggctcctggccagaccgcacgtatcacatgcggcgggaacaatattggaagcaaatctgtccattggtatcagcagaagccaggtcaagcccccgtgttggtggtctacgacgattccgacagaccttcaggcatcccagagaggttcagcgggagtaactctggaaatactgctaccttaacaatatcccgggttgaagccggcgatgaggcggactactattgtcaggtgtgggatagctcgtctgaccacgcagtatttggtgggggcacccagctgacggtgctagga

SEQ ID NO: 28100 - RNA, 738 nt, synthetic construct
  misc_feature 1..738: note = derived and/or modified sequence opt3 from anti-influenza_Chain
  source 1..738: mol_type = other RNA
gaggtgcagctggtcgaaaccggcgccgaggttaagaaacccggggctagcgtgaaggtatcctgcaaagcatctggatacacattcacttcatattacatgcactgggtgagacaagcccctggtcagggcctcgaatggatggggtggatcaacccaaatagtggaggcacgaactatgcgcagaagtttcagggtagggtcaccatgacacgggacactagcatttccaccgcttacatggagctttctcgcctgcgatcggatgacacagccgtgtattactgtgcacgtgaagggaaatggggaccgcaagccgctttcgatatatggggccagggcaccatggttactgtgtcaagcgggacaggaggtagtggcgggaccggatccggcacgggtgggtctactgagatcgtcatgacccagagccccggaacattgtccttatcacctggcgagagagcaactctgagttgcagggccagccagtctgtgtcctcaagctatctagcttggtaccaacagaagccaggccaggcgccccggctcctgatttacgacgccagttctcgcgcaaccgatatccctgacagattttccgggagcggatcgggtacagatttcacccttacgatttctaggctggaaccagaggactttgccgtatattactgtcagcaatatggctcctcattgtggactttcgggcagggaacaaaggttgaaatcaaacgg

SEQ ID NO: 28101 - RNA, 738 nt, synthetic construct
  misc_feature 1..738: note = derived and/or modified sequence opt3 from anti-influenza_Chain
  source 1..738: mol_type = other RNA
gaggtgcagctggtcgaaagcggcgggggactcgttcaacccggtggctcccttagactgtcttgcgccgcttcagggttcacctttagtatctacgcaatgagctgggtgaggcaggcccctggaaagggcttggagtgggtatccgcgatttcttcgtcaggtgacagcacatattacgctgatagtgtgaaagggcggttcactatatcccgcgacaacgcccgaaatacgttatatctgcagatgaactctctacgtgcagaagataccgccgtctactattgtgctagagcatacggatatacatttgacccatggggccagggcactctcgtgaccgttagctccgggacaggaggttcaggcgggaccggaagtggcactggtgggagcacagagatcgtgctgacccaatctccgctttccctgcccgtcacgcctggagaaccagcctcaattagctgcaggagttctcagtccttgctccacagcaatggctacaactacctggattggtatctgcagaagcccggccagtcgcctcaactcttaatctacctggggtctaatcgggcttccggagtgccagaccgcttctcaggtagtggcagcgggactgattttacccttaaaatttccagagtagaggccgaggacgttggagtgtattactgtatgcaggcgttgcagacacccctgactttcggcggtgggaccaaggtcgaaatcaaaagg

SEQ ID NO: 28102 - RNA, 738 nt, synthetic construct
  misc_feature 1..738: note = derived and/or modified sequence opt3 from anti-influenza_Chain
  source 1..738: mol_type = other RNA
gaggtgcagctggtcgaaaccggcgccgaggttaagaaacccgggagctccgtgaaggtatcttgcaaagcatcaggaggtacattcagaactcacgcaatcagttgggtgaggcaagcccctggccaggggctcgaatggatgggaggcattatagcgatctttggtacggctaactacgcccagaagttccaggggcggattaccatcacagcagacgagagcacttccaccgcctatatggaactttcttcgctgcgctcagaggatacagctgtctacttttgtgcacgaggaagcggctatcatattagtaccccattcgacaattggggccaagggactttggtgacagtttcctctggaaccggtggcagcgggggaacgggctccggtactgggggatcaaccagttacgtgttaacacagccgcccagcgtctctgtggcccctggccagactgctcgtataacctgcggcgggaacaatatcggatccaaaggtgtacactggtatcagcaaaagccaggccaggcccccgttctggtggtctacgatgactcagatagacctagcgggatcccagagaggtttagtggatctaactccggcaatacagcgaccctaacgattagccgggtggaagctggtgacgaggccgattattactgtcaggtgtgggactcgtcttccgatcatgtcgttttcgggggcggaactaagctcacagtgctgggc

SEQ ID NO: 28103 - RNA, 738 nt, synthetic construct
  misc_feature 1..738: note = derived and/or modified sequence opt3 from anti-influenza_Chain
  source 1..738: mol_type = other RNA
gaggtgcagctggtccaaagcggcgccgaagttaagaaacccgggtcctctgtgaaggtatcatgcaaagctagtggaggtatcttcagaagcaactccatttcttgggtgaggcaggcacctggccaggggctcgagtggatgggaggcatatttgcccttttcggtaccacagactacgcgcagaagtttcaagggcgggtcactatcacggctgatgaatcgtcaaccacagtgtatctggagttgagcagtttaacttccgaagacaccgccgtttactattgtgcacgcggatctggctacacaacccgaaattatttcgattactggggccaggggactctggtgacagtcagctccggaaccggtggctcagggggaacgggcagtggtactgggggaagcaccgagattgtgctaacacagtctccaggcactctctccctgtcaccgggcgagcgtgccacccttagctgcagagctagtcagtctgtatccagcaactatctggggtggtaccaacagaaacccggacaggcacctaggttgctcatctacggtgcctcgtctcgggcttccggcattccagaccgcttttcagggggaggcagtggtacagatttcaccctgacgatcagcagactggaacccgaggactttgccgtttattactgtcagcaatatgggtcctctcctctcactttcggcggaggcacaaaggtggaaataaagagg

SEQ ID NO: 28104 - RNA, 738 nt, synthetic construct
  misc_feature 1..738: note = derived and/or modified sequence opt3 from anti-influenza_Chain
  source 1..738: mol_type = other RNA
gaggtgcagctggtcgaaagcggcgccgaggttaagaagcccgggtcctctgtgaaggtatcatgcaaagctagtggaggtatcttcaacagctacgcaatttcctgggtgagacaagcccctggccaggggctcgaatggatgggaggcataatcgcgatttttcacaccccaaagtatgctcagaaattccagggtagggtcacaatcactgccgacgagtctacgaataccgcatacatggaacttcggtcgctgaagtcagaggatacagccttgtattactgtgctcgcgggagcacttatgactttagttccggattagattactggggccaaggcaccctggtgacagtttctagcgggaccggaggttccggcgggactggatcaggcacaggtgggagtacccaggcaggactaacgcagccgcccagcgtgtctgtcgcccctggccagactgctcgaattacctgcggcgggaacaatatcggatccaagtcagtgcattggtatcaacagaaaccaggtcaggcccccgtactcgttgtgtacgacgatagcgaccgtcctagtggcataccagagagattctctgggtccaacagcggaaatacagcgactctgaccatctcgagggtcgaagcaggcgatgaggccgactactattgtcaggtgtgggattcttcctcagaccacgtggtctttggtgggggcacaaaacttaccgttctggga

SEQ ID NO: 28105 - RNA, 741 nt, synthetic construct
  misc_feature 1..741: note = derived and/or modified sequence opt3 from anti-influenza_Chain
  source 1..741: mol_type = other RNA
cagatgcaactggtgcagagcggcgccgaggtcaagaaacccgggtcctctgttaaggtgtcatgcaaagctagtggaggtaccttcagctcctacgcaatcacatgggtaagacaggcccctggccaggggctcgaatggatgggaggcattataggtatgtttgggtctactaactatgcgcaaaatttccagggaagggtgacgatcaccgctgacgagtcgacatcaactgcctacatggaacttagcagtctgcggtccgaggataccgcagtctattactgtgcccgctctacaggctattacccagcttatttgcaccattggggccaggggaccttagtgactgttagctccggaacaggtggctcagggggaaccggcagtggtactgggggaagcacgcagtctgcactgacccaaccgcgatccgtgtcaggcagccccggccagagtgtcacaatttcttgcactgggacctccagcgacgtgggaggttacaactacgtatcgtggtatcagcagcaccctggcaaggccccaaaactaatgatctacgatgtttctaagcgtccctccggggtgcctgacagattttcaggaagtaagagcggcaatacagcttccctcaccatttctggtctgcaagccgaagatgaggcggactattactgtagctcatatacgagttccagcactcatgtcttcgggacaggcaccaaagtgactgtgcttgga

SEQ ID NO: 28106 - RNA, 744 nt, synthetic construct
  misc_feature 1..744: note = derived and/or modified sequence opt3 from anti-influenza_Chain
  source 1..744: mol_type = other RNA
gaggtgcagctggtcgaaagcggcgccgaggttaagaagcccgggtcctctgtgaaggtatcatgcaaagctagtggaggtcctttcagaagctacgcaatctcctgggtgaggcaagccccaggccaggggccggaatggatgggaggcattatacccatctttggtaccacaaagtatgcgcctaaattccaggggcgggtcactattacggctgacgattttgccggaaccgtgtacatggagctctcttcgcttcgctcagaagacacagcaatgtattactgtgccaagcacatgggctatcaggttcgagagactatggatgtgtggggcaaggggaccacagtcaccgtgagcagtggaactggtggctccgggggaacaggctctggtaccgggggaagcacgtcctacgtactgactcaaccaccctcagctagtggcacccctggccagcgtgttacaatcagctgctctgggtccactttcaacattggatcaaatgcagtggactggtatagacagttgccaggtaccgcccccaaattactgatctacagcaacaatcagaggcctagtggcgtcccagatcggttttctgggtcccgcagcggaacatcggcttctctagccatatccggcctccaatcagaggacgaagcggattactattgtgcagcctgggacgatatcctgaacgtgccggtgttcggtgggggcaccaaacttacggtcctggga

SEQ ID NO: 28107 - RNA, 744 nt, synthetic construct
  misc_feature 1..744: note = derived and/or modified sequence opt3 from anti-influenza_Chain
  source 1..744: mol_type = other RNA
caggtgcaactggtccagagcggcgccgaggttaagaaacccgggtcctctgtgaaggtatcatgcaaagctagtggaggtcctttcagaagctacgcaatctcctgggtgaggcaggccccaggccaggggccggaatggatgggaggcattatacccatctttggtaccacaaagtatgcgcctaaattccaagggcgggtcactattacggctgacgattttgccggaaccgtgtacatggagctctcttcgcttcgctcagaagacacagcaatgtattactgtgccaagcacatgggctatcaggttcgagagactatggatgtgtggggcaaggggaccacagtcaccgtgagcagtggaactggtggctccgggggaacaggctctggtaccgggggaagcacgcagtccgctctgactcagccagcagccgtatcaggcagtcccggccaaagcatcaccatttcttgcacagggacttcctcagacgttggaggttacaactatgtgagctggtaccagcagcatcctggcaaagctccaaagttgatgatctacgaagtcagtaatcgtccctctggggtgtccaacagattcagcggatcgaaatctggcaataccgcctccttaacaatatcaggtctgcaggcggaggatgaggcagactattactgtagtagctatacctcctctagcacgtacgtgtttgggactggcacaaaggtcaccgttctagga

SEQ ID NO: 28108 - RNA, 744 nt, synthetic construct
  misc_feature 1..744: note = derived and/or modified sequence opt3 from anti-influenza_Chain
  source 1..744: mol_type = other RNA
gaggtgcagctggtcgaaagcggcgccgaggttaagaaacccgggtcctctgtgaaggtatcatgcaaagctagtggaggtcctttcagaagctacgcaatctcctgggtgaggcaagccccaggccaggggccggaatggatgggaggcattatacccatctttggtaccacaaagtatgcgcctaaattccaggggcgggtcactattacggctgacgattttgccggaaccgtgtacatggagctctcttcgcttcgctcagaagacacagcaatgtattactgtgccaagcacatgggctatcaggttcgagagactatggatgtgtggggcaaggggaccacagtcaccgtgagcagtggaactggtggctccgggggaacaggctctggtaccgggggaagcacgtcctacgtactgactcaaccaccctcagttagtggcacccctggccagcgtgtgacaatcagctgctctgggtccagatcaaacgtcggagacaatagcgtgtattggtaccagcatgtgccagagatggctcccaaattgttagtctacaagaacactcagaggcctagtggtgttccagcacggttctctggctccaaaagcgggacctcggcctctctggctattatcggactacaatccggcgatgaagccgactattactgtgtggcgtgggatgactcagtagatggttatgtgtttgggagtggcacaaaggtcaccgtgctcgga

SEQ ID NO: 28109 - RNA, 744 nt, synthetic construct
  misc_feature 1..744: note = derived and/or modified sequence opt3 from anti-influenza_Chain
  source 1..744: mol_type = other RNA
gaggtgcagctggtcgaaagcggcgccgaggttaagaaacccgggtcctctgtgaaggtatcatgcaaagctagtggaggtcctttcagaagctacgcaatctcctgggtgaggcaagccccaggccaggggccggaatggatgggaggcattatacccatctttggtaccacaaagtatgcgcctaaattccaggggcgggtcactattacggctgacgattttgccggaaccgtgtacatggagctctcttcgcttcgctcagaagacacagcaatgtattactgtgccaagcacatgggctatcaggttcgagagactatggatgtgtggggcaaggggaccacagtcaccgtgagcagtggaactggtggctccgggggaacaggctctggtaccgggggaagcacgtcctacgtactgactcaaccaccctcagctagtggcacccctggccagcgtgttacaatcagctgctctgggtcctcaagcaacattggaagtaattatgtgtactggtaccagcagttgccaggtactgcacccaaattactgatctatagagacggccaaaggccttctggggtcccagatcggttctccggaagcaagtcgggcacctctgcctccctagctatatcaggtctccgcagtgacgatgaggccgactactattgtgcgacatgggatgacaacctgagcgggccggtgtttggcggaggcaccaaacttacggtgctgggg

SEQ ID NO: 28110 - RNA, 744 nt, synthetic construct
  misc_feature 1..744: note = derived and/or modified sequence opt3 from anti-influenza_Chain
  source 1..744: mol_type = other RNA
gaggtgcagctggtcgaaagcggcgccgaggttaagaaacccgggtcctctgtgaaggtatcatgcaaagctagtggaggtaccttcagcttttactccatgtcttgggtgagacaagcacctggccaggggctcgaatggatgggaggcatcattccaatgttcggtacaactaactatgcccagaagtttcaggggagggtcacgataaccgcggtggagtcgacatcaactgcttacatggaagttagcagtcttcggtccgaggacaccgccgtgtattactgtgcacgcggagataaaggcatctattactattacatggacgtctggggcaaggggacaaccgtgactgtatctagcggaacaggtggctccgggggaaccggctcaggtactgggggaagtacgcaaagcgccctgacccagccggcttctgtttccggctcacccggccagagcattacaatcagttgcactgggacctcttccgatgtgggaggttacaattatgtcagctggtaccagcaacaccctggcaaggcaccaaaattgatgatttatgaggtgtcgaaccgaccctctggggtgtccaatcgtttctcaggaagtaagagcggcaacacagcctccttaaccatctctggtctgcaggctgaagacgaggccgattactattgtagctcatacacgagttccagcactctagtctttgggacaggcaccaaagttactgtgctcgga

SEQ ID NO: 28111 - RNA, 744 nt, synthetic construct
  misc_feature 1..744: note = derived and/or modified sequence opt3 from anti-influenza_Chain
  source 1..744: mol_type = other RNA
atgagcctgttcggcgacaccatcgcctacctcctttccctgattgaggatggggaaggaaaggctgagttggcagaaaaattacactgctggtttggtggcaaggagttcgacctggattctgccctagaatggatcaaaaacaagagatgtctcacagacatacagaaagcgctgattggggcttcaatctgctttcttaagcccaaggatcaagagaggaaacggcgcttcattactgagcctctgagtggaatgggcacgaccgccacaaagaaaaagggtttgatcctcgcagaacgaaaaatgcgtagatgtgtgagctttcatgaggccttcgaaatagctgaggggcacgagtcctctgcactgctgtattgcctcatggtcatgtacttaaatccagaaaactattcgatgcaggttaagctgggaactctttgtgccttgtgcgagaagcaggcttcacatagccacagggcccatagtcgggcggcacgctcctctgtgccgggcgtaagaagggaaatgcagatggtgagcgccatgaataccgctaaaacaatgaacggcatggggaagggagaggacgtccaaaaactggccgaggaactacagaataacatcggtgtgctccggtccctgggcgcatcacagaagaatggggagggaattgctaaagatgttatggaagtgcttaagcagagtagcatgggcaactctgccctggtccgcaaatacttg

SEQ ID NO: 28112 - RNA, 747 nt, synthetic construct
  misc_feature 1..747: note = derived and/or modified sequence opt3 from anti-influenza_Chain
  source 1..747: mol_type = other RNA
gaggtgcagctggtcgaaagcggcgccgaggttaagaaacccgggtcctctgtgaaggtatcatgcaaagctagtggaggtcctttcagaagctacgcaatctcctgggtgaggcaagccccaggccaggggccggaatggatgggaggcattatacccatctttggtaccacaaagtatgcgcctaaattccaggggcgggtcactattacggctgacgattttgccggaaccgtgtacatggagctctcttcgcttcgctcagaagacacagcaatgtattactgtgccaagcacatgggctatcaggttcgagagactatggatgtgtggggcaaggggaccacagtcaccgtgagcagtggaactggtggctccgggggaacaggctctggtaccgggggaagcacgcaatccgtactgactcagccaccctcagttagtgctgcacctggccagaaagtgaccatcagctgctctggctcctcaagcaacattgggaatgactacgtcagttggtatcagcaattgccaggaacagcccccaagttactgatctacgataacaataaacgtccttctggtataccagacagattctccggcagcaagtcggggacttctgctaccctaggaatcacaggcctccagaccggtgatgaggccaactactattgtgcgacgtgggacaggcggccgactgcatacgtggtgtttgggggcggaacaaaactgaccgtccttggc

SEQ ID NO: 28113 - RNA, 750 nt, synthetic construct
  misc_feature 1..750: note = derived and/or modified sequence opt3 from anti-influenza_Chain
  source 1..750: mol_type = other RNA
caggtgcaactggtccagagcggcgccgaggttaagaaacccgggtcctctgtgagagtatcatgcaaggctagtggaagcatcttcaggaactacgcaatgtcctgggtgcggcaggcccctggtcagggcctcgaatggatgggagggattatagcgatctttggcaccccaaaatatgctcaaaagttccagggtcgcgtcacaattactgccgacgagtctacgtcgaccgtgtacatggaactttcagggctgcgaagcgaggatacagcaatgtattactgtgcccgtatcccgcactataattttggaagtggctcctacttcgactattggggccaggggactttggttaccgtgtctagcggaacaggtggctccgggggaaccggctcaggtactgggggaagtacaaccgtcttaacgcagccccctagcgtgtctggcgctccaggccaaagagtaactatttcctgcaccgggtcaagcagtaacatcggagcaggttacgatgttcattggtaccagcagctgcccggcacagcccctaaactactcatatatggaaattctaacaggccatccggggtgcccgaccggtttagcggctcgaagtctggtacttccgctaccctggggatcacaggccttcagaccggagatgaagccgactactattgtggcacgtgggattcaagtctgagcgcgtacgtcttcgggactggaacaaaggtgaccgtgttgggt

SEQ ID NO: 28114 - RNA, 756 nt, synthetic construct
  misc_feature 1..756: note = derived and/or modified sequence opt3 from anti-influenza_Chain
  source 1..756: mol_type = other RNA
gaggtgcagctggtcgaaagcggcgccgaggttaagaaacccgggtcctctgtgaaggtatcatgcaaagctagtggacacatcttcagcggttacgcaatttcctgggtgagacaagcccctggccaggggctcgaatggatgggaggcataatcccaatttttggtaccacaaactatgcgcagaagttccaggggagggtcactatcacggctgaccaatctacctcgacagcctacatggatctttcaaatctgcggagcgaggacactgcagtgtattactgtgcccgcgttaaagatggatattgcaccttgacaagttgtccggtgggctggtactttgacttatggggccgagggaccctggtcactgtgtcctctggaacaggtggcagcgggggaaccggctccggtactgggggatcaacggaaattgtaatgacccagagtcccggcacactaagcctctctcctggcgagcgtgctactctgtcctgcagagcatcacagagcgttagttcttcctatcttgcctggtaccagcaaaagccagggcaggctcccaggctgttgatcttcggagccagctcgcgggcgaccggtatacctgatcgcttttctggctccgggtcaggaacagacttcaccctcacgatcagtagactggagccagaagattttgcagtgtactattgtcagcagtacggcagctccctgactttcggtgggggcacaaagctcgagattaaaagg

SEQ ID NO: 28115 - RNA, 768 nt, synthetic construct
  misc_feature 1..768: note = derived and/or modified sequence opt3 from anti-influenza_Chain
  source 1..768: mol_type = other RNA
caggtgcaactggtccagagcggcgccgaggttaagaaacccgggtcctctgtgaaggtatcatgcaaagctagtggaggtttctttagctcctacgcaatctcttgggtgagacaggcccctggccaggggctcgaatggatgggaggcgtcattccaatattcaggaccgcgaactatgctcaaaattttcagggtcgggtgacaatcactgccgacgagttcacgtcgtacatggaactttcaagcctgcgcagtgatgacaccgcagtttattactgtgcccgattgaactatcacgattccgggacatactataatgctccgcgtggatggtttgacccctggggccagggcactttagtgaccgtctctagcgggacaggaggttccggcgggaccggatcaggcactggtgggagtacagatattcagatgacccaaagccctgactctctggcagtgtccctaggagagaaggccacgatcaactgcaaatcaagccagagtattctcaattcttccaacaataagaactacctggcttggtaccagcagaagccaggccaaccccctaaacttctgatctattgggccagcactagagaatcgggcgtaccagataggttctctgggtccggatcaggtaccgactttacattgactataagtagcctccaggcggaggatgttgcagtgtactattgtcagcaatactattcctctccccctaccttcggccaggggacaaaggtcgagatcaaacgg

SEQ ID NO: 28116 - RNA, 768 nt, synthetic construct; identical to SEQ ID NO: 28115
  misc_feature 1..768: note = derived and/or modified sequence opt3 from anti-influenza_Chain
  source 1..768: mol_type = other RNA

SEQ ID NO: 28117 - RNA, 771 nt, synthetic construct
  misc_feature 1..771: note = derived and/or modified sequence opt3 from anti-influenza_Chain
  source 1..771: mol_type = other RNA
atctgcattggctaccacgccaacaatagcaccgaacaggtggacacaataatggaaaagaacgtcactgttacgcatgctcaagatatcctggagaaaacccacaatgggaagctctgtgaccttgatggagtgaaacccctgattttgagagactgctccgtagcaggttggttactgggcaaccctatgtgtgatgagttcatcaatgtgccagagtggtcttatattgtcgaaaaggccaacccggcgaatgacctatgctaccccgggaactttaatgattatgaggagctcaaacatctgctttcaaggatcaaccacttcgaaaagatacagatcattcctaagagtagctggtccgaccatgaggcttcttcgggagtgtcaagcgcctgtccataccagggcacaccctcctttttccggaatgttgtgtggctgatcaaaaagaacaatacttatcctaccattaaacgcagttacaacaatacaaaccaggaagatttgctcatcctgtggggtatacaccactctaacgacgcagccgagcaaaccaagctgtatcagaatccaactacatacattagcgtcgggacctccacgctcaaccagcgattagtgcccaaaatcgctactcgttcaaaggtaaatggacagaacggcagaatggactttttctggaccattctgaagcctaatgatgcaatcaactttgagagtaatggcaacttcatcgccccagaatacgcttataaaattgttaagaaa

SEQ ID NO: 28118 - RNA, 771 nt, synthetic construct; identical to SEQ ID NO: 28117
  misc_feature 1..771: note = derived and/or modified sequence opt3 from anti-influenza_Chain
  source 1..771: mol_type = other RNA

SEQ ID NO: 28119 - RNA, 777 nt, synthetic construct
  misc_feature 1..777: note = derived and/or modified sequence opt3 from anti-influenza_Chain
  source 1..777: mol_type = other RNA
atggttaagagcaaatacctggtcttcatctccgtgttttctctccttttcggcgtgtttgtagtggggttctcacaccagggagtcaaggccgaggaagagagacccatgggtaccgctttttatgaaagtttcgacgcatttgatgacgagaggtggagcaaagccggcgtgtggacaaacgggcaaatgttcaatgcgacttggtaccctgaacaggttacggctgatggactgatgcggttgaccattgccaagaaaacaacttccgcacgcaactataaggccggcgagttacgaaccaatgacttttaccattatggtctgttcgaggtgtctatgaagccagctaaagtcgaagggacagtgtcgtcatttttcacctacactggagagtgggattgggacggcgatccgtgggacgaaatagatatcgagtttctaggcaaggacacaacccgtattcagttcaactatttcacgaatggggtaggaggtaacgagttttactacgatctcggcttcgacgcaagcgaaagttttaatacttatgccttcgagtggagagaagattccatcacctggtacgttaacggggaggctgtgcacacagccactgaaaatattccccagacccctcagaaaatcatgatgaacctgtggccaggagtcggcgtggacggttggacaggggtgtttgacggagataatacccccgtctattcttactatgactgggttaggtacacgcctcttcaaaactatcagatacatcag

SEQ ID NO: 28120 - RNA, 777 nt, synthetic construct; identical to SEQ ID NO: 28119
  misc_feature 1..777: note = derived and/or modified sequence opt3 from anti-influenza_Chain
  source 1..777: mol_type = other RNA

SEQ ID NO: 28121 - RNA, 783 nt, synthetic construct
  misc_feature 1..783: note = derived and/or modified sequence opt3 from anti-influenza_Chain
  source 1..783: mol_type = other RNA
gacatccagatgacccaaagcccctcctctgtgtcagccagtgtcggcgatagagttacaattacttgcagggctagccaggacatatccacgtggctggcatggtaccagcagaagcctgggaaagccccaaagctccttatctatgcggcttcttcgctgcaatcaggagtgccgagccggttcagtggttccggctctgggaccgattttacattgactattagctccttacagcccgaggacttcgccacctacttttgtcagcaggcaaactcattccctccaacatttggatgcggcaccaaactggaaatcaagggtgggggaggcagtggcgggggaggtagcggcgggggaggctctggtgggggaggctccgaggtacagctagtggtctcaggcgggggactcgtgaaacccggtggcagcctgcgccttagttgtgccgcttctgggctgtccttcttgaatgcatggatgagctgggttcgacaagcccctggaaagtgcctcgaatgggtgggccgtattaagtcgaacactgatggtgggacaaccgactatgctgccccagtcaaaggcagattttctatctccagggatgactcaaagaatatgctgttcctgcacatgagtagcctccggacggaggatactgcggtgtactattgtgcaaccgacggaccctactccgatgactttcgctctggctatgccgctagatacaggtacttcgggatggatgtatggggacagggtacaactgttaccgtgagctca

SEQ ID NO: 28122 - RNA, 783 nt, synthetic construct; identical to SEQ ID NO: 28121
  misc_feature 1..783: note = derived and/or modified sequence opt3 from anti-influenza_Chain
  source 1..783: mol_type = other RNA

SEQ ID NO: 28123 - RNA, 789 nt, synthetic construct
  misc_feature 1..789: note = derived and/or modified sequence opt3 from anti-influenza_Chain
  source 1..789: mol_type = other RNA
atgggcttcgtgctgtttagccagctcccctccttccttctggtctctaccttgttactgtttctagttatctcacacagttgcagagcccaaaacgggggaagctacccttataagtccggtgagtacaggacaaaatctttctttggctatgggtactatgaagtgcggatgaaggctgccaaaaatgtaggaattgtgtcgtcattctttacttacacgggcccaagcgacaacaatccgtgggatgagatagacatcgagttcctcggtaaggataccacaaaagtccagtttaactggtataagaatggggtgggaggcaacgaatacctgcataatcttggcttcgacgcaagtcaggattttcacacttacgggttcgaatggcgccccgactatattgatttttacgttgacggaaagaaagtgtatcgaggtacccgtaacatccctgtcacaccaggcaagattatgatgaatctgtggcccgggatcggagtggatgagtggttgggcagatacgacggtaggacccctctccaggcggagtatgaatacgtaaaatattacccaaacgggcggtccaagctggttgtgaatactcccttcgtcgctgtgttctctaactttgatagctcccaatgggagaaagccgactgggcaaatggatcagtgttcaactgtgtctggaagcctagtcaggttacatttagcaatggcaagatgatactgaccctcgatcgcgaatacgtggaccatcaccatcaccaccataaagacgagtta

SEQ ID NO: 28124 - RNA, 789 nt, synthetic construct; identical to SEQ ID NO: 28123
  misc_feature 1..789: note = derived and/or modified sequence opt3 from anti-influenza_Chain
  source 1..789: mol_type = other RNA

SEQ ID NO: 28125 - RNA, 840 nt, synthetic construct
  misc_feature 1..840: note = derived and/or modified sequence opt3 from anti-influenza_Chain
  source 1..840: mol_type = other RNA
atggcccaggtgggcagaggggctagccccctgtccagggcacgggtccctccactcccgcacccccttgacggagagcatctgcctcacgatccagccggtggcgggcatggaaaggcgtcttcacaagacgctcccgttggccagttgcctggtcacttagcccgcccagcattctttcattacctgaaaaacagtttcctagtgtgcagcctcaccacagtatttgccctggctgtggcaactttcgccgggtatgctcttgcccgatttcgtttccccggagcggaactgtttggcggctccgtcttggtgacgcaggttatccctgggattctcttcctgataccaatctacattatgtatatctacgtgcagaattgggtcagatctgcactgggactcgaggtgaggttagtaggttcgtatggcgggctggtttttacctacacagccttctttgtgccgctttcaatttggatcttgcggggattctttgctagcatacccaaggaactggaggaagccgcaatggtcgatggcgctactcctttccaagccttccaccgcgtgatcctaccactcgcgctgcccggtcttgccgcaaccgctgtgtatatttttctgacagcctgggacgagctcttgttcgctcaggtcctgaccactgaggccacagcaaccgttcctgtggggatcagaaactttgtaggaaattaccagaacaggtacgatttagtgatggccgctgcgacggtcgcaactctgccagtgctcgttcttttctttttcgtgcagcggcaactgattcagggcttgaccgccggcgctgtcaaaggg

SEQ ID NO: 28126 - RNA, 840 nt, synthetic construct; identical to SEQ ID NO: 28125
  misc_feature 1..840: note = derived and/or modified sequence opt3 from anti-influenza_Chain
  source 1..840: mol_type = other RNA

SEQ ID NO: 28127 - RNA, 843 nt, synthetic construct
  misc_feature 1..843: note = derived and/or modified sequence opt3 from anti-influenza_Chain
  source 1..843: mol_type = other RNA
atggccgacaacatgaccacaactcagatcgaggtgggccccggggctacgaatgcaaccattaacttcgaagccggaatactggagtgctacgaaagatttagctggcaaagggcgctcgattatcctggtcaggaccggcttcaccgcctgaagcgaaaattggagtcccgtatcaagacacataataaatctgaaccagagaacaagagaatgtcattagaggaaaggaaagctattggcgtcaagatgatgaaggttctgctattcatggatccgagtgccgggatcgagggatttgaaccctactgtgtgaaaaatcctagcacttccaagtgcccaaactatgactggaccgattatccccctacaccaggcaaatacctcgacgatattgaggaggaacccgagaatgtagaccaccctatcgaagtggtcctgcgggatatgaacaataaggacgcacgccagaaaataaaggatgaggtgaacacccagaaggaaggtaaattcagacttactatcaagagggacattcggaatgttctgtctttgcgcgtgctcgtcaacgggacatttctgaaacatccaaatggagataagtcgctgtcaaccctccaccgattaaacgcctacgaccaaaatggcggcctggtggctaaacttgtagcaacggacgatagaactgttgaggacgagaaggatgggcataggatcttgaacagcctgttcgaacggtttgacgagggacacagtaaaccgattcgtgccgctgaaaccgccgtgggtgtcctatcccagttcggccaggagcaccgcctctctcccgaagagggggataac

SEQ ID NO: 28128 - RNA, 843 nt, synthetic construct; identical to SEQ ID NO: 28127
  misc_feature 1..843: note = derived and/or modified sequence opt3 from anti-influenza_Chain
  source 1..843: mol_type = other RNA

SEQ ID NO: 28129 - RNA, 858 nt, synthetic construct
  misc_feature 1..858: note = derived and/or modified sequence opt3 from anti-influenza_Chain
  source 1..858: mol_type = other RNA
atgtgcaccatgcccctgatgaagctcaaaaagatgatgagaaggacagccttccttctgagcgtgttgatcggctgttccatgttagggtctgaccggtcagataaagctcctcactgggagctggtctggagtgacgaatttgattacagcggactaccagacccggagaagtgggattatgacgttggtggccatgggtggggaaaccaggaactccaatactatactcgcgcacgaattgagaatgcccgtgtgggcggtggggtactgataatcgaagcgagacacgagccctacgagggaagggaatatacgtccgctcggcttgtgacccgcggcaaagcctcttggacatacggcagattcgagattagggcacggctgccttcggggcgcggaacttggccagccatctggatgttgcccgatcgacagacctatggttcagcttactggcctgacaacggcgaaattgatatcatggagcatgtcgggtttaatccagacgtggttcacggaacagtgcataccaaggcatacaaccacctcctgggcactcagagaggtgggagcataagggtccccacagcccggaccgatttccacgtgtatgctatcgagtggacgcctgaagagattcgttggtttgtagacgatagtctgtactatcgcttcccaaatgaaagactcactgacccggaggccgactggaggcattggccctttgatcagcctttccacttaatcatgaacattgcggttggaggcgcatggggcgggcaacagggagtggacccagaagcctttcccgctcagctggtcgtggattacgtgcgggtctatcgatgggttgag

SEQ ID NO: 28130 - RNA, 858 nt, synthetic construct; identical to SEQ ID NO: 28129
  misc_feature 1..858: note = derived and/or modified sequence opt3 from anti-influenza_Chain
  source 1..858: mol_type = other RNA

SEQ ID NO: 28131 - RNA, 900 nt, synthetic construct
  misc_feature 1..900: note = derived and/or modified sequence opt3 from anti-influenza_Chain
  source 1..900: mol_type = other RNA
aacgtgcccgagtggagctacatcgtcgaaaaggccaatcctgctaacgacctgtgctatccaggcaatttcaacgattacgaggaactcaaacaccttctgtccagaattaatcattttgagaagatacaggggtatatcccggaagcacccagggacggacaagcctacgttcggaaagatggtgagtgggtgttgttatctaccttcctgcgctcagacaagacacacacttgtcctccatgccccgcgcctgagctactcggcgggccaagtgtatttctgtttccccctaaaccaaaggatacgcttatgattagccgaaccccggaagtgacatgtgtcgtggttgacgtgtcccatgaggatcccgaagtcaagtttaactggtatgtggacggagtagaggttcacaatgctaaaactaagcctcgtgaggaacagtacaactctacctatagagtggtctcggtgctgacagtgttgcatcaggattggctcaatggcaaagagtacaagtgcaaagtctcaaacaaggccctgccagcacccatcgaaaagaccattagcaaagccaagggtcagcctagggagccacaagtttacactctgcccccgagtcgggaagagatgaccaaaaatcaggtgtccctcacatgtttagtaaaggggttctatccttctgacatcgctgtggagtgggaaagcaacggacagcccgagaataactacaaaacgactccacctgtcctggattccgacggctcatttttcctttatagtaagttgaccgtggataaaagccgctggcagcaaggcaatgttttctcttgctccgtgatgcacgaagcactgcacaaccattacacacagaagtcactaagcctcagtcccgggaag

SEQ ID NO: 28132 - RNA, 900 nt, synthetic construct; identical to SEQ ID NO: 28131
  misc_feature 1..900: note = derived and/or modified sequence opt3 from anti-influenza_Chain
  source 1..900: mol_type = other RNA

SEQ ID NO: 28133 - RNA, 927 nt, synthetic construct
  misc_feature 1..927: note = derived and/or modified sequence opt3 from anti-influenza_Chain
  source 1..927: mol_type = other RNA
atggtgaacagaagggacctgatcaagtggagcgccgtcgctctcggcgcaggggccggacttgcgggtcccgctcctgccgcacacgccgctgatctggagtgggaacagtacccagttccggcagcccccggcgggaatcggtcctggcaattgttaccttctcattcagacgatttcaactataccggaaaaccacagacatttcgcggccgatggctggaccagcacaaggatggttggagtgggcccgctaatagcctatactccgcccgtcattcttgggtggcggacggaaacctcattgtagagggcagaagggcacctgatggccgggtgtattgcgggtacgtcacttcgcgcacgccagtggaatatcccctgtacaccgaggttcttatgagagtgtcaggactgaaattgagcagtaatttctggctcctgtccagggacgatgtcaacgaaatagacgtgatcgagtgttatggtaatgagtctctgcacggcaagcatatgaacacagcctaccacatttttcagcggaatcctttcactgaactcgctcgcagccaaaaagggtactttgccgatggatcctatggctacaacggtgagaccgggcaggtattcggagacggcgcaggccagccattactgcgaaatgggtttcacagatatggagttcattggatctcagctacagagttcgatttttacttcaacggtaggcttgtgcggcgtttgaatcgcagtaacgacctgagagacccgaggagccggtttttcgatcagcccatgcacctaattctcaataccgaatctcatcaatggcgagtcgaccgcggcatcgagcctactgatgccgaactggcggacccatccataaacaacatctattacagatgggtgaggacatatcaggccgtg

SEQ ID NO: 28134 - RNA, 927 nt, synthetic construct; identical to SEQ ID NO: 28133
  misc_feature 1..927: note = derived and/or modified sequence opt3 from anti-influenza_Chain
  source 1..927: mol_type = other RNA

SEQ ID NO: 28135 - RNA, 960 nt, synthetic construct
  misc_feature 1..960: note = derived and/or modified sequence opt3 from anti-influenza_Chain
  source 1..960: mol_type = other RNA
atctgcattggctaccacgccaacaatagcaccgaacaggtggacacaataatggaaaagaacgtcactgttacgcatgctcaagatatcctggagaaaacccacaatgggaagctctgtgaccttgatggagtgaaacccctgattttgagagactgctccgtagcaggttggttactgggcaaccctatgtgtgatgagttcatcaatgtgccagagtggtcttatattgtcgaaaaggccaacccggcgaatgacctatgctaccccgggaactttaatgattatgaggagctcaaacatctgctttcaaggatcaaccacttcgaaaagatacagatcattcctaagagtagctggtccgaccatgaggcttcttcgggagtgtcaagcgcctgtccataccagggcacaccctcctttttccggaatgttgtgtggctgatcaaaaagaacaatacttatcctaccattaaacgcagttacaacaatacaaaccaggaagatttgctcatcctgtggggtatacaccactctaacgacgcagccgagcaaaccaagctgtatcagaatccaactacatacattagcgtcgggacctccacgctcaaccagcgattagtgcccaaaatcgctactcgttcaaaggtaaatggacagaacggcagaatggactttttctggaccattctgaagcctaatgatgcaatcaactttgagagtaatggcaacttcatcgccccagaatacgcttataaaattgttaagaaaggggatagcgccatagtgaagtctgaggtcgaatacggaaattgcaacacaaaatgtcaaactccgatcggtgcgattaattcctcaatgccctttcataacatccaccctcttaccataggcgagtgcccaaagtatgtgaaaagcaataagttggtgctggcaacagggctaaggaacagtcccctc

SEQ ID NO: 28136 - RNA, 960 nt, synthetic construct; identical to SEQ ID NO: 28135
  misc_feature 1..960: note = derived and/or modified sequence opt3 from anti-influenza_Chain
  source 1..960: mol_type = other RNA

SEQ ID NO: 28137 - RNA, 960 nt, synthetic construct; identical to SEQ ID NO: 28135
  misc_feature 1..960: note = derived and/or modified sequence opt3 from anti-influenza_Chain
  source 1..960: mol_type = other RNA

SEQ ID NO: 28138 - RNA, 978 nt, synthetic construct
  misc_feature 1..978: note = derived and/or modified sequence opt3 from anti-influenza_Chain
  source 1..978: mol_type = other RNA
accctgtgcatcggctaccacgccaacaatagcacagacactgtggatacggtcctcgagaagaacgttaccgtgacacattccgtaaatcttctggaagacaaacacaacgggaagttgtgtaaattaagaggagtggctcccctgcatctaggtaagtgcaatattgcaggctggatactcgggaaccctgagtgtgaatctctgtcaactgccagtagctggtcctatatcgtcgagacctcttcgtcagataatggaacatgctacccaggcgacttcattgattatgaggaacttagggagcagctgagcagtgtgtcctcttttgaacggttcgagatctttccgaaaaccagctcctggcccaaccacgactcaaataagggtgttactgcggcttgtcctcatgccggggcaaagagtttctacaaaaacttgatttggctcgtgaagaaaggaaatagctatccaaagctgtctaaatcctacatcaacgataagggcaaggaagtcctggtgctctggggcatacaccacccctcaacaagcgccgaccaacagagtttatatcagaatgctgatgcatacgtatttgttgggacctctcgctactccaaaaagttcaaacctgagatcgccattcgaccaaaggtgcgtgaccaggagggaagaatgaactattactggacgctggtcgaacccggtgataaaatcacttttgaggctaccggcaatcttgtggtgcctaggtatgccttcgcgatggaacgggacgcagggagcggaattatcatatcggatacaccagtccatgactgcaacactacctgtcaaacaccgaagggcgccattaacacctctttgccctttcagaatatccaccctattacgatcggtaaatgcccaaagtacgttaagtccactaaactgcgcctagctacagggctcagaaacgtgccctcaatccagagtagg

SEQ ID NO: 28139 - RNA, 978 nt, synthetic construct; identical to SEQ ID NO: 28138
  misc_feature 1..978: note = derived and/or modified sequence opt3 from anti-influenza_Chain
  source 1..978: mol_type = other RNA

SEQ ID NO: 28140 - RNA, 960 nt, synthetic construct; identical to SEQ ID NO: 28135
  misc_feature 1..960: note = derived and/or modified sequence opt3 from anti-influenza_Chain
  source 1..960: mol_type = other RNA

SEQ ID NO: 28141 - RNA, 990 nt, synthetic construct
  misc_feature 1..990: note = derived and/or modified sequence opt3 from anti-influenza_Chain
  source 1..990: mol_type = other RNA
atgtgcagctccatcccctctctgagagaggtgttcgccaacgactttaggattggcgctgcagtcaatcctgttaccctcgaagcccagcaatcacttctgatacggcacgtgaacagtttgacagcggagaatcatatgaagttcgaacacttacagccagaggaagggcgctttactttcgatatcgctattaaaagctccacgtctccgttttcgtcacatggagtacgaggtcacaccctggtgtggcataaccagacacccagctgggtcttccaggacagtcaaggccactttgtggggcgtgatgttctactcgagagaatgaagtcccacatctctactgtggtccagaggtacaaaggaaaggtgtattgttgggacgtaattaatgaggccgttgcagatgaaggcagcgagtggctgcggtcctcaacctggcgccagatcataggtgacgatttcatccagcaagcctttctttacgctcatgaagcagaccctgaggccctgttgttctataacgattacaatgagtgctttccagagaaaagagaaaagatttatacactcgtgaagagtctgagggacaaagggatccccattcacggaatcggcatgcaggctcattggagcctgaaccggcctaccctcgatgaaatacgcgccgcgattgagcgatacgcatctttaggcgtcatcctgcacattactgaacttgacatctccatgttcgagtttgatgaccacagaaaggacttggccgctccaacaaatgagatggtggaaaggcaggccgagcggtatgaacagatcttctcactgttcaaagagtaccgtgatgtgattcaaaacgtcaccttttgggggatagcagacgatcatacgtggctagaccacttccccgttcagggacgcaagaattggcctctcctgtttgatgaacagcataacccaaaaccggctttctggagagtggtaaatatc

SEQ ID NO: 28142 - RNA, 990 nt, synthetic construct; identical to SEQ ID NO: 28141
  misc_feature 1..990: note = derived and/or modified sequence opt3 from anti-influenza_Chain
  source 1..990: mol_type = other RNA

SEQ ID NO: 28143 - RNA, 1002 nt, synthetic construct
  misc_feature 1..1002: note = derived and/or modified sequence opt3 from anti-influenza_Chain
  source 1..1002: mol_type = other RNA
atgaagaacagagtgatcagcctgctcatggcctcccttctgttggtcttatctgttattgtggctcccttctacaaagcagaggccgcgaccgtagtgaatacaccttttgtcgctgtgttctcaaactttgacagtagccagtgggaaaaggccgattgggcaaatggctccgttttcaactgcgtgtggaaaccatctcaagtcactttttcgaatgggaagatgatactgacgctagacagggagtatggaggttcatacccgtataaaagcggcgaataccggaccaagagtttctttgggtatggatactatgaggtgcgcatgaaggccgctaaaaacgtaggcatcgtttcctctttctttacatacactggtcccagcgataataacccttgggacgaaattgatatcgagttcctcgggaaggacaccacaaaagtgcagtttaattggtacaagaacggagtcggcggcaatgagtatctgcacaaccttgggttcgatgcatcccaggactttcatacctacggattcgaatggcgaccagattatattgacttctacgtggatggtaaaaaggtgtatcgtggcactagaaatatccccgtcacacctgggaagataatgatgaacctgtggccaggaatcggcgttgacgagtggttgggtaggtacgatgggcggacgcccctccaggccgaatatgagtacgtgaaatactatcctaatggagtaccacaagacaacccgacccccactcctaccattgctccatcaacacccactaaccctaatctgccactgaagggcgacgtgaacggcgatgggcacgtcaatagtagcgactactctctctttaaacgctatttactgagagtgatcgataggttccccgttggagaccagtccgtggccgatgtcaaccgggacggtcgcattgattcaaccgaccttacaatgttgaagcgatacctgatcagagcgataccgagccta

SEQ ID NO: 28144 - RNA, 1002 nt, synthetic construct; identical to SEQ ID NO: 28143
  misc_feature 1..1002: note = derived and/or modified sequence opt3 from anti-influenza_Chain
  source 1..1002: mol_type = other RNA

SEQ ID NO: 28145 - RNA, 1041 nt, synthetic construct
  misc_feature 1..1041: note = derived and/or modified sequence opt3 from anti-influenza_Chain
  source 1..1041: mol_type = other RNA
atctgcattggctaccacgccaacaatagcaccgaacaggtggacacaataatggaaaagaacgtcactgttacgcatgctcaagatatcctggagaaaacccacaatgggaagctctgtgaccttgatggagtgaaacccctgattttgagagactgctccgtagcaggttggttactgggcaaccctatgtgtgatgagttcatcaatgtgccagagtggtcttatattgtcgaaaaggccaacccggcgaatgacctatgctaccccgggaactttaatgattatgaggagctcaaacatctgctttcaaggatcaaccacttcgaaaagatacagatcattcctaagagtagctggtccgaccatgaggcttcttcgggagtgtcaagcgcctgtccataccagggcacaccctcctttttccggaatgttgtgtggctgatcaaaaagaacaatacttatcctaccattaaacgcagttacaacaatacaaaccaggaagatttgctcatcctgtggggtatacaccactctaacgacgcagccgagcaaaccaagctgtatcagaatccaactacatacattagcgtcgggacctccacgctcaaccagcgattagtgcccaaaatcgctactcgttcaaaggtaaatggacagaacggcagaatggactttttctggaccattctgaagcctaatgatgcaatcaactttgagagtaatggcaacttcatcgccccagaatacgcttataaaattgttaagaaaggggatagcgccatagtgaagtctgaggtcgaatacggaaattgcaacacaaaatgtcaaactccgatcggtgcgattaattcctcaatgccctttcataacatccaccctcttaccataggcgagtgcccaaagtatgtgaaaagcaataagttggtgctggcaacagggctaaggaacagtcccctcggatacattcctgaagccccacgggacggccaggcttatgtccgcaaggacggtgagtgggttctgctttctaccttcctg

SEQ ID NO: 28146 - RNA, 1041 nt, synthetic construct; identical to SEQ ID NO: 28145
  misc_feature 1..1041: note = derived and/or modified sequence opt3 from anti-influenza_Chain
  source 1..1041: mol_type = other RNA

SEQ ID NO: 28147 - RNA, 1047 nt, synthetic construct
  misc_feature 1..1047: note = derived and/or modified sequence opt3 from anti-influenza_Chain
  source 1..1047: mol_type = other RNA
atgaacatcaagaaaaccgccgtcaagagcgctctggcagtggccgcggctgccgcagccctcacaactaatgtttccgctaaagacttctctggcgcagagctttacacgctggaagaggtgcagtatgggaagtttgaagccagaatgaaaatggctgccgcgtcaggaaccgtaagtagcatgttcttgtaccaaaacggttccgagattgcagatggcaggccctgggtggaagtcgacatagaggtgttagggaagaatcctggatcttttcagtcgaacatcattacaggcaaggccggtgctcagaaaacttcagagaagcaccatgccgttagcccagcagctgatcaggccttccacacctatgggctggaatggacaccgaattacgtgcggtggaccgtcgacggacaagaggtgcgcaaaactgaaggcggccaggtaagtaacctaacagggacccagggactccgatttaatctgtggtcctctgagagcgcggcctgggttggtcagttcgatgagtccaaacttcccctgtttcaattcatcaactgggtgaaggtctataagtacacgcctggccagggggaaggaggctcagactttactttggattggaccgacaatttcgatacatttgacggtagtcgttgggggaagggagattggactttcgacggcaacagagtggatctcaccgacaaaaatatttatagcagggacggcatgctgatcctggcactcacacggaaggggcaggagtcttttaacggacaggtgccacgcgatgacgaacccgctcctcaatcctcaagcagtgccccagcttcttccagctcggtccccgcctcttcctcaagtgttcctgcaagctcctctagcgccttcgtgccaccgtcaagttccagcgctaccaatgcgatacatggtatgagaacgactcccgcagtagccaaagagcacaggaacttagtgaatgctaagggcgccaaagtcaaccctaacgggcataagcggtaccgcgtgaatttcgaacac

SEQ ID NO: 28148 - RNA, 1047 nt, synthetic construct
  misc_feature 1..1047: note = derived and/or modified sequence opt3 from anti-influenza_Chain
  source 1..1047: mol_type = other RNA
gaggtgcagctggtcgaaagcggcgggggagttgtgcaacccggtagatccctcaggctttcttgcgccgcttcaggcttcgcatttcacaaccgggccatgcattgggtacgccaggcgcctgggaagggactggagtgggtggctttgatctacttcgacggcagtaaacagtattacgccgatagcgtcaagggtcgatttaccatttcccgtgacaattctaaaaacacagtgttcttacagatgaactcgctgagaccagaagatactgcagtttattactgtgccgtgccggggcccatatttggaatcttccctccatggtcatattttgaccactggggccaaggcattctagtcacggtgagcagtgcttccaccaaggggccctctgtattccctctcgcaccaagctccaaatcaacaagtggaggtactgccgctctgggctgccttgttaaggattactttcccgagcctgtgaccgtcagctggaactctggggccctgacatccggagtgcataccttcccagcggtgttgcagtcaagcggcctctatagtctgtcttccgtcgttactgtgccgagctcgtctctgggtacacagacctacatctgtaatgtaaatcacaagccctccaatacgaaagtggacaagaaagtcgaacctaagtcatgcgataaaactcatacctgtccaccctgccctgcaccagagctcttagggggacccagtgtgtttctgttcccgcctaagcccaaggacacacttatgattagcaggactccagaggttacctgtgtggtcgtggatgtatcccacgaagaccctgaggttaaatttaactggtacgtggatggcgtcgaagtgcacaatgccaagacaaaaccccgggaggagcagtataactctacctaccgcgtcgtgagcgttttgacggtgctgcatcaagactggctaaatggcaaggaatataaatgcaaggtatcaaacaaagctctcccagcccccatcgagaagactataagtaaggcaaaaggg

SEQ ID NO: 28149 - RNA, 1047 nt, synthetic construct; identical to SEQ ID NO: 28148
  misc_feature 1..1047: note = derived and/or modified sequence opt3 from anti-influenza_Chain
  source 1..1047: mol_type = other RNA

SEQ ID NO: 28150 - RNA, 1047 nt, synthetic construct; identical to SEQ ID NO: 28147
  misc_feature 1..1047: note = derived and/or modified sequence opt3 from anti-influenza_Chain
  source 1..1047: mol_type = other RNA

SEQ ID NO: 28151 - RNA, 1161 nt, synthetic construct
  misc_feature 1..1161: note = derived and/or modified sequence opt3 from anti-influenza_Chain
  source 1..1161: mol_type = other RNA
atgaacaagttcctgaataaaaagtggagcctcatccttaccatgggcgggatttttctgatggccacattgtccttaatattcgctactggtaaaaaggcatttaacgaccagacgtctgccgaggatatcccctcactggcggaagccttcagagactactttcctattggagccgcaatcgagccaggctataccacagggcaaattgccgaactatacaaaaagcacgtgaatatgctcgtcgctgagaacgcaatgaagccggccagtctgcagcccactgaaggaaatttccagtgggctgatgccgacaggatcgttcagtttgcgaaagagaacggcatggagcttcggttccataccctggtgtggcacaatcaaacacctaccggttttagcttggataaggaagggaaaccaatggtagaggaaactgacccccagaagcgcgaggagaaccgaaaactcctgctgcagcgtctcgaaaattatataagagcagtggtcttaaggtacaaggatgacatcaagtcctgggatgtggttaacgaggtgattgaacctaatgacccaggaggcatgcggaactctccctggtatcagatcacaggcaccgagtacattgaagtcgccttccgcgctacgagagaggccgggggatcggatatcaaactgtatataaatgactacaacactgatgaccctgtgaagagggacattctttacgagttggttaaaaatctgctagaaaagggtgtaccaatcgatggcgtggggcatcaaacccacattgacatctataacccgcccgtcgagcggatcattgaatcaatcaaaaagtttgcaggactcggcctggataacataattacagagcttgacatgagcatctacagttggaatgatcgctccgactatggtgattctatacctgactacattctgactttgcaggctaaacgatatcaggaactcttcgatgccctgaaggagaacaaggacatcgtgagcgcggtggtcttttgggggatctccgataaatactcatggttaaatggattcccagttaagagaaccaacgctcccctcctgttcgacaggaattttatgcctaaaccagcattctgggctattgtggaccccagtcggcttcgtgag

SEQ ID NO: 28152 - RNA, 1161 nt, synthetic construct; identical to SEQ ID NO: 28151
  misc_feature 1..1161: note = derived and/or modified sequence opt3 from anti-influenza_Chain
  source 1..1161: mol_type = other RNA

SEQ ID NO: 28153 - RNA, 1221 nt, synthetic construct
  misc_feature 1..1221: note = derived and/or modified sequence opt3 from anti-influenza_Chain
  source 1..1221: mol_type = other RNA
atgagaaacgtggtcaggaagcccctgaccatcggcctcgcccttacactgttgttacctatggggatgactgctacgagcgccaaaaatgcagactcctacgcgaagaaaccacacatttctgctctgaacgccccgcagctagatcaacggtataagaatgagttcaccataggagcagccgttgaaccctaccagctccagaacgagaaagacgtgcagatgctgaagcgccattttaattcaatcgtagctgaaaacgtgatgaagcctattagtatccaaccagaggaaggtaaattcaattttgagcaggcagatcgaattgtcaagttcgccaaagctaacggcatggacatccgttttcacacacttgtgtggcatagccaggttccccagtggttctttctggataaggaggggaaacctatggtgaatgaaactgacccagtcaagagagagcaaaacaagcagttgctcctgaaaaggctggaaacccacataaagacaatcgtggagcggtataaagatgacattaagtactgggatgtagttaatgaggtggtcggagacgatggcaaactccgcaactccccctggtatcagatcgccggtattgactacatcaaggtggcgttccaggcagccagaaaatatgggggagataatataaagttatacatgaacgactacaataccgaagtggagcctaagaggactgctctgtataaccttgtcaaacaattgaaggaagagggcgttccaattgacggcatcgggcatcagtctcacattcagatcggatggccgtcggaagccgagatcgagaaaacaattaacatgtttgcagctctgggtctagataatcaaataaccgaactcgacgtgtcaatgtacggctggccccctcgggcctatccaacgtacgatgcgatccccaagcagaaattcctggaccaggccgcacgctatgatcgactttttaagctgtacgagaagttgagcgacaaaattagtaacgtaactttctgggggatcgctgataatcacacctggctcgactccagagccgatgtgtattacgacgctaacggaaatgtcgtggttgatcctaacgccccatacgcaaaggtggaaaaaggcaagggtaaagacgccccctttgtcttcgggccggactataaggtgaagcctgcttactgggcgataattgatcataaa

SEQ ID NO: 28154 - RNA, 1221 nt, synthetic construct; identical to SEQ ID NO: 28153
  misc_feature 1..1221: note = derived and/or modified sequence opt3 from anti-influenza_Chain
  source 1..1221: mol_type = other RNA

SEQ ID NO: 28155 - RNA, 1233 nt, synthetic construct
  misc_feature 1..1233: note = derived and/or modified sequence opt3 from anti-influenza_Chain
  source 1..1233: mol_type = other RNA
ctgagcagaatcaaccacttcgagaagattcagataatccccaaatcctcttggtcagaccatgaagccagtagcggcgtgtcctctgcttgcccttaccaagggaccccatcgtttttcaggaatgtcgtttggctcattaagaaaaacaatacatatccgactatcaagcggtcatacaacaatacgaaccaggaggatcttctgattttgtggggaatccaccatagcaatgacgcagccgaacagaccaaattatatcagaaccccacaacttacataagtgtgggtacctccacactgaatcaacgcctagtacctaagatcgcgacccgatctaaggtgaacggccagaatgggcgtatggactttttctggactattctcaaaccaaacgatgctatcaattttgagagcaacggaaatttcattgcccccgaatatgcatacaagatcgtcaaaaagggctatatacctgaggccccaagagatggtcaggcttacgtgaggaaagacggggagtgggttctgctttccacatttctgcggtcagataagacccacacgtgtcccccttgcccagcaccggaattgctcggaggccccagtgtgttcctgtttcctccaaagcccaaagacactctgatgattagccgcacccctgaggtcacatgtgtggtagttgatgtgtctcatgaagacccagaggtcaagttcaactggtacgtggatggcgtggaggtccacaacgccaaaactaagcccagagaggaacagtataattccacctacagggttgtgtcagtactcacagtgttacaccaagactggctgaacgggaaagaatataagtgcaaagtcagcaataaggcccttccggctcctatcgagaagaccattagtaaagcgaagggacagccccgggaaccacaggtgtacacgttgcctccctctcgcgaggagatgactaaaaaccaggtttccctgacatgtctagtgaagggtttttatccaagcgatatcgcagtcgaatgggagtcgaatggccaacccgaaaacaattacaaaaccactcctccagtgctcgactctgacgggtccttctttctgtattcaaaacttacagtagataagagtcgatggcagcagggaaacgttttcagctgctccgtgatgcatgaggccctgcacaatcattacacccaaaagtctttgagcctctcaccgggcaag

SEQ ID NO: 28156 - RNA, 1233 nt, synthetic construct; identical to SEQ ID NO: 28155
  misc_feature 1..1233: note = derived and/or modified sequence opt3 from anti-influenza_Chain
  source 1..1233: mol_type = other RNA

SEQ ID NO: 28157 - RNA, 1293 nt, synthetic construct
  misc_feature 1..1293: note = derived and/or modified sequence opt3 from anti-influenza_Chain
  source 1..1293: mol_type = other RNA
atggacgatcacgccgagaagttcctgtggggcgtggctaccagcgcataccagatcgaaggggccacacaagaggacggaagaggtccctccatttgggatgcgtttgctaggcggcctggcgccatacgcgacgggtctactggagaaccagcatgcgatcattatcgacgttacgaggaagacatcgccctcatgcagtcacttggcgtcagagcttataggttcagtgttgcatggccgcggattctgcccgagggtcgcgggagaatcaaccctaaaggattggccttttacgataggttagtggaccggctgctagctagcggcattacgccattcctcaccctgtatcactgggatcttcccctggccttggaggaacgcggcgggtggcgatccagagagacagcgtttgcattcgccgaatacgctgaggccgtagcaagggctctcgccgaccgggtgccatttttcgcgactctgaatgagccttggtgttctgcctttctgggacattggaccggtgaacacgcacccggcctccgtaacttagaggctgccctgcgcgctgcccatcaccttttgctggggcacggactagcagtcgaagccctcagagctgcgggcgcaaggcgggtgggtatcgttctgaatttcgcccctgcttatggggaggatccagaagccgtggacgtcgcagatcgataccataaccgctactttcttgacccgatactgggaaagggctatcccgagtcgcctttcagagacccaccccctgtgccaatcttgtcaagggatctcgagctggtagcccggcccttagactttctgggcgttaattactatgctccggtgcgcgtcgcccctgggacaggaaccctccccgtgagataccttccacctgaaggtcccgcaactgcgatgggctgggaggtgtatccagaagggctgcaccatttgctaaaaaggctgggacgtgaggtcccctggcctctctacgttacagaaaacggcgctgcctatccagatctgtggaccggtgaggcagtggtagaggacccggaacgggtggcctaccttgaggctcacgtcgaagccgcactgcgagctagagaggaaggggtggatttgaggggctacttcgtttggagcctcatggacaatttcgagtgggcctttggatatacgcgccggttcggcctgtactatgtggattttcccagtcagagaaggattcctaagcgctccgcgttatggtaccgagagcggatcgcccgtgctcagact

SEQ ID NO: 28158 - RNA, 1293 nt, synthetic construct
  misc_feature 1..1293: note = derived and/or modified sequence opt3 from anti-influenza_Chain
  source 1..1293: mol_type = other RNA
atgaccgagaacgccgaaaagttcctgtggggcgtggctacaagcgcataccagatcgagggggccactcaagaagacggaagaggtccctccatttgggatgcgtttgctcagaggcctggcgccatacgggacgggtctacgggagagccagcatgcgatcactatcgccgatacgaagaggacatcgccctcatgcagtcacttggcgtccgtgcttatagattcagtgttgcatggccgaggattctgcccgagggtcgggggcgcatcaatcctaaaggattggccttttacgatagattagtggacaggctgctagctagcggcattaccccattcctcacactgtatcattgggatcttcccctggccttggaagagagaggcgggtggcgctcccgagaaactgcgtttgcattcgccgagtacgctgaggccgtagcaagagctctcgccgacagggtgccatttttcgcgaccctgaacgaaccttggtgttctgcctttctgggacactggacaggtgagcatgcacccggcctccggaatttagaagctgccctgcgtgctgcccaccatcttttgctggggcacggactagcagtcgaggccctccgcgctgcgggcgcaagaagggtgggtatcgttctgaacttcgcccctgcttatggggaagatccagaggccgtggacgtcgcagatcggtaccacaatcgatttttccttgacccgatactgggaaagggctaccccgagtcgccttttcgcgatccaccccctgtgccaatcttgtcaagagacctcgaactggtagccaggcccttagacttcctgggcgttaactattacgctccggtgcgggtcgcccctgggaccggaactctccccgtgcgctatcttccacctgagggtcccgcaacagcgatgggctgggaagtgtacccagaggggctgtatcatttgctaaaaagactgggaagggaagtcccctggcctctctacgttaccgagaatggcgctgcctatccagatctgtggacgggtgaggcagtggtagaagacccggagcgtgtggcctaccttgaagctcacgtcgaggccgcactgcgggctcgagaagagggggtggatttgagaggctacttcgtttggagcctcatggacaactttgagtgggccttcggatatactaggcgctttggcctgtactatgtggatttccccagtcagcggcggattcctaagaggtccgcgttatggtaccgcgaacgaatcgcccgggctcaaacc

SEQ ID NO: 28159 - RNA, 1293 nt, synthetic construct
  misc_feature 1..1293: note = derived and/or modified sequence opt3 from anti-influenza_Chain
  source 1..1293: mol_type = other RNA
atggccgagaacgctgaaaagttcctgtggggcgtggcaaccagcgcctaccagatcgagggggcgacacaagaagacggaagaggtccctccatttgggatacttttgctaggcggcctggcgccatacgcgacgggtctacgggagagccagcatgcgatcactatcatcgatacgaagaggacatcgccctcatgcagtcacttggcgtcggtgtttatcgtttcagtgtggcttggccgaggattctgcccgaggggaggggacggatcaatcctaaaggcttggcattttacgatcgcttagtagacagactgctagccgctggcattaccccattcctcacactgtatcactgggatcttccccaggccctggaagacagagggggatggcggagccgcgagactgcgtttgcattcgccgaatacgctgaggccgtggcacgagctttggccgatagagtcccatttttcgcgaccctcaacgagccttggtgttccgcctttctgggtcattggacaggcgaacacgcacccgggctgaggaatctcgaggctgccttacgggctgcccatcacttacttttgggacacggcctggcagtggaagccctacgtgctgcgggtgcaaagcgcgttgggatcgtgctcaacttcgcccctgtctatggagaggacccagaagctgtggatgtagccgacagataccataataggtactttctggatccgatacttggccggggctatcccgagtctcctttccaggacccaccccctaccccaaacctgtcgcgagacttggagctcgttgcacgccccctggattttctgggggtgaattactatgccccggtcagagtggctcctggaactggtcccctgccagtgaggtacctccctcccgaaggcccagtcacagccatggggtgggaggtttatcccgaaggactttaccacctgttgaaacggctaggccgcgaggtgccttggccactgtatatcaccgaaaacggtgcagcgtacccggacctctggacgggggaggctgtagtggaggatcccgaaagagtcgcctacctggaggcacatgtggaagccgctcttagggcccgtgaggaaggcgttgacctgcggggatatttcgtgtggtcattgatggataatttcgagtgggcatttggctacactcgaagattcgggctctattacgtcgactttcctagccaaaggcgcattccaaagcggagtgctctgtggtatagagagaggatcgcccgcgcgcagtta

SEQ ID NO: 28160 - RNA, 1293 nt, synthetic construct; identical to SEQ ID NO: 28157
  misc_feature 1..1293: note = derived and/or modified sequence opt3 from anti-influenza_Chain
  source 1..1293: mol_type = other RNA

SEQ ID NO: 28161 - RNA, 1293 nt, synthetic construct; identical to SEQ ID NO: 28158
  misc_feature 1..1293: note = derived and/or modified sequence opt3 from anti-influenza_Chain
  source 1..1293: mol_type = other RNA

SEQ ID NO: 28162 - RNA, 1293 nt, synthetic construct; identical to SEQ ID NO: 28159
  misc_feature 1..1293: note = derived and/or modified sequence opt3 from anti-influenza_Chain
  source 1..1293: mol_type = other RNA

SEQ ID NO: 28163 - RNA, 1296 nt, synthetic construct
  misc_feature 1..1296: note = derived and/or modified sequence opt3 from anti-influenza_Chain
  source 1..1296: mol_type = other RNA
atgttcaagcccaactaccactttttccctatcaccggctggatgaatgacccaaacgggctgatattttggaaaggaaagtatcatatgttctaccagtataatccgagaaaacccgagtggggtaacatttgctggggccacgccgtgagcgatgacctcgtccattggaggcaccttcctgttgctctgtacccagatgacgaaacacatggggtgttttccggatctgcagtagagaaggatggcaaaatgttcttggtgtatacttactatcgggaccccacgcacaataagggtgaaaaggagacccaatgtgtcgccatgtcagaaaacgggttagattttgtgaaatacgacggaaatcctgttatcagtaagccacccgaggagggcacacacgcgttccgcgatcctaaagtgaaccgaagcaatggcgaatggcgtatggtcctggggtccggaaaggacgagaaaattggtagagtgctactctacacttctgatgacctgtttcattggaagtatgaaggcgtaatcttcgaggatgagaccacaaaggaaattgagtgcccagaccttgttaggatcggggaaaaagacatactgatctactcgattacctcaactaacagcgtgttgtttagtatgggagagctcaaggaaggcaaactgaatgtcgagaagcggggtctgctcgatcacgggacagacttctatgctgcccagacctttttcggaacggatcgcgtggtggtcatcggctggttacagtcctggctgagaactggcctttacccgaccaaaagggaggggtggaacggagttatgtctttgccccgggaactgtatgtggagaataacgaactaaaggtaaaacctgtggacgagctcctggcacttcgcaagcgaaaggtcttcgaaacagccaaaagcggtacttttctgttggatgtgaaggaaaattcctacgagattgtttgtgagttctcaggcgagatcgaactcagaatggggaacgagagtgaagaggtggtcataaccaaaagcagggacgagctgattgtggatacaacccggtctggagtatccggcggtgaagttcgtaagtcaacggtggaggacgaagctactaaccgcatcagagcatttttagatagctgcagtgtcgagttctttttcaatgactctattgccttttccttcaggatccatccagagaacgtgtataatatcctgagcgtcaaatcgaaccaggtgaagctcgaagtttttgagcttgaaaatatttggctg

SEQ ID NO: 28164 - RNA, 1296 nt, synthetic construct; identical to SEQ ID NO: 28163
  misc_feature 1..1296: note = derived and/or modified sequence opt3 from anti-influenza_Chain
  source 1..1296: mol_type = other RNA

SEQ ID NO: 28165 - RNA, 1323 nt, synthetic construct
  misc_feature 1..1323: note = derived and/or modified sequence opt3 from anti-influenza_Chain
  source 1..1323: mol_type = other RNA
gaggtgaagctggtcgaaagcggcgggggactcgttcagcccggtggctcccttagactgtcttgcgccacctcagggttcacatttagtgactactatatgagctgggtgaggcaatcccctggaaaagccttggagtggttaggcttcactcggtctcgcgtactgggttacacgaccgattattcggcatcagtgaaggggcgatttacaatcagccgtgacaacagtcagtccattctatacctccagatgaactctctgagaggagaagatagcgccacttattactgtgcgagggaccggccaatggattattggggccagggcacctccgtcacagtgtcaagtgctaaaaccactccgcccagcgtttaccctcttgccccagggtctgcagcccaaacaaattccatggtgaccctgggatgcttggtcaagggttacttccccgagcctgtgacggtaacttggaactcaggcagcctcagttctggggttcacacctttccagctgtgctgcagtccgacctgtatacactcagctcgtctgtcactgtgccctcctcaacctggcctagtgaaacagtgacctgtaatgtcgcacatccagccagctccacgaaagttgataagaagatagtgccgcgcgactgcggatgtaaaccctgcatctgtactgtacctgaggtgtctagcgtcttcatttttccacccaagcctaaagatgtgttaacaatcaccctgactccaaaggttacatgcgtggtcgtggacatttcaaaagatgaccccgaggtacagttcagttggtttgttgatgacgtggaagtccacaccgctcagacgcaaccgagagaggaacagttcaattccacctttaggagcgtgtctgagcttcctatcatgcatcaggactggttgaacggcaaggagttcaagtgtcgggtcaattcagccgcgtttcccgcaccaatagagaaaacaatcagtaagactaaaggtcgccctaaggctccccaggtgtacaccattccaccccctaaagaacaaatggctaaggataaagttagcctgacatgcatgatcactgacttcttcccagaagatattaccgtggagtggcagtggaacgggcagccggccgaaaattataagaacacacaacccatcatggacaccgatggatcctactttgtatattctaagctaaatgtccagaaatcgaactgggaggcaggcaatactttcacgtgtagcgtgctccacgagggcctgcataaccaccacacagaaaagtccctttcacatagtcctgggaaa

SEQ ID NO: 28166 - RNA, 1323 nt, synthetic construct; identical to SEQ ID NO: 28165
  misc_feature 1..1323: note = derived and/or modified sequence opt3 from anti-influenza_Chain
  source 1..1323: mol_type = other RNA

SEQ ID NO: 28167 - RNA, 1329 nt, synthetic construct
  misc_feature 1..1329: note = derived and/or modified sequence opt3 from anti-influenza_Chain
  source 1..1329: mol_type = other RNA
gaggtgcagctgcagcagagcggccccgaactcgtcaagcctggggcctccgttaaaatgtcttgcaaggcttcaggatacaccttcacaagttatgtgatgcactgggtaaaacagaagccaggtcagggccttgagtggatcgggtacattaacccgtataatgacggaactagatacaacgaaaaatttagggtgaaggcaacgctgaccagcgataagtcctcttcgacagcctatatggagttgagtagcttaacttcagaagactccgcggtctactattgtgctcggcgcggcctgataaccacacccaccctagattactggggtcaagggactacactcaccgtgtctagcgccaaaacgactcctccatccgtttaccccctggcacctggatcagccgctcagaccaatagtatggtgacacttggctgcctggtcaagggctatttcccagagcccgtgactgtaacctggaacagcgggtctttgtcctcaggagttcatacatttcctgcagtgctccagagcgacctgtacaccctgagttcttccgtcacggtgccaagctcgacttggccgtctgagacagtgacctgtaatgtcgcccaccccgcttcctcaactaaagttgataagaaaatcgtgcctcgagactgcggttgtaagccatgcatttgtacagtacccgaagtgagtagcgtcttcatctttcctccaaagcccaaagatgtgctcaccattacgttaaccccgaaggttacatgcgtggtcgtggacatctccaaagatgaccctgaggtacagttctcttgggttgatgacgtggaagtccatactgcccaaacccagccccgtgaggagcagtttaacagcacattcagatcagtgagtgaactgccaataatgcaccaggattggcttaatggcaaggagtttaaatgtagggtcaactccgcggcattccctgcccccatcgaaaagactattagcaaaaccaaggggcggccaaaggctccccaagtgtatacaatccctccaccgaaagagcagatggccaaggacaaagtttctttgacctgcatgattactgactttttccccgaagatatcacggtggagtggcagtggaatggacaacctgcagagaactacaagaatacacagccaataatggacaccgatggctcatattttgtatacagtaaactgaacgtccaaaagagcaattgggaagctggtaacactttcacctgttccgtgctacatgaggggctccacaatcaccatacagaaaagtctctgtcgcacagccccggaaaa

SEQ ID NO: 28168 - RNA, 1329 nt, synthetic construct; identical to SEQ ID NO: 28167
  misc_feature 1..1329: note = derived and/or modified sequence opt3 from anti-influenza_Chain
  source 1..1329: mol_type = other RNA

SEQ ID NO: 28169 - RNA, 1332 nt, synthetic construct
  misc_feature 1..1332: note = derived and/or modified sequence opt3 from anti-influenza_Chain
  source 1..1332: mol_type = other RNA
aacgtgcccgagtggagctacatcgtcgaaaaggccaatcctgctaacgacctgtgctatccaggcaatttcaacgattacgaggaactcaaacaccttctgtccagaattaatcattttgagaagatacagatcattccgaaatcttcatggagtgaccacgaagcaagctccggggtttcttcggcctgtccctatcaaggaaccccttcattctttaggaacgtggtatggttgatcaagaaaaataacacatacccaactattaagcggagctataataacacgaatcaggaggatttactgatcctatggggtatacatcacagtaacgacgcggctgagcagaccaagctctaccagaatcccacaacttatatctccgtgggcacctctacactgaaccaacgccttgtccctaaaattgccacccgaagcaaggtgaatgggcagaacggacgtatggatttcttttggactatcctgaaaccaaacgacgcaattaatttcgaatccaacggcaattttatcgcccccgagtacgcttacaagatagttaaaaagggttatattcctgaagcaccaagagatgggcaggcctacgtgaggaaggacggagagtgggtcttgctctcaacattcctgcggagtgataaaacccatacgtgcccgccctgtcctgctccagagctgctcggcggccccagcgtgtttttattccctccaaagcccaaagacactctgatgatctctcgcaccccggaagtaacatgcgttgtggtcgatgtgtcccacgaggaccctgaagtgaagtttaactggtatgtcgatggggttgaggtgcacaatgccaaaactaagcccagagaggaacagtacaactcaacctatagggtagtgagcgtccttacagtgttgcatcaagactggctgaatggaaaagagtacaagtgtaaggttagtaacaaagcgctaccagcacctattgaaaagaccatctctaaagccaagggtcagccccgggagccacaggtgtatacgctgcccccttcccgcgaagagatgactaaaaatcaggtcagcctcacatgccttgtgaagggcttctacccatcggacatcgctgtagaatgggagtctaacgggcaaccggagaataactacaagaccactccccctgttctggattccgacggatcatttttcttgtatagtaaactcacagtggataagagccgatggcagcagggcaatgtcttctcctgttctgtgatgcacgaagccctgcataaccactacacccaaaagagcttatcactgagtccaggtaaa

SEQ ID NO: 28170 - RNA, 1332 nt, synthetic construct; identical to SEQ ID NO: 28169
  misc_feature 1..1332: note = derived and/or modified sequence opt3 from anti-influenza_Chain
  source 1..1332: mol_type = other RNA

SEQ ID NO: 28171 - RNA, 1341 nt, synthetic construct
  misc_feature 1..1341: note = derived and/or modified sequence opt3 from anti-influenza_Chain
  source 1..1341: mol_type = other RNA
caggtgcaactgcaggagagcggccccgggctcgtcaagccttccgaaaccctttctctgacatgcactgtttcaggaggtttgatcggcacggggagttactattggggatggattagacagaccccaggcaaaggtatggagtggatagggagcatctcctactctggatcgacatattaccacccgtcattaaagagcagggtgactattagtgacgatacctccaaaaaccagctgttcctaaagctccggtctgtaacagccgctgacaccgcacaatattactgtgcccgctataattggggcatccgatactttgatttctggggccgtgggactctggtgacagtcagctccgcgtcaaccaaaggacccagtgtgtttcctcttgctccatgcagcagatctacgtccgaatcaactgccgcactgggttgtttggttaaggactacttccccgagcctgtgaccgtcagctggaacagtggcgccctcacatctggggtgcatacttttccagctgtactgcagtccagcggactgtattcgctctcttccgttgtgaccgtcccctcaagtagcttaggcacaaagacctacacgtgcaatgtggatcacaaaccttccaacactaaggtggacaaaacaagggaatctaagtatggtccaccgtgtcccagctgccctgcaccagagttccttgggggaccctcagtctttctgttccctccaaaacccaaggataccttgatgattagtcggactccggaggttacatgtgtggtagtggacgtctcccaggaagatcctgaggtgcagtttaattggtacgttgacggcgtggaagtccataacgccaagaccaaaccccgcgaggagcaattcaatagcacgtatagagtggtatctgttctgaccgtgctacaccaggattggctcaacggcaaggaatacaaatgcaaggtctcaaataaagggctgccaagtagcatcgagaagacaatatccaaagctaagggacagcctagggaaccccaggtgtatactcttccacccgcccaagaggaaatgaccaagaaccaggtctctctgacatgtttggtgaaaggtttttacccttcggacatcgcggttgagtgggagagcaatggccagccagaaaacaattacaagactaccccgcccgtgctcgattccgacgggtcattctttctgtatagtcggttaacagtagacaaatctcgctggcaagagggaaacgtcttcagctgctccgtgatgcatgaagcactgcacaatcactacacccagaagtcactcagcctttctctgggcaaa

SEQ ID NO: 28172 - RNA, 1341 nt, synthetic construct; identical to SEQ ID NO: 28171
  misc_feature 1..1341: note = derived and/or modified sequence opt3 from anti-influenza_Chain
  source 1..1341: mol_type = other RNA

SEQ ID NO: 28173 - RNA, 1344 nt, synthetic construct
  misc_feature 1..1344: note = derived and/or modified sequence opt3 from anti-influenza_Chain
  source 1..1344: mol_type = other RNA
gaggtgcagctgcaagaaagcggccccgggctcgtcaagccttcccagaccctttctctgacatgcaacgtttcaggaggtagtatcactggcgactacaaatggagctggattagacagccaccggggaagggattggagtggataggccacatccattccacgggtaccacatattacaatccctctttaaggtcgcggattactatctcaatggataccagcaaaaacaatctgagtctacgcctcacatccgtgaccgccgctgacactgcagtatattactgtgcctctcacacactgaccagcgggcattatcctcgagatttcgacttttggggacagggcacgcttgtgactgtctcctcagcgagtaccaagggcccaagcgtgttccccctggctccttgctctcgttccacatcagaaagcactgccgcattggggtgtctcgttaaagattactttccagagcccgtgaccgtcagttggaactctggagccctgacatccggtgtgcacaccttccctgctgtactgcaaagctcgggcctctattctttatcctcagttgtgacggtcacaagtagcaattttgggactcagacctacacttgcaacgtggaccataagccatccaatacaaaggtggataaaaccgtcgaaagaaagtgttgcgttgagtgtccgccctgccctgcaccacccgtggccggaccttctgtattcctgtttccacccaaaccgaaggacacgcttatgattagcaggacccctgaggtgacatgtgtcgtggttgatgtgtcacacgaagaccccgaggtccagttcaactggtacgtggatggcatggaagtacacaatgctaaaactaagccacgggaggagcagtttaacagtaccttccgcgttgtgtccgtcttgacagtggtccatcaagactggctgaatggtaaggaatataaatgcaaggtgagcaacaaagggctacctgcccccatcgagaagactatatctaaaaccaagggacagccaagagaaccccaggtttacacactccctccatcaagggaggaaatgaccaaaaatcaggtgagtctgacttgtcttgtaaagggcttttatccgagcgatatcgcggtcgagtgggagtccaacggccaacccgaaaataactacaagacgacacctccaatgctggactctgacgggtcgttctttttgtatagcaaactcaccgtggataagtcccggtggcagcagggaaacgttttctcatgcagtgtgatgcacgaggcactgcataatcactacactcaaaaatctttaagcctgtccggtaag

SEQ ID NO: 28174 - RNA, 1350 nt, synthetic construct
  misc_feature 1..1350: note = derived and/or modified sequence opt3 from anti-influenza_Chain
  source 1..1350: mol_type = other RNA
caggtgcaactgcagcagagcggcgccgaggtcaagaaacccgggtcctctgttaaggtgtcatgcaaagtaagtggagtgatcttcagcggttccgctatttcttgggtcagacaggcacctggccaagggctcgaatggatgggaggcatatcgccactttttggtaccacaaactacgcccagaagttccaggggagggtgactatcacggcggaccagtcaaccaatacaacttatatggaggttaacagcctgcggtacgaagataccgctgtgtatttttgtgcccgcggaccgaaatactatagtgagtacatggacgtctggggcaagggcacaaccgtgactgtatcctctgcaagcacaaaggggccctccgttttccctttggccccatcaagtaaaagcacctctggaggtacggctgcattaggctgcctggtgaaggattattttcccgaacctgtcactgtgtcctggaactcaggggccctaaccagcggagtgcacacattcccagctgtcctccaaagttctggcctgtactcccttagctcggttgtgactgtaccctcttcctcactgggtacccagacatacatttgtaatgtgaatcataaacctagtaacaccaaggtcgacaaacgagtggagccaaagagctgcgataagacgcacacttgtccgccctgccctgccccagagttgctcgggggaccctccgtttttctgttccctccaaaacccaaggacacactgatgatctctcgtaccccggaagtgacttgtgtcgtggtagatgttagccatgaggaccctgaagtgaaatttaattggtatgtcgatggcgtggaggtccacaacgcgaagacaaaacccagagaggaacagtacaattcaacctatagggtggttagtgtgctcacggtattacatcaggactggctgaacggcaaggagtacaaatgcaaggtctccaataaggcacttccagcccctattgaaaagaccatcagcaaggctaaagggcaaccccgggagccacaggtgtatacattgcccccttctcgcgaagagatgactaagaaccaggtttcactgacctgtctagtgaaaggattctacccaagtgatatagccgtcgagtgggaaagcaatggtcaaccggagaacaattataagacaactccccctgtgctcgactccgatggctcgtttttcctgtactctaaacttaccgtagacaaaagcagatggcagcaggggaacgtgttttcctgctcagttatgcacgaagcactgcacaaccattacacacagaagagtttgtctctcagcccaggaaaa

SEQ ID NO: 28175 - RNA, 1350 nt, synthetic construct
  misc_feature 1..1350: note = derived and/or modified sequence opt3 from anti-influenza_Chain
  source 1..1350: mol_type = other RNA
caggtgcaactggtccagagcggcgccgaggttaagaaacccgggtcctctgtgaaggtatcatgcaaagctagtggaggtaccttcagctcctacgcaatctcttgggtgagacaggcccctggccaggggctcgaatggatgggaggcattatgggtatgtttgggacaactaactatgcgcaaaagttccagggaagggtcacgataaccgctgacgagtttacatcggccgcatacatggaacttcggtcactgcgcagcgaggatactgccgtgtattactgtgctcgaagttccggctattacccagaatatttccaggactggggccaggggaccttggttacagtgtctagcgcatccaccaaaggaccgtcagtctttcccttagcccctagtagcaagtctacttccggtggcacagctgccctggggtgcctagtgaaggattacttcccagagcccgtaaccgtttcatggaatagcggagcgctcacgagtggcgtgcacacttttcctgcagtcctgcaatcttccggtctttacagcctgtcgtctgtggtgaccgtcccatcctcaagtttggggacacagacttatatctgtaacgttaatcataaacccagcaacaccaaggtggacaaacgtgtagagcctaagtcctgcgataaaacacacacctgtccaccgtgccccgcccctgaactcctgggaggcccatctgtgttcctgtttccccctaagccaaaggacacgctcatgattagcagaactcccgaggtcacatgtgtggttgtggatgtctcacatgaagacccggaggtgaaattcaattggtacgtagatggcgttgaggtgcacaacgctaagaccaaacctagggaggaacagtataatagtacttaccgggtcgtgtccgtcttaacagtgctgcatcaggactggcttaacgggaaggaatataaatgcaaggttagcaataaagccttgcccgcaccaatcgagaagaccatttctaaggctaaaggacaacctcgcgaaccccaggtgtacacgctgccaccctcaagagaggagatgaccaagaaccaggtaagtctaacatgtctcgtcaaaggtttttatcctagcgatatcgccgtggaatgggagtccaatggccaaccagaaaacaattacaagactaccccgcccgttctggactctgatgggtcgttctttctttacagcaaactgacagtggacaagtccaggtggcagcagggaaacgtcttctcatgcagtgtgatgcacgaggcgttgcacaatcattatactcagaagtctctcagcctgtcccctggcaaa

SEQ ID NO: 28176 - RNA, 1350 nt, synthetic construct
  misc_feature 1..1350: note = derived and/or modified sequence opt3 from anti-influenza_Chain
  source 1..1350: mol_type = other RNA
gaggtgcagctggtcgaaagcggcgccgaggttaagaaacccgggtcctctgtgaaggtatcatgcaaagctagtggaggtaccttcagctcctacggcatctcttgggtgagacaagcacctgggcagggactcgaatggatgggcgacattataggtatgtttgggtcgacaaactatgcccagaatttccagggaaggcttactatcacggcggatgagtcaaccagcacagcttacatggaactgagttccttgcggtctgaggacactgccgtctattactgtgcacgcagctccggctattacccagcctatttaccgcactggggccaagggaccctggtgacagtttcaagtgctagcaccaagggaccctctgtgtttcctctagcaccatcctcaaaaagcaccagtggtggcacagccgctctcgggtgcctggtcaaggattacttccccgagcctgtgaccgtatcttggaactccggagcccttacgagcggcgttcatacttttccagcggtgctgcagtcgtctggtttgtactccctctcaagtgtcgtgaccgtgcccagctcctctctggggacacagacttatatttgtaatgtcaaccacaagcctagcaataccaaagttgacaagcgagtggaaccaaaatcatgcgataagacacatacctgtccgccctgccctgcaccagagctgctcggaggccccagtgtattcttatttcctccaaaacccaaggacacgctgatgatctcccgtactccggaagtgacatgtgtcgtggttgatgtgagccacgaggaccctgaggtcaagttcaactggtacgtggatggcgtagaagttcataatgccaaaaccaagcccagagaggaacagtataactctacttacagggtggtctcagtgcttacagtcttgcaccaagactggctgaatgggaaagagtataagtgcaaagtgagtaacaaggctctaccagcccctattgagaaaaccatcagcaaggcaaagggacagccccgggaaccacaggtttacacgctgcccccttcccgcgaggaaatgaccaaaaatcaggtgtctctcacatgtcttgtaaagggtttttatccatcggatatagctgtcgagtgggaaagcaacggccaaccggagaataactacaaaactactccccctgtgctggactccgatgggtcattctttttgtacagtaagctcacagttgacaaatctagatggcagcagggaaatgtgttcagctgctccgtcatgcacgaagccctgcataaccactatactcaaaagtcattaagcctgtctccaggcaag

SEQ ID NO: 28177 - RNA, 1350 nt, synthetic construct
  misc_feature 1..1350: note = derived and/or modified sequence opt3 from anti-influenza_Chain
  source 1..1350: mol_type = other RNA
gaggtgcagctggtcgaaagcggcgccgaggttaagaaacccgggtcctctgtgaaggtatcatgcaaagctagtggaggtaccttcagctcctacgcaatctcttgggtgagacaagcccctggccaggggctcgaatggatgggaggcattataggtatgtttgggacagcgaactatgctcagaagttccagggaagggtcactatcacggccgacgagtttacctcgacagcatacatggaactttcaagcctgcggagtgaggatactgccgtgtattactgtgctcgcggcaattattactatgagtcctctttggactactggggccaagggaccttagttacagtgagctccgcatcaaccaaaggaccaagtgtcttcccgctggcccccagctctaagtccacttcaggtggcacagctgccctagggtgcctcgtgaaggattactttcctgaaccagtaaccgttagctggaacagtggagcgctgacgtctggcgtgcacactttccccgcagtccttcagtccagcggtctgtattcgttgtcttccgtggtgaccgtcccttcaagtagcctcgggacacagacttacatttgtaatgttaaccataaaccatccaataccaaggtggacaaacgagtagagcccaagtcttgcgataaaacacacacctgtcctccatgcccggcccccgaactgctgggaggccctagcgtgtttctcttcccacccaagcctaaggacacgttaatgatctcacgtactccagaggtcacatgtgtggttgtggatgtcagtcatgaggaccccgaagtgaaatttaactggtatgtagatggcgttgaggtgcacaatgctaagaccaaaccgagagaggaacagtacaactccacttatagggtcgtgagcgtcctgacagtgcttcatcaagactggttgaatgggaaggaatacaaatgcaaggtttctaacaaagccctgcctgcacccattgagaagaccatctcaaaggctaaaggacagccacgggagcctcaggtgtatacgctacccccaagtcgcgaagagatgaccaagaatcaggtaagcctcacatgtctggtcaaaggtttctacccctccgatatagccgtggaatgggagtctaacggccaacctgaaaataactacaagactaccccaccggttcttgactcggatgggagctttttcctgtattccaaattgacagtggacaagtcaagatggcagcagggaaatgtctttagttgctctgtgatgcacgaggcgctccacaaccattacactcaaaagagcctgtccttatcacccggcaaa

SEQ ID NO: 28178 - RNA, 1350 nt, synthetic construct
  misc_feature 1..1350: note = derived and/or modified sequence opt3 from anti-influenza_Chain
  source 1..1350: mol_type = other RNA
gaggtgcagctggtccaaagcggcgccgaagttaagaaacccgggtcctctatgaaggtgtcatgcaaagctagtggaagcatcttctccaactacggtatttcttgggtaagacaggcacctggccaggggctcgagtggatgggaggcataatcccaatttttggtgccgcgaattatgctcagaagttccaagggagggtgaccatcacagccgacgaatcgacttcaacggtctacatggaggtgcggagccttcgcagtgaagataccgcagtttattactgtgcccgacgtcagcagctgtataaaggatactatcaccattggggccagggcacattggtgactgtctcctctgctagcaccaaggggccgtccgtgtttcccttagcaccttcaagtaagagcacatctggaggtaccgccgctctgggctgcctagtaaaagactacttcccagagcccgttactgtgtcctggaactcaggggccctcacaagcggagtccacacctttcctgcggtgctgcaaagttctggcctttactccctgagctcggtggtcacggttccatcttcctcattgggtactcagacctatatttgtaatgtgaaccataagcccagtaatacaaaagtagataagaaagtggagcctaagagctgcgacaagactcacacctgtccaccgtgccccgcacctgaactcctcgggggaccatccgtcttcctgtttccccctaaaccaaaggatacactgatgatctctagaacccccgaggtgacgtgtgttgtggtcgacgtgagccatgaagatccggaggtaaaattcaactggtacgttgacggcgtggaggtccacaatgccaagactaaacctagggaggaacagtataactcaacataccgggtggtcagtgtgttaaccgttctgcaccaggattggcttaatggcaaggaatataaatgcaaggtgtccaacaaggctttgcccgccccaatagagaaaactatcagcaaggcaaaagggcaacctcgcgaaccccaggtatacacactgccaccctctagagaggagatgaccaagaatcaggtctcactaacgtgtctcgtgaaaggattttatcctagtgacattgctgttgaatgggagagcaacggtcaaccagaaaataactacaagaccacaccgcccgtgctggattccgacggctctttctttctttactcgaagctgactgtcgataaatccaggtggcagcaggggaatgtgttcagctgctcagtaatgcatgaggccttgcacaaccattatacccagaagagtctctctctgagccctggaaaa

SEQ ID NO: 28179 - RNA, 1350 nt, synthetic construct
  misc_feature 1..1350: note = derived and/or modified sequence opt3 from anti-influenza_Chain
  source 1..1350: mol_type = other RNA
caggtgcaactggtccagagcggcgccggggttaagaaacccggatcctctatgaaggtgtcatgcaaagctagtggtagcatcttctccaactacggcatttcttgggtaagacaggcacctgggcagggactcgagtggatgggcggtataatcccaatttttggggccgcgaattatgctcaaaagttccagggaagggtgaccatcacagccgacgaatcgacttcaacggtctacatggaggtgcggagccttcgcagtgaagataccgcagtttattactgtgcccgacgtcagcagctgtataaaggctactatcaccattggggccaagggacattggtgactgtctcctctgctagcaccaagggaccgtccgtgtttcccttagcaccttcaagtaagagcacatctggtggcaccgccgctctggggtgcctagtaaaagactacttcccagagcccgttactgtgtcctggaactcaggagccctcacaagcggcgtccacacctttcctgcggtgctgcagagttctggtctttactccctgagctcggtggtcacggttccatcttcctcattggggactcagacctatatttgtaatgtgaaccataagcccagtaatacaaaagtagataagaaagtggaacctaagagctgcgacaagactcacacctgtccaccgtgccccgcacctgagctcctgggaggcccatccgtcttcctgtttccccctaaaccaaaggatacactcatgatctctagaacccccgaggtgacgtgtgttgtggtcgacgtgagccatgaagatccggaggtaaaattcaactggtacgttgacggcgtggaagtccacaatgccaagactaaacctagggaggagcagtataactcaacataccgggtggtcagtgtgttaaccgttctgcaccaagattggcttaatgggaaggaatataaatgcaaggtgtccaacaaggctttgcccgccccaatagagaaaactatcagcaaggcaaaaggacagcctcgcgaaccccaggtatacacactgccaccctctagagaggaaatgaccaagaatcaagtctcactaacgtgtctcgtgaaaggtttttatcctagtgacattgctgttgagtgggagagcaacggccagccagaaaataactacaagaccacaccgcccgtgctggattccgacgggtctttctttctttactcgaagctgactgtcgataaatccaggtggcagcagggaaatgtgttcagctgctcagtaatgcatgaggccttgcacaaccattatacccaaaagagtctctctctgagccctggcaaa

SEQ ID NO: 28180 - RNA, 1350 nt, synthetic construct
  misc_feature 1..1350: note = derived and/or modified sequence opt3 from anti-influenza_Chain
  source 1..1350: mol_type = other RNA
caggtgcaactggtccagagcggcgccgaggttagaaagcccgggtcctctgtgaaagtatcatgcaaggtgagtggaggtatcattaggaaatacgctataaactgggtccggcaggcacctggccaggggctcgaatggatgggaggcatcattgccatcttcaataccgcgaactatgctcaaaagtttcagggtcgcgtgacaattactgccgacgagagcacgtccaccgtttacatggaactttcttcgctgcgatcagaggatacagcattgtattactgtgcccgtgggatgaattattacagcgactatttcgattactggggacagggcagtttagtgactgtctccccagcttctaccaaaggcccgagcgtgtttcccctggcaccttcctcaaagagtacaagcgggggaaccgccgctctaggttgcctcgtaaaggactacttcccagaacccgttactgtgtcttggaactccggcgccctgacatcaggggtccacacctttcctgcggtgcttcagagcagtggactgtattctttgtccagcgtggtcacggttccatcgtcttccctcggcactcaaacctacatctgtaatgtgaaccataaaccctcaaatacaaaggtagataaaaaggtggagcctaaaagttgcgacaagactcacacctgtccaccgtgccccgcacctgagctgctgggtgggccaagcgtcttcctctttccccctaagccaaaagatacattaatgatatccagaacccccgaagtgacgtgtgttgtggtcgacgtgtctcatgaggatccggaagtaaagttcaactggtatgttgacggagtggaggtccacaatgccaaaactaagcctagggaggaacagtacaacagcacatatcgggtggtctcagtgctgaccgttcttcatcaggattggttgaatggcaaagagtacaagtgcaaagtgagtaacaaggctctgcccgccccaatcgaaaagactatttccaaagcaaagggccagcctcgcgagccccaagtatatacactaccacccagcagagacgaactcaccaaaaatcaggtctctctgacgtgtcttgtgaaggggttttacccttcagatatcgctgttgagtgggagagtaacggacagccagaaaataactacaaaaccacaccgcccgtgctggacagcgacggttccttctttttgtattctaagctcactgtcgataagtcgaggtggcaacagggcaacgtgttcagctgctccgtaatgcacgaggccctgcacaatcattacacccagaaatcattaagtctgtctcctgggaag

SEQ ID NO: 28181 - RNA, 1350 nt, synthetic construct; identical to SEQ ID NO: 28180
  misc_feature 1..1350: note = derived and/or modified sequence opt3 from anti-influenza_Chain
  source 1..1350: mol_type = other RNA

SEQ ID NO: 28182 - RNA, 1350 nt, synthetic construct; identical to SEQ ID NO: 28178
  misc_feature 1..1350: note = derived and/or modified sequence opt3 from anti-influenza_Chain
  source 1..1350: mol_type = other RNA

SEQ ID NO: 28183 - RNA, 1350 nt, synthetic construct; identical to SEQ ID NO: 28179
  misc_feature 1..1350: note = derived and/or modified sequence opt3 from anti-influenza_Chain
  source 1..1350: mol_type = other RNA

SEQ ID NO: 28184 - RNA, 1350 nt, synthetic construct; identical to SEQ ID NO: 28174
  misc_feature 1..1350: note = derived and/or modified sequence opt3 from anti-influenza_Chain
  source 1..1350: mol_type = other RNA

SEQ ID NO: 28185 - RNA, 1350 nt, synthetic construct; identical to SEQ ID NO: 28175
  misc_feature 1..1350: note = derived and/or modified sequence opt3 from anti-influenza_Chain
  source 1..1350: mol_type = other RNA

SEQ ID NO: 28186 - RNA, 1350 nt, synthetic construct; identical to SEQ ID NO: 28176
  misc_feature 1..1350: note = derived and/or modified sequence opt3 from anti-influenza_Chain
  source 1..1350: mol_type = other RNA

SEQ ID NO: 28187 - RNA, 1350 nt, synthetic construct; identical to SEQ ID NO: 28177
  misc_feature 1..1350: note = derived and/or modified sequence opt3 from anti-influenza_Chain
  source 1..1350: mol_type = other RNA

SEQ ID NO: 28188 - RNA, 1353 nt, synthetic construct
  misc_feature 1..1353: note = derived and/or modified sequence opt3 from anti-influenza_Chain
  source 1..1353: mol_type = other RNA
gaggtgcagctggtcgaaagcggcgccgaggttaagaaacccgggtcctctgtgaaggtatcatgcaaagctagtggaggtcctttcagaagctacgcaatctcctgggtgaggcaagccccaggccaggggccggaatggatgggaggcattatacccatctttggtaccacaaagtatgcgcctaaattccaggggcgggtcactattacggctgacgattttgccggaaccgtgtacatggagctctcttcgcttcgctcagaagacacagcaatgtattactgtgccaagcacatgggctatcaggttcgagagactatggatgtgtggggcaaggggaccacagtcaccgtgagcagtgcttccactaaaggaccatctgtattccccctggcacctagctccaagtcaacaagtggtggcaccgccgctttggggtgcttagttaaagactactttccagagcccgtgacggtcagctggaactctggagccctgacttccggcgtgcataccttccctgcggtgctacaatcaagcggtctctatagtctgtcttccgtcgttacagtgccaagctcgtctcttgggactcagacctacatctgtaatgtaaaccacaagccgtccaatacaaaagtggataagcgtgtcgaacccaagtcatgcgacaaaacccatacgtgtcctccatgccccgcacctgagctgttgggaggcccaagtgtgtttctctttcccccgaagcctaaagatactctgatgattagcagaacacccgaagttacctgtgtggtcgtggacgtatcccacgaggatccagaggttaagttcaactggtacgtggacggcgtcgaagtgcataatgccaaaactaagcctagggaggaacagtataactctacataccgggtcgtgagcgttctgaccgtgctccaccaggattggttaaatgggaaagagtataagtgcaaggtatcaaacaaagctctgcccgccccaatcgaaaagacgataagtaaagcaaagggacaaccccgcgagcctcaggtctacacccttccaccgtccagagaggaaatgactaaaaatcaggtgagcttgacatgtctggttaagggtttctatccctctgacatcgctgtggagtgggaatcaaacggccagcctgagaataactacaagaccacaccacccgtcctagatagtgacgggagctttttcctctattccaaactgactgtggacaagtctaggtggcaacagggaaatgtattttcgtgcagcgtgatgcacgaagcccttcataaccactacacccagaaatccctgtcattgagtcctggcaag

SEQ ID NO: 28189 - RNA, 1353 nt, synthetic construct
  misc_feature 1..1353: note = derived and/or modified sequence opt3 from anti-influenza_Chain
  source 1..1353: mol_type = other RNA
caggtgcaactggtccagagcggcgccgaggttaagaaacccgggtcctctgtgaaggtatcatgcaaagctagtggaggtcctttcagaagctacgcaatctcctgggtgaggcaggccccaggccaggggccggaatggatgggaggcattatacccatctttggtaccacaaagtatgcgcctaaattccaagggcgggtcactattacggctgacgattttgccggaaccgtgtacatggagctctcttcgcttcgctcagaagacacagcaatgtattactgtgccaagcacatgggctatcaggttcgagagactatggatgtgtggggcaaggggaccacagtcaccgtgagcagtgcttccactaaaggaccatctgtattccccctggcacctagctccaagtcaacaagtggtggcaccgccgctttggggtgcttagttaaagactactttccagaacccgtgacggtcagctggaactctggagccctgacttccggcgtgcataccttccctgcggtgctacagtcaagcggtctctatagtctgtcttccgtcgttacagtgccaagctcgtctcttgggactcagacctacatctgtaatgtaaaccacaagccgtccaatacaaaagtggataagcgtgtcgagcccaagtcatgcgacaaaacccatacgtgtcctccatgccccgcacctgagctgttgggaggcccaagtgtgtttctctttcccccgaagcctaaagatactctgatgattagcagaacacccgaagttacctgtgtggtcgtggacgtatcccacgaggatccagaagttaagttcaactggtacgtggacggcgtcgaggtgcataatgccaaaactaagcctagggaggaacaatataactctacataccgggtcgtgagcgttctgaccgtgctccaccaggattggttaaatgggaaagagtataagtgcaaggtatcaaacaaagctctgcccgccccaatcgaaaagacgataagtaaagcaaagggacagccccgcgagcctcaggtctacacccttccaccgtccagagaagagatgactaaaaatcaagtgagcttgacatgtctggttaagggtttctatccctctgacatcgctgtggagtgggaatcaaacggccagcctgagaataactacaagaccacaccacccgtcctagatagtgacgggagctttttcctctattccaaactgactgtggacaagtctaggtggcagcaaggaaatgtattttcgtgcagcgtgatgcacgaagcccttcataaccactacacccagaaatccctgtcattgagtcctggcaag

SEQ ID NO: 28190 - RNA, 1353 nt, synthetic construct
  misc_feature 1..1353: note = derived and/or modified sequence opt3 from anti-influenza_Chain
  source 1..1353: mol_type = other RNA
gaggtgcagctggtcgaaagcggcgctgaggttaagaaacccgggtcctctgtgaaggtatcatgcaaagctagtggaggtaccttcagcttttactccatgtcttgggtgagacaagcacctggccaggggctcgaatggatgggaggcatcattccaatgttcggtacaactaactatgcccagaagtttcaggggagggtcacgataaccgcggtggagtcgacatcaactgcttacatggaagttagcagtcttcggtccgaggacaccgccgtgtattactgtgcacgcggagataaaggcatctattactattacatggacgtctggggcaaggggacaaccgtgactgtatctagcgcctccacaaagggaccgtcagttttccccctggctcctagtagcaaatctacctccggtggcacggcagccttggggtgcttagtgaaggattactttccagagcccgtcactgtgtcatggaatagcggagctctgaccagtggcgtgcacacattccctgccgtcctacaatcttccggtctctatagcctgtcgtctgttgtgactgtaccatcctcaagtcttgggacccagacatacatttgtaacgtgaatcataaacccagcaacaccaaggtcgacaaacgagtggaacctaagtcctgcgataagacgcacacttgtccaccgtgccccgcgcctgagctgttgggaggcccatctgtttttctctttccccctaaaccaaaggacacactgatgatcagccgtacccccgaagtgacttgtgtcgtggtagatgtttcacatgaggacccggaggtgaaattcaattggtatgtcgatggcgtggaagtccacaacgcaaagacaaaacctagagaggaacagtacaatagtacctatagggtggtttccgtgctgacggtactccatcaggactggttaaacgggaaggagtacaaatgcaaggtcagcaataaggccctgcccgctccaattgagaaaaccatctctaaggccaaaggacaacctcgggaaccccaggtgtatacacttccaccctcacgcgaggaaatgactaagaaccaggttagtttgacctgtctggtgaaaggtttctaccctagcgatatagcagtcgagtgggaatccaatggccagccagagaacaattacaagacaactccgcccgtgctagactctgatgggtcgtttttcctctatagcaagctgaccgtagacaaatccagatggcaacagggaaacgtgttttcatgcagtgttatgcacgaagcccttcacaatcattacacacagaagtctctgagcttgtcccctggcaaa

SEQ ID NO: 28191 - RNA, 1353 nt, synthetic construct; identical to SEQ ID NO: 28188
  misc_feature 1..1353: note = derived and/or modified sequence opt3 from anti-influenza_Chain
  source 1..1353: mol_type = other RNA

SEQ ID NO: 28192 - RNA, 1353 nt, synthetic construct; identical to SEQ ID NO: 28189
  misc_feature 1..1353: note = derived and/or modified sequence opt3 from anti-influenza_Chain
  source 1..1353: mol_type = other RNA

SEQ ID NO: 28193 - RNA, 1353 nt, synthetic construct; identical to SEQ ID NO: 28190
  misc_feature 1..1353: note = derived and/or modified sequence opt3 from anti-influenza_Chain
  source 1..1353: mol_type = other RNA

SEQ ID NO: 28194 - RNA, 1356 nt, synthetic construct
  misc_feature 1..1356: note = derived and/or modified sequence opt3 from anti-influenza_Chain
  source 1..1356: mol_type = other RNA
caggtgcaactggtccagagcggcgggggactcgttaagcccggtggctcccttagactgtcttgcgccgcttcagggttcacctttagtagctactccatgaactgggtgaggcaggcacctggaaaaggcttggagtgggtatcttcgatctcaagcagttcctcttatatttactatgtggacagcgtcaagggtcggttcacaatatcccgcgataatgccaaaaactcattatacctgcagatgaatagtctacgagcggaagacactgctgtgtattactgtgcccgtgggggaggcagctatggcgcatacgaggggtttgattactggggacaaggtacgctcgttaccgtgtcttccgcctcaacaaagggcccaagcgtcttcccgctggctcccagttctaaatccactagcgggggaaccgcagcccttggctgcctggtgaaggactattttcctgaaccagtaacagtttcgtggaactctggtgctttgacctccggggtgcacactttccccgccgtcctccagtcaagtggactgtacagcctgtcctctgtggtgacagtccctagctcaagtctcggcacccagacgtatatctgtaatgttaaccataagccatccaatactaaagtggataagagagtagagcccaaaagctgcgacaagacccacacatgtcctccatgcccggcgcccgaattactgggcgggccttctgtgtttcttttcccacccaaacctaaggatactttgatgatttcaaggaccccagaggtcacatgtgtggttgtggacgtcagtcatgaggatcccgaagtgaagtttaactggtacgtagacggagttgaggtgcacaatgcaaaaaccaagccgcgggaagaacagtataacagcacgtaccgcgtcgtgtccgtcctgactgtgctacatcaagattggctcaatggtaaagagtataagtgcaaagtttctaacaaggccctgcctgctcccatcgagaaaacaatttcgaaggccaagggccagccaagagagcctcaggtgtacacccttcccccaagcagggaagagatgactaaaaatcaggtatccctgacatgtttggtcaaggggttctacccctcagacatcgcagtggaatgggagagtaacggacaacctgagaataactataaaaccacgccaccggttctcgattctgacggcagctttttcctgtactccaagttaaccgtggacaaatcacggtggcagcagggtaacgtctttagctgctctgtgatgcacgaagctctgcacaatcattatacacaaaagtccctcagtcttagccccgggaag

SEQ ID NO: 28195 - RNA, 1356 nt, synthetic construct
  misc_feature 1..1356: note = derived and/or modified sequence opt3 from anti-influenza_Chain
  source 1..1356: mol_type = other RNA
caggtgcaactggtccagagcggcgccgaggttaagcagcccggggcttccgtgaaagtatcttgcaaggcatcaggatacaccttcaacgcctattacatccactgggtgagacaggcgcctggtcaaggcctcgaatggatggggtggattaatccaaactttggaggcacacattatgctaggaaattccagggtcgggtcactatgacgcgcgacgccagtataaataccgcatacatggagcttgatcgactgatcagcgacgatacagccgtgtattactgtgttcgttggagagctgcagccgtgattatggaccagttttataagatggatgtctgggggcagggaactttggtgaccgtatcctctgcttcgacaaaaggcccgtcagttttccccttagccccttgcagcaggagtacctccgaatctactgcggcactgggctgtctagtgaaggactactttccagagcccgtcacagtgagctggaactccggggccctcacctcaggagtgcacacgttccctgctgtcctgcaaagtagcggtctttactctctgtcctcagttgtgactgtaccaagcagttctttgggcaccaagacatatacttgcaatgtggatcataaaccctccaacaccaaggtcgacaaaacacgggaaagcaagtacgggcctccatgtccgtcgtgccccgcccctgagtttctcggaggcccatctgtgttcctgtttccccctaaaccaaaggataccctgatgatctcccgcacgcccgaggttacttgtgtggtcgtggacgtatcacaggaagatccggaggttcagttcaattggtatgtggacggtgtcgaagtgcacaacgcaaagacaaaacctagagaggagcagtttaatagtacctacagggtcgtgagcgttctcactgtgttacatcaagattggctgaacgggaaggaatataaatgcaaggtatccaataaaggacttccctctagcattgagaagacaatctcaaaagctaagggccagccacgggaacctcaggtctacaccttgcccccagcccaagaggaaatgacgaagaaccaggtgagtctgacctgtctagttaaaggcttctatccctccgacatagcggtggagtgggagagcaatgggcagcctgaaaacaattacaagacaactccaccggtcctcgactctgatggatcatttttcctgtacagtcgccttaccgtggacaaaagccgatggcaggagggtaacgtattctcctgctctgtgatgcacgaagccctgcacaaccattatacacaaaagtcgttgagcctctccctgggcaaa

SEQ ID NO: 28196 - RNA, 1356 nt, synthetic construct
  misc_feature 1..1356: note = derived and/or modified sequence opt3 from anti-influenza_Chain
  source 1..1356: mol_type = other RNA
gaggtgcagctggtccaaagcggcgccgaagttaagaaacccggggcttccgtgaaggtatcttgcaaagcatcaggatacatcttcaccggttattacattcactgggtgagacaggcccctggccaggggctcgagtggatgggaaggatagacccaaacggcgcgggtacaacttatgctcagaagtttcaagggcgggtcacgcttaccatggatacaagtatcactaccgcctacatggaactgagccgcttgcgattcgacgatacagcaatttattactgtgcccgttgggactggaattttgatttatatctgggatggttcgacccgtggggccagggcacccccgtgactgttgcttccgcatctacaaaagggccttcggtgtttccactagccccctcaagcaagagtacctccggaggtacggctgccctcggctgcctggtcaaggattacttccctgagccagtgactgtatcttggaacagcggggcgcttacctccggagttcatacatttcccgcagtgctgcagtcaagtggcttgtacagcctctcttccgtcgtgactgtgccttcaagcagtctgggtacccagacatatatctgtaatgtcaaccacaaaccatctaataccaaggttgacaaaaaggtggaaccgaaatcctgcgataagacgcatacttgtcccccttgcgccccagagctgctcgggggacccagcgtattcttatttcctccaaagcccaaagacacactgatgatttcgagaaccccggaggtgacttgtgtcgtggttgatgtgtctcacgaagaccctgaggtcaagttcaactggtacgtggatggcgtagaagttcataatgctaaaacaaagcccagggaggagcaatataactccacctaccgggtggtctcagtgcttacggtcttgcaccaggactggctgaatggcaaagaatataagtgcaaagtgagtaacaaggccctaccagcacctatcgagaagaccataagcaaagctaaggggcagccccgcgaaccacaggtttacacattacccccttccagagaggaaatgactaaaaatcaagtgtctctgacctgtcttgtaaagggattttatccaagcgacatcgccgtcgagtgggagtcaaacggtcagccggaaaataactacaaaacaactccccctgtgctggatagtgacggctccttctttttgtacagcaagctcaccgttgataagtctaggtggcagcaagggaatgtgttctcatgcagtgtcatgcacgaggcgctgcataaccactatacacagaaaagcctctccctgtctccaggaaag

SEQ ID NO: 28197 - RNA, 1356 nt, synthetic construct; identical to SEQ ID NO: 28195
  misc_feature 1..1356: note = derived and/or modified sequence opt3 from anti-influenza_Chain
  source 1..1356: mol_type = other RNA

SEQ ID NO: 28198 - RNA, 1356 nt, synthetic construct; identical to SEQ ID NO: 28194
  misc_feature 1..1356: note = derived and/or modified sequence opt3 from anti-influenza_Chain
  source 1..1356: mol_type = other RNA

SEQ ID NO: 28199 - RNA, 1356 nt, synthetic construct; identical to SEQ ID NO: 28196
  misc_feature 1..1356: note = derived and/or modified sequence opt3 from anti-influenza_Chain
  source 1..1356: mol_type = other RNA

SEQ ID NO: 28200 - RNA, 1359 nt, synthetic construct
  misc_feature 1..1359: note = derived and/or modified sequence opt3 from anti-influenza_Chain
  source 1..1359: mol_type = other RNA
caggtgcaactggtccagagcggcgccgaggttaagaaacccgggtcctctgtgagagtatcatgcaaggctagtggaagcatcttcaggaactacgcaatgtcctgggtgcggcaggcccctggtcagggcctcgaatggatgggagggattatagcgatctttggcaccccaaaatatgctcaaaagttccagggtcgcgtcacaattactgccgacgagtctacgtcgaccgtgtacatggaactttcagggctgcgaagcgaggatacagcaatgtattactgtgcccgtatcccgcactataattttggaagtggctcctacttcgactattggggccaggggactttggttaccgtgtctagcgcttccacaaaaggaccctcagtctttcctttagcaccaagtagcaagtctacctccggtggcactgccgctctggggtgcctagtgaaggattacttccccgaacctgtaacagtttcatggaacagcggagccctcaccagtggcgtgcatacgtttccagcggtcctgcagtcttccggtctttacagcctgtcgtctgtggtgactgtcccctcctcaagtttggggacccaaacatatatttgtaatgttaaccacaaacctagcaatactaaggtggacaaaagagtagagccaaagtcctgcgataaaacccatacatgtccgccctgccctgcaccagagctcctgggaggcccctctgtgttcctgtttcctccaaagcccaaggacaccctcatgatcagcaggacgccggaagtcacttgtgtggttgtggatgtctcacacgaggaccctgaagtgaaattcaactggtacgtagatggcgttgaggtgcataatgccaagacaaaaccccgggaggaacagtataacagtacctaccgcgtcgtgtccgtcttaactgtgctgcaccaggactggcttaatgggaaggagtataaatgcaaggttagcaacaaagccttgccagctcctatagaaaagacaatctctaaggcaaaaggacagcccagagagccacaagtgtacaccctgcccccttcaagggaagagatgacgaagaatcaggtaagtctaacctgtctcgtcaaaggtttttatccaagcgatattgctgtggagtgggaatccaacggccagccggagaataactacaagacaactccccctgttctggactctgatgggtcgttctttctttacagcaaactgaccgtggacaagtcccggtggcaacagggaaatgtcttctcatgcagtgtgatgcacgaagccttgcataaccactatacacagaagtctctcagcctgtccccaggcaaa

SEQ ID NO: 28201 - RNA, 1359 nt, synthetic construct
  misc_feature 1..1359: note = derived and/or modified sequence opt3 from anti-influenza_Chain
  source 1..1359: mol_type = other RNA
caggtgcaactggtccagagcggcgccgaggttaagaaacccggggcttccgtgaaggtatcttgcaaagcatcaggatacatcttcaccggttattacattcactgggtgagacaggcccctggccaggggctcgaatggatgggaaggatagacccaaacggcagtggtacaacttatgcgcaaaagtttcaggggcgggtcacgcttaccatggatacaagcatcactaccgcttacatggagctgtcccgcttgcgattcgacgatacagccatttattactgtgcacgttgggactggaattttgatttatatctgggatggttcgacccgtggggccagggcacccccgtgactgttgcctctgcttcgacaaaagggccttcagtgtttccactagcacccagcagtaagtccacctctggaggtacggccgctctcggctgcctggtcaaggattacttccctgaaccagtgactgtaagctggaactccggggcccttacctcaggagttcatacatttcccgcggtgctgcagagtagcggcttgtactctctctcctcagtcgtgactgtgcctagcagttctctgggtacccaaacatatatctgtaatgtcaaccacaaaccatccaataccaaggttgacaaaaaggtggagccgaaaagctgcgataagacgcatacttgtcccccttgcccagcacccgaactgctcgggggaccttcggtattcttatttccacccaagccgaaagacacactgatgatttctagaacccctgaggtgacttgtgtcgtggttgatgtgtcccacgaggaccccgaagtcaagttcaactggtacgtggatggcgtagaggttcataatgccaaaacaaagccaagggaggaacagtataactcaacctaccgggtggtcagtgtgcttacggtcttgcaccaggactggctgaatggcaaagagtataagtgcaaagtgagcaacaaggctctacctgcccccatcgaaaagaccatatccaaagcaaaggggcagccacgcgagccccaagtttacacactccctccatctagagaagagatgactaaaaatcaggtgagcctgacctgtcttgtaaagggattttatccgtcagacatcgctgtcgaatgggagagtaacggtcagcccgagaataactacaaaacaactcctccagtgctggattccgacggcagcttctttttgtactctaagctcaccgttgataagtcaaggtggcaacaggggaatgtgttcagttgcagcgtcatgcacgaagccctgcataaccactatacacagaaatccttatctctgtcgcccggaaag

SEQ ID NO: 28202 - RNA, 1359 nt, synthetic construct
  misc_feature 1..1359: note = derived and/or modified sequence opt3 from anti-influenza_Chain
  source 1..1359: mol_type = other RNA
gaggtgcagctggtccaaagcggcgccgaagttaagaaacccggggcttccgtgaaggtatcttgcaaagcatcaggatacatcttcaccggttattacattcactgggtgagacaggcccctggccaggggctcgagtggatgggaaggatagacccaaacggcgcgggtacaacttatgctcagaagtttcaagggcgggtcacgcttaccatggatacaagtatcactaccgcctacatggaactgagccgcttgcgattcgacgatacagcaatttattactgtgcccgttgggactggaattttgatttatatctgggatggttcgacccgtggggccagggcacccccgtgactgttgcttccgcatctacaaaagggccttcggtgtttccactagccccctcaagcaagagtacctccggaggtacggctgccctcggctgcctggtcaaggattacttccctgagccagtgactgtatcttggaacagcggggcgcttacctccggagttcatacatttcccgcagtgctgcagtcaagtggcttgtacagcctctcttccgtcgtgactgtgccttcaagcagtctgggtacccagacatatatctgtaatgtcaaccacaaaccatctaataccaaggttgacaaaaaggtggaaccgaaatcctgcgataagacgcatacttgtcccccttgcccagcccccgagctgctcgggggacctagcgtattcttatttccacccaagccgaaagacacactgatgatttcgagaacccctgaggtgacttgtgtcgtggttgatgtgtctcacgaagaccccgaggtcaagttcaactggtacgtggatggcgtagaagttcataatgctaaaacaaagccaagggaggagcaatataactccacctaccgggtggtctcagtgcttacggtcttgcaccaggactggctgaatggcaaagaatataagtgcaaagtgagtaacaaggccctacctgcacccatcgagaagaccataagcaaagctaaggggcagccacgcgaaccccaggtttacacactccctccatccagagaggaaatgactaaaaatcaagtgtctctgacctgtcttgtaaagggattttatccgagcgacatcgccgtcgagtgggagtcaaacggtcagcccgaaaataactacaaaacaactcctccagtgctggatagtgacggctccttctttttgtacagcaagctcaccgttgataagtctaggtggcagcaagggaatgtgttctcatgcagtgtcatgcacgaggcgctgcataaccactatacacagaaatccttaagcctgtctcccggaaag

SEQ ID NO: 28203 - RNA, 1359 nt, synthetic construct
  misc_feature 1..1359: note = derived and/or modified sequence opt3 from anti-influenza_Chain
  source 1..1359: mol_type = other RNA
caggtgcaactggtccagagcggcgccgaggttaagaaacccggggcttccgtgaaggtatcttgcaaagcatcaggatacaccttcaacgcccaccatatgcactgggtgagacaggcgcctggtcagggcctcgggtggatgggatggatcgacccaaataacgatggcacaatttatgctcaaaagtttcagggtagggtcactcttacgatggacaccagtatacatacagcctacatggaactgagcgggttgcggtatgatgacactgcaatctactattgtgtgcgctgggcctggaatttcgactttttcttaggatggtttgatccgtggggccagggcaccctggttacagtggcttccgcatctaccaaagggccctcggtcttccctctagccccatcaagcaagagtacttccggaggtacagctgccctcggctgcctggtgaaggattactttcccgagcctgtaaccgtttcttggaacagcggggcgcttacgtccggagtgcacactttcccagcagtcctgcagtcaagtggcttgtatagcctctcttccgtggtgaccgtcccctcaagcagtctgggtacacaaacttacatttgtaatgttaaccataaaccttctaataccaaggtggacaaaaaggtagaaccaaaatcctgcgataagacacacacctgtccgccctgccctgccccagagctgctcgggggacccagcgtgtttttattccctccaaagcccaaagacacgctgatgatctcgcgaactccggaagtcacatgtgtggttgtggatgtctctcacgaggaccctgaggtgaagtttaactggtacgtagatggcgttgaagtgcataatgctaaaaccaagccccgtgaggaacagtataactccacttacagagtcgtgtcagtccttacagtgttgcaccaggactggctgaatggcaaagagtataagtgcaaagttagtaacaaggccctaccagcacctattgagaagaccatcagcaaagctaaggggcagcccagggaaccacaagtgtacacgttacccccttcccgggaggaaatgaccaaaaatcaggtatctctgacatgtcttgtcaagggattctatccaagcgacatagccgtggagtgggaatcaaacggtcagccggagaataactacaaaactacaccccctgttctggatagtgacggctcctttttcttgtatagcaagctcaccgtggataagtctcgctggcaacaggggaacgtcttctcatgcagtgtgatgcatgaggcgctgcacaatcactacactcagaaaagcctctccctgtctccaggaaag

SEQ ID NO: 28204 - RNA, 1359 nt, synthetic construct
  misc_feature 1..1359: note = derived and/or modified sequence opt3 from anti-influenza_Chain
  source 1..1359: mol_type = other RNA
gaggtgcagctggtccagagcggcgccgaagttaagaaacccggggagtccctcaagatctcttgcaaagtgtcaggatacagtttcaccagccagtggattggttgggtaagacagatgcctggcaaggggcttgaatggataggaatgatgtatccaggcgactccgatacaatctactctccgtcgtttcagggtcaagtgactatttcagctgacaacagcatcagtacggcatatctgcagtggtcctctttgaaagccagcgataccgcgatttactattgtgcttccgggcccggatactcaggctatcactacggctggttcgacacatgggggcagggaactttagtcaccgtgagtagcgcctctacaaagggtccttccgtttttccactggcaccctcaagcaagagtacctctggcgggactgccgctctaggatgcctcgtgaaagattacttccctgagccagtcacagtgtcctggaatagcggcgcactgacctcgggtgtacatacgtttcccgccgttcttcagtcttccgggctgtattcattgagtagcgtggtcactgtgccttcctctagcctcggaacccaaacatacatctgtaacgtgaatcacaagccatcaaacactaaagtcgacaagaaagttgaaccgaagagttgcgataagacccatacatgtcccccttgcccagctcccgagctgctgggcggcccttccgtgttcctctttccacccaaaccgaaggacaccttaatgataagcaggacgcctgaggtaacttgtgtggtcgtggatgtttctcacgaagaccccgaggtgaaattcaattggtatgtcgatggggtggaagtacataacgccaagacaaaaccacgggaggagcagtacaattcaacctatcgcgttgtgagtgtcctgactgtgcttcaccaggactggttgaacggaaaggaatacaaatgcaaggtcagcaataaggcgctgcctgcacccatcgagaaaacaatttccaaggccaaaggtcagccacgagaaccccaagtgtataccctacctccatctcgtgaggaaatgacgaagaaccaggtttcgctcacctgtctggtgaaaggcttttacccgagcgatatcgctgtagagtgggagtccaatgggcagcccgaaaacaattacaagacaactcctccagtccttgactcagacggaagtttctttctgtattctaagttgaccgtggataaaagcagatggcaacagggcaacgttttctcctgctcagtgatgcacgaggccctccataatcactacacacaaaagagcctgtctttatcccccggtaaa

SEQ ID NO: 28205 - RNA, 1359 nt, synthetic construct
  misc_feature 1..1359: note = derived and/or modified sequence opt3 from anti-influenza_Chain
  source 1..1359: mol_type = other RNA
gaggtgcagctggtccaaagcggcgccgaagttaagaaacccggggagtccctcaagatctcttgcaaagtgtcaggatacagtttcaccagccagtggattggttgggtaagacagatgcctggcaaggggcttgaatggataggaatgatgtatccaggcgacgctgatgcaatctactccccgtcttttcagggtcaagtgacaatttcggccgacaactcaatcagcactgcgtatctgcagtggagttccttgaaggcttctgatacggccatttactattgtgcaagcgggcccggatactccggctatcactacggctggttcgacacctgggggcagggaacattagtcactgtgtcaagtgccagcaccaaaggtccttctgtttttccactggctccctcctcaaagagcacaagtggcgggaccgcagccctaggatgcctcgtgaaagattacttccctgagccagtcactgtgtcttggaactccggcgctctgacaagcggtgtacatacctttcccgccgttcttcagtcgtctgggctgtattccttgtcaagtgtggtcacggtgcctagctcctctctcggaactcaaacctacatctgtaatgtgaatcacaagccaagcaacacaaaagtcgacaagaaagttgaaccgaagtcatgcgataagactcatacctgtcccccttgcccagcgcccgagctgctgggcggccctagtgtgttcctctttccacccaaaccgaaggacacattaatgatatccaggacccctgaggtaacgtgtgtggtcgtggatgttagccacgaagaccccgaggtgaaattcaattggtatgtcgatggggtggaagtacataacgcaaagactaaaccacgggaggagcagtacaattctacatatcgcgttgtgtcagtcctgaccgtgcttcaccaggactggttgaacggaaaggaatacaaatgcaaggtcagtaataaggccctgcctgctcccatcgagaaaactattagcaaggccaaaggtcagccacgagaaccccaagtgtatacactacctccatcccgtgaggaaatgaccaagaaccaggtttctctcacgtgtctggtgaaaggcttttacccgtcggatatcgcagtagagtgggagagcaatgggcagcccgaaaacaattacaagaccacacctccagtccttgactccgacggatcattctttctgtatagtaagttgactgtggataaatctagatggcaacagggcaacgttttcagctgctccgtgatgcacgaggctctccataatcactacacccagaagtcactgagcttatctcccggtaaa

SEQ ID NO: 28206 - RNA, 1359 nt, synthetic construct; identical to SEQ ID NO: 23949
  misc_feature 1..1359: note = derived and/or modified sequence opt3 from anti-influenza_Chain
  source 1..1359: mol_type = other RNA

SEQ ID NO: 28207 - RNA, 1359 nt, synthetic construct
  misc_feature 1..1359: note = derived and/or modified sequence opt3 from anti-influenza_Chain
  source 1..1359: mol_type = other RNA
gaggtgcagctggtccaaagcggcgccgaagttaagaaacccggggagtccctcaagatctcttgcaaagtgtcaggatacagtttcaccagccagtggattggttgggtaagacagatgcctggcaaggggcttgaatggataggaatgatgtatccaggcgacgctgatacaatctactccccgtcttttcagggtcaagtgactatttcggcagacaactcaatcagcacggcctatctgcagtggagttccttgaaagcgtctgataccgctatttactattgtgccagcgggcccggatactccggctatcactacggctggttcgacacatgggggcagggaactttagtcaccgtgtcaagtgcaagcacaaagggtccttctgtttttccactggccccctcctcaaagagcaccagtggcgggactgctgcactaggatgcctcgtgaaagattacttccctgagccagtcacagtgtcttggaactccggcgccctgaccagcggtgtacatacgtttcccgctgttcttcagtcgtctgggctgtattccttgtcaagtgtggtcactgtgcctagctcctctctcggaacccaaacatacatctgtaatgtgaatcacaagccaagcaacactaaagtcgacaagaaagttgaaccgaagtcatgcgataagacccatacatgtcccccttgcccagcccccgagctgctgggcggccctagtgtgttcctctttccacccaaaccgaaggacaccttaatgatatccaggacgcctgaggtaacttgtgtggtcgtggatgttagccacgaagaccccgaggtgaaattcaattggtatgtcgatggggtggaagtacataacgcgaagacaaaaccacgggaggagcagtacaattctacctatcgcgttgtgtcagtcctgactgtgcttcaccaggactggttgaacggaaaggaatacaaatgcaaggtcagtaataaggcactgcctgcccccatcgagaaaacaattagcaaggctaaaggtcagccacgagaaccccaagtgtataccctacctccatcccgtgaggaaatgacgaagaaccaggtttctctcacctgtctggtgaaaggcttttacccgtcggatatcgccgtagagtgggagagcaatgggcagcccgaaaacaattacaagacaactcctccagtccttgactccgacggatcattctttctgtatagtaagttgaccgtggataaatctagatggcaacagggcaacgttttcagctgctccgtgatgcacgaggcactccataatcactacacacagaagtcactgagcttatctcccggtaaa

SEQ ID NO: 28208 - RNA, 1359 nt, synthetic construct
  misc_feature 1..1359: note = derived and/or modified sequence opt3 from anti-influenza_Chain
  source 1..1359: mol_type = other RNA
gaggtgcagctggtccaaagcggcgccgaagttaagaaacccggggagtccctcaagatctcttgcaaagtgtcaggatacagtttcaccagccagtggattggttgggtaagacagatgcctggcaaggggcttgaatggataggaatgatgtatccaggctcctctgacacaatctactcgccgtcatttcagggtcaagtgactattagcgctgataacagtatctccacggcatatctgcagtggtctagcttgaaagcctccgacaccgcgatttactattgtgcttcagggcccggatacagtggctatcactacggctggttcgatacatgggggcagggaactttagtcaccgtgagctctgcctccacaaagggtccttcagtttttccactggcacccagcagtaagtctacctccggcgggactgccgctctaggatgcctcgtgaaagactacttccctgagccagtcacagtgagctggaactcgggcgcactgacctctggtgtacatacgtttcccgccgttcttcagtcctcagggctgtatagtttgagctccgtggtcactgtgccttctagctcactcggaacccaaacatacatctgtaatgtgaatcacaagccaagtaacactaaagtcgataagaaagttgaaccgaagtcctgcgacaagacccatacatgtcccccttgcccagctcccgagctgctgggcggccctagcgtgttcctctttccacccaaaccgaaggataccttaatgatatctaggacgcctgaggtaacttgtgtggtcgtggacgtttcacacgaagatcccgaggtgaaattcaattggtatgtcgacggggtggaagtacataacgccaagacaaaaccacgggaggagcagtacaatagtacctatcgcgttgtgagcgtcctgactgtgcttcaccaggattggttgaacggaaaggaatacaaatgcaaggtctccaataaggcgctgcctgcacccatcgagaaaacaatttctaaggccaaaggtcagccacgagaaccccaagtgtataccctacctccatcgcgtgaggaaatgacgaagaaccaggttagcctcacctgtctggtgaaaggcttttacccgtccgacatcgctgtagagtgggagtcaaatgggcagcccgaaaacaattacaagacaactcctccagtccttgatagtgacggatctttctttctgtatagcaagttgaccgtggacaaatccagatggcaacagggcaacgttttctcatgcagcgtgatgcacgaggccctccataatcactacacacagaagtctctgtccttaagtcccggtaaa

SEQ ID NO: 28209 - RNA, 1359 nt, synthetic construct
  misc_feature 1..1359: note = derived and/or modified sequence opt3 from anti-influenza_Chain
  source 1..1359: mol_type = other RNA
gaggtgcagctggtccagagcggcgccgaagttaagaaacccggggagtccctcaagatctcttgcaaagtgtcaggatacagtttcaccagccagtggattggttgggtaagacagatgcctggcaaggggcttgaatggataggaatgatgtatccaggcgactccgatgctatctactctccgtcgtttcagggtcaagtgacaatttcagcagacaacagcatcagtactgcctatctgcagtggtcctctttgaaagcgagcgatacggctatttactattgtgcctccgggcccggatactcaggctatcactacggctggttcgacacctgggggcagggaacattagtcactgtgagtagcgcatctaccaagggtccttccgtttttccactggccccctcaagcaagagtacatctggcgggaccgctgcactaggatgcctcgtgaaagattacttccctgagccagtcactgtgtcctggaatagcggcgccctgacatcgggtgtacatacctttcccgctgttcttcagtcttccgggctgtattcattgagtagcgtggtcacggtgccttcctctagcctcggaactcaaacctacatctgtaacgtgaatcacaagccatcaaacacaaaagtcgacaagaaagttgaaccgaagagttgcgataagactcatacctgtcccccttgcccagcccccgagctgctgggcggcccttccgtgttcctctttccacccaaaccgaaggacacattaatgataagcaggacccctgaggtaacgtgtgtggtcgtggatgtttctcacgaagaccccgaggtgaaattcaattggtatgtcgatggggtggaagtacataacgcgaagactaaaccacgggaggagcagtacaattcaacatatcgcgttgtgagtgtcctgaccgtgcttcaccaggactggttgaacggaaaggaatacaaatgcaaggtcagcaataaggcactgcctgcccccatcgagaaaactatttccaaggctaaaggtcagccacgagaaccccaagtgtatacactacctccatctcgtgaggaaatgaccaagaaccaggtttcgctcacgtgtctggtgaaaggcttttacccgagcgatatcgccgtagagtgggagtccaatgggcagcccgaaaacaattacaagaccacacctccagtccttgactcagacggaagtttctttctgtattctaagttgactgtggataaaagcagatggcaacagggcaacgttttctcctgctcagtgatgcacgaggcactccataatcactacacccaaaagagcctgtctttatcccccggtaaa

SEQ ID NO: 28210 - RNA, 1359 nt, synthetic construct
  misc_feature 1..1359: note = derived and/or modified sequence opt3 from anti-influenza_Chain
  source 1..1359: mol_type = other RNA
gaggtgcagctggtccaaagcggcgccgaagttaagaaacccggggagtccctcaagatctcttgcaaagtgtcaggatacagtttcaccagccagtggattggttgggtaagacagatgcctggcaaggggcttgaatggataggaatgatgtatccaggcgacacagatactatctactccccgtcttttcagggtcaagtgacgatttcggctgacaactcaatcagcaccgcatatctgcagtggagttccttgaaagcctctgatacagcgatttactattgtgctagcgggcccggatactccggctatcactacggctggttcgacacttgggggcagggaaccttagtcacagtgtcaagtgccagcaccaagggtccttctgtttttccactggcaccctcctcaaagagcacttccggcgggacagccgctctaggatgcctcgtgaaagattacttccctgagccagtcaccgtgtcttggaatagtggcgcactgacgagcggtgtacatacttttcccgccgttcttcagtcgtctgggctgtattccttgtcaagtgtggtcaccgtgcctagctcctctctcggaacacaaacttacatctgtaacgtgaatcacaagccaagcaacaccaaagtcgacaagaaagttgaaccgaagtcatgcgataagacacatacctgtcccccttgcccagctcccgagctgctgggcggccctagtgtgttcctctttccacccaaaccgaaggacacgttaatgatatccaggactcctgaggtaacatgtgtggtcgtggatgttagccacgaagaccccgaggtgaaattcaattggtatgtcgatggggtggaagtacataacgccaagaccaaaccacgggaggagcagtacaattctacttatcgcgttgtgtcagtcctgacagtgcttcaccaggactggttgaacggaaaggaatacaaatgcaaggtcagtaataaggcgctgcctgcacccatcgagaaaaccattagcaaggccaaaggtcagccacgagaaccccaagtgtatacgctacctccatcccgtgaggaaatgaccaagaaccaggtttctctcacatgtctggtgaaaggcttttacccgtcggatatcgctgtagagtgggagagcaatgggcagcccgaaaacaattacaagactacccctccagtccttgactccgacggatcattctttctgtatagtaagttgacagtggataaatctagatggcaacagggcaacgttttcagctgctccgtgatgcacgaggccctccataatcactacactcagaagtcactgagcttatctcccggtaaa

SEQ ID NO: 28211 - RNA, 1359 nt, synthetic construct
  misc_feature 1..1359: note = derived and/or modified sequence opt3 from anti-influenza_Chain
  source 1..1359: mol_type = other RNA
gaggtgcagctggtccaaagcggcgccgaagttaagaaacccggggagtccctcaagatctcttgcaaagtgtcaggatacagtttcaccagccagtggattggttgggtaagacagatgcctggcaaggggcttgaatggataggaatgatgtatccaggcgagtccgacacaatctactctccgtcgtttcagggtcaagtgactatttcagctgataacagcatcagtacggcatatctgcagtggtcctctttgaaagccagcgacaccgcgatttactattgtgcttccgggcccggatactcaggctatcactacggctggttcgatacatgggggcagggaactttagtcaccgtgagtagcgcctctacaaagggtccttccgtttttccactggcaccctcaagcaagagtacctctggcgggactgccgctctaggatgcctcgtgaaagactacttccctgaaccagtcacagtgtcctggaatagcggcgcactgacctcgggtgtacatacgtttcccgccgttcttcagtcttccgggctgtattcattgagtagcgtggtcactgtgccttcctctagcctcggaacccaaacatacatctgtaacgtgaatcacaagccatcaaacactaaagtcgataagaaagttgagccgaagagttgcgacaagacccatacatgtcccccttgcccagctcccgagctgctgggcggcccttccgtgttcctctttccacccaaaccgaaggataccttaatgataagcaggacgcctgaagtaacttgtgtggtcgtggacgtttctcacgaggatcccgaagtgaaattcaattggtatgtcgacggggtggaggtacataacgccaagacaaaaccacgggaggaacagtacaattcaacctatcgcgttgtgagtgtcctgactgtgcttcaccaggattggttgaacggaaaggagtacaaatgcaaggtcagcaataaggcgctgcctgcacccatcgaaaagacaatttccaaggccaaaggtcagccacgagagccccaagtgtataccctacctccatctcgtgaagagatgacgaagaaccaggtttcgctcacctgtctggtgaaaggcttttacccgagcgacatcgctgtagagtgggaatccaatgggcagcccgagaacaattacaagacaactcctccagtccttgattcagacggaagtttctttctgtattctaagttgaccgtggacaaaagcagatggcaacagggcaacgttttctcctgctcagtgatgcacgaagccctccataatcactacacacagaaaagcctgtctttatcccccggtaaa

SEQ ID NO: 28212 - RNA, 1359 nt, synthetic construct; identical to SEQ ID NO: 28200
  misc_feature 1..1359: note = derived and/or modified sequence opt3 from anti-influenza_Chain
  source 1..1359: mol_type = other RNA

SEQ ID NO: 28213 - RNA, 1359 nt, synthetic construct; identical to SEQ ID NO: 28201
  misc_feature 1..1359: note = derived and/or modified sequence opt3 from anti-influenza_Chain
  source 1..1359: mol_type = other RNA

SEQ ID NO: 28214 - RNA, 1359 nt, synthetic construct; identical to SEQ ID NO: 28202
  misc_feature 1..1359: note = derived and/or modified sequence opt3 from anti-influenza_Chain
  source 1..1359: mol_type = other RNA

SEQ ID NO: 28215 - RNA, 1359 nt, synthetic construct; identical to SEQ ID NO: 28203
  misc_feature 1..1359: note = derived and/or modified sequence opt3 from anti-influenza_Chain
  source 1..1359: mol_type = other RNA

SEQ ID NO: 28216 - RNA, 1359 nt, synthetic construct; identical to SEQ ID NO: 28204
  misc_feature 1..1359: note = derived and/or modified sequence opt3 from anti-influenza_Chain
  source 1..1359: mol_type = other RNA

SEQ ID NO: 28217 - RNA, 1359 nt, synthetic construct; identical to SEQ ID NO: 28205
  misc_feature 1..1359: note = derived and/or modified sequence opt3 from anti-influenza_Chain
  source 1..1359: mol_type = other RNA

SEQ ID NO: 28218 - RNA, 1359 nt, synthetic construct; identical to SEQ ID NO: 23949
  misc_feature 1..1359: note = derived and/or modified sequence opt3 from anti-influenza_Chain
  source 1..1359: mol_type = other RNA

SEQ ID NO: 28219 - RNA, 1359 nt, synthetic construct; identical to SEQ ID NO: 28207
  misc_feature 1..1359: note = derived and/or modified sequence opt3 from anti-influenza_Chain
  source 1..1359: mol_type = other RNA

SEQ ID NO: 28220 - RNA, 1359 nt, synthetic construct; identical to SEQ ID NO: 28208
  misc_feature 1..1359: note = derived and/or modified sequence opt3 from anti-influenza_Chain
  source 1..1359: mol_type = other RNA

SEQ ID NO: 28221 - RNA, 1359 nt, synthetic construct; identical to SEQ ID NO: 28209
  misc_feature 1..1359: note = derived and/or modified sequence opt3 from anti-influenza_Chain
  source 1..1359: mol_type = other RNA

SEQ ID NO: 28222 - RNA, 1359 nt, synthetic construct; identical to SEQ ID NO: 28210
  misc_feature 1..1359: note = derived and/or modified sequence opt3 from anti-influenza_Chain
  source 1..1359: mol_type = other RNA

SEQ ID NO: 28223 - RNA, 1359 nt, synthetic construct; identical to SEQ ID NO: 28211
  misc_feature 1..1359: note = derived and/or modified sequence opt3 from anti-influenza_Chain
  source 1..1359: mol_type = other RNA

SEQ ID NO: 28224 - RNA, 1365 nt, synthetic construct
  misc_feature 1..1365: note = derived and/or modified sequence opt3 from anti-influenza_Chain
  source 1..1365: mol_type = other RNA
caggtgcaactggtcgagagcggcgggggagttgtgcagcccggtagatccctcaggctttcttgcgccgcttcaggcttcgcatttcacaaccgggccatgcattgggtacgccaggcgcctgggaagggactggaatgggtggctttgatctacttcgacggcagtaaacagtattacgccgatagcgtcaagggtcgatttaccatttcccgtgacaattctaaaaacacagtgttcttacaaatgaactcgctgagaccagaggatactgcagtttattactgtgccgtgccggggcccatatttggaatcttccctccatggtcatattttgaccactggggccagggcattctagtcacggtgagcagtgcttccaccaaggggccctctgtattccctctcgcaccaagctccaaatcaacaagtggaggtactgccgctctgggctgccttgttaaggattactttcccgaacctgtgaccgtcagctggaactctggggccctgacatccggagtgcataccttcccagcggtgttgcagtcaagcggcctctatagtctgtcttccgtcgttactgtgccgagctcgtctctgggtacacagacctacatctgtaatgtaaatcacaagccctccaatacgaaagtggacaagaaagtcgagcctaagtcatgcgataaaactcatacctgtccaccctgccctgcaccagaactcttagggggacccagtgtgtttctgttcccgcctaagcccaaggacacacttatgattagcaggactccagaggttacctgtgtggtcgtggatgtatcccacgaggaccctgaagttaaatttaactggtacgtggatggcgtcgaggtgcacaatgccaagacaaaaccccgggaggaacaatataactctacctaccgcgtcgtgagcgttttgacggtgctgcatcaggactggctaaatggcaaggagtataaatgcaaggtatcaaacaaagctctcccagcccccatcgaaaagactataagtaaggcaaaagggcagcctagagagccacaggtctacacactgccgccctccagggaagagatgaccaagaatcaagtgagccttacttgtctggttaaaggattctatccttctgatatcgctgtggaatgggagtcaaacggtcagccagagaataactacaagacaacgccccctgtcttggacagtgacggcagcttctttctctattccaaactgaccgtggataagtctcggtggcagcaagggaacgtattctcgtgcagcgtgatgcacgaagccttacataatcactacacccagaagtccctgtcactcagtccaggaaaa

SEQ ID NO: 28225 - RNA, 1365 nt, synthetic construct
  misc_feature 1..1365: note = derived and/or modified sequence opt3 from anti-influenza_Chain
  source 1..1365: mol_type = other RNA
gaggtgcagctggtcgaaagcggcgggggagttgtgcaacccggtagatccctcaggctttcttgcgccgcttcaggcttcgcatttcacaaccgggccatgcattgggtacgccaggcgcctgggaagggactggagtgggtggctttgatctacttcgacggcagtaaacagtattacgccgatagcgtcaagggtcgatttaccatttcccgtgacaattctaaaaacacagtgttcttacagatgaactcgctgagaccagaagatactgcagtttattactgtgccgtgccggggcccatatttggaatcttccctccatggtcatattttgaccactggggccaaggcattctagtcacggtgagcagtgcttccaccaaggggccctctgtattccctctcgcaccaagctccaaatcaacaagtggaggtactgccgctctgggctgccttgttaaggattactttcccgagcctgtgaccgtcagctggaactctggggccctgacatccggagtgcataccttcccagcggtgttgcagtcaagcggcctctatagtctgtcttccgtcgttactgtgccgagctcgtctctgggtacacagacctacatctgtaatgtaaatcacaagccctccaatacgaaagtggacaagaaagtcgaacctaagtcatgcgataaaactcatacctgtccaccctgccctgcaccagagctcttagggggacccagtgtgtttctgttcccgcctaagcccaaggacacacttatgattagcaggactccagaggttacctgtgtggtcgtggatgtatcccacgaagaccctgaggttaaatttaactggtacgtggatggcgtcgaagtgcacaatgccaagacaaaaccccgggaggagcagtataactctacctaccgcgtcgtgagcgttttgacggtgctgcatcaagactggctaaatggcaaggaatataaatgcaaggtatcaaacaaagctctcccagcccccatcgagaagactataagtaaggcaaaagggcagcctagagaaccacaggtctacacactgccgccctccagggaggaaatgaccaagaatcaggtgagccttacttgtctggttaaaggattctatccttctgatatcgctgtggagtgggagtcaaacggtcaaccagaaaataactacaagacaacgccccctgtcttggacagtgacggcagcttctttctctattccaaactgaccgtggataagtctcggtggcagcaggggaacgtattctcgtgcagcgtgatgcacgaggccttacataatcactacacccaaaagtccctgtcactcagtccaggaaaa

SEQ ID NO: 28226 - RNA, 1365 nt, synthetic construct
  misc_feature 1..1365: note = derived and/or modified sequence opt3 from anti-influenza_Chain
  source 1..1365: mol_type = other RNA
gaggtgcagctggtccaaagcggcgggggagttgtgcagcccggtaagtccctcagactttcttgcgccgcttcaggcctgaccttcagtagctacgcagtacactgggtgaggcaggcccctgggaaaggattggaatgggtcacattaatctcctatgacggcgcgaaccagtactatgctgattctgtgaagggtcggtttactatttcgcgcgacaattcaaagaacacggtttacctgcaaatgaatagcctacgaccagaggataccgccgtgtattactgtgcagtcccggggcccgtgttcggaatatttcctccatggagttatttcgacaactggggccagggcatcctcgtaacagtttcctctgccagcactaaagggccctccgtgtttcctctggctccatcaagtaaaagcacctctggaggtacagcagcccttggctgcctggtcaaggattacttccccgaacctgtgaccgtgtcctggaactcaggggctttgactagcggagtccatacatttccagccgttctccagagttctggcctgtactccctgagctcggtggtaaccgtgccgtcttcctcactcggtacgcagacttatatttgtaatgtcaatcacaagcccagtaacaccaaagtggacaagaaagttgagcctaagagctgcgataaaacacatacttgtccaccctgccctgcgccagaattacttgggggaccctccgtgttcctgtttccgcctaagcccaaggacaccttgatgatctctcgtacaccagaggtcacctgtgtggtagttgatgtgagccacgaggaccctgaagtcaaattcaattggtacgtggatggcgtcgaggtgcataacgcaaagacgaaacccagagaggaacaatataattcaacttacagggttgtgagtgtactgacagtcctacaccaggactggctcaacggcaaggagtataaatgcaaggtgtccaataaagccctgccagctcccattgaaaagaccatcagcaaggccaaagggcagcctcgggagccacaggtttacactcttccgccctctcgcgaagagatgacaaagaaccaagtgtcactgacctgtttggtcaaaggattttatcctagtgatatagcagtggaatgggagagcaatggtcagccagagaacaactacaagacgacaccccctgtactcgactccgacggctctttctttctgtactcgaaattaaccgtggataagagcagatggcagcaagggaatgttttctcctgctcagtcatgcacgaagctctgcataaccactatactcagaagagtctctctcttagcccaggaaaa

SEQ ID NO: 28227 - RNA, 1365 nt, synthetic construct
  misc_feature 1..1365: note = derived and/or modified sequence opt3 from anti-influenza_Chain
  source 1..1365: mol_type = other RNA
caggtgcaactggtcgagagcggcgggggagttgtgcagcccggtaagtccctcagactttcttgcgccgcttcaggcctgaccttcagtagctacgcagtacactgggtgaggcaggcccctgggaaaggattggaatgggtcacattaatctcctatgacggcgcgaaccagtactatgctgattctgtgaagggtcggtttactatttcgcgcgacaattcaaagaacacggtttacctgcaaatgaatagcctacgaccagaggataccgccgtgtattactgtgcagtcccggggcccgtgttcggaatatttcctccatggagttatttcgacaactggggccagggcatcctcgtaacagtttcctctgccagcactaaagggccctccgtgtttcctctggctccatcaagtaaaagcacctctggaggtacagcagcccttggctgcctggtcaaggattacttccccgaacctgtgaccgtgtcctggaactcaggggctttgactagcggagtccatacatttccagccgttctccagagttctggcctgtactccctgagctcggtggtaaccgtgccgtcttcctcactcggtacgcagacttatatttgtaatgtcaatcacaagcccagtaacaccaaagtggacaagaaagttgagcctaagagctgcgataaaacacatacttgtccaccctgccctgcgccagaattacttgggggaccctccgtgttcctgtttccgcctaagcccaaggacaccttgatgatctctcgtacaccagaggtcacctgtgtggtagttgatgtgagccacgaggaccctgaagtcaaattcaattggtacgtggatggcgtcgaggtgcataacgcaaagacgaaacccagagaggaacaatataattcaacttacagggttgtgagtgtactgacagtcctacaccaggactggctcaacggcaaggagtataaatgcaaggtgtccaataaagccctgccagctcccattgaaaagaccatcagcaaggccaaagggcagcctcgggagccacaggtttacactcttccgccctctcgcgaagagatgacaaagaaccaagtgtcactgacctgtttggtcaaaggattttatcctagtgatatagcagtggaatgggagagcaatggtcagccagagaacaactacaagacgacaccccctgtactcgactccgacggctctttctttctgtactcgaaattaaccgtggataagagcagatggcagcaagggaatgttttctcctgctcagtcatgcacgaagctctgcataaccactatactcagaagagtctctctcttagcccaggaaaa

SEQ ID NO: 28228 - RNA, 1365 nt, synthetic construct
  misc_feature 1..1365: note = derived and/or modified sequence opt3 from anti-influenza_Chain
  source 1..1365: mol_type = other RNA
caggtgcaactggtcgagagcggcgggggagttgtgcagcccggtaagtcccctagactctcttgcgccgcttcaggcccaaccttcagtagctacgcagtacactgggtgaggcaggccccggggaaaggacttgaatgggtcacactgatctcctatgacggcgcgaaccagtactatgctgattctgtgaagggtcggtttactatttcgcgcgacaattcaaagaacacggtttacttgcaaatgaatagcttacgacccgaggataccgccgtgtattactgtgcagtccctgggccagtgttcggaatatttcccccttggagttatttcgacaactggggccagggcatcctggtaacagtttcctctgccagcactaaagggccatccgtgtttcccctagctccttcaagtaaaagcacctctggaggtacagcagccctcggctgcctggtcaaggattacttcccagaaccggtgaccgtgtcctggaactcaggggctcttactagcggagtccatacatttcccgccgttctgcagagttctggcttgtactccctcagctcggtggtaaccgtgccttcttcctcactgggtacgcagacttatatttgtaatgtcaatcacaagccaagtaacaccaaagtggacaagaaagttgagcccaagagctgcgataaaacacatacttgtcctccatgccccgcgccggaactgctcgggggaccttccgtgttcttatttcccccaaagcctaaggacaccctgatgatctctcgtacacccgaggtcacctgtgtggtagttgatgtgagccacgaggacccagaagtcaaattcaattggtacgtggatggcgtcgaggtgcataacgcaaagacgaaacccagagaggaacaatataattcaacttacagggttgtgagtgtacttacagtcttgcaccaggactggctgaacggcaaggagtataaatgcaaggtgtccaataaagccctacctgctccaattgaaaagaccatcagcaaggccaaagggcagccgcgggagccccaggtttacactctccctccatctcgcgaagagatgacaaagaaccaagtgtcactgacctgtcttgtcaaaggattttatcccagtgatatagcagtggaatgggagagcaatggtcagcctgagaacaactacaagacgaccccacccgtactggactccgacggctctttctttttgtactcgaaactcacagtggataagagcagatggcagcaagggaatgttttctcctgctcagtcatgcacgaagctctgcataaccactatactcagaagagtttatctctgagcccgggaaaa

SEQ ID NO: 28229 - RNA, 1365 nt, synthetic construct; identical to SEQ ID NO: 23933
  misc_feature 1..1365: note = derived and/or modified sequence opt3 from anti-influenza_Chain
  source 1..1365: mol_type = other RNA

SEQ ID NO: 28230 - RNA, 1365 nt, synthetic construct
  misc_feature 1..1365: note = derived and/or modified sequence opt3 from anti-influenza_Chain
  source 1..1365: mol_type = other RNA
caggtgcaactggtccagagcggcgccgagctcaagagacccggggcttccgttaaagtgtcttgcaagacctcaggatacagtttcaacaattatggtatcaactgggtaaggcaggcacctggccaggggcttgaatggatgggatggattagcgcctacacaggcaatactcactatgcgaaaaactttgagggtcgggtgacgctgaccacagacacttccacctctacagcttacatggaagtccgctcgttgcgatcagatgacagcgccgtgtatttctgtgcacgtgccatgatacaaggggttgtgaccttatacctgagaccaggagattattggggccagggcactctagtcacagtgagttccgcttctaccaaggggccgagcgtatttcccctcgcaccttcctcaaaaagtacgagcggaggtactgccgctctgggctgccttgttaaggactacttcccagagcccgtgaccgtctcttggaactccggggccctgacatcaggagtgcatacttttcctgcggtgttgcagagcagtggcctctactctctgtccagcgtcgttaccgtgccatcgtcttccctgggtacacagacctatatctgtaatgtaaatcacaagccctcaaacacgaaagtggataagaaagtcgaacctaagagttgcgacaaaactcatacatgtccaccgtgccccgcacctgagctcttagggggaccaagcgtgttcctgtttccccctaagccaaaggatacccttatgatttccaggactcccgaggttacatgtgtggtcgtggacgtatctcacgaagatccggaggttaaattcaattggtacgtggacggcgtcgaagtgcataacgccaagaccaaacctcgggaggagcaatataatagcacgtaccgcgtcgtgtcagttttgaccgtgctgcaccaggattggctaaacggcaaggaatataaatgcaaggtaagtaataaagctctccccgccccaatcgagaagacaatttccaaggcaaaagggcagcctagagaaccccaggtctacactctgccacccagcagggaggaaatgaccaagaaccaagtgtctcttacatgtctggttaaaggattttatccttcagacatcgctgtggagtgggagagtaatggtcagccagaaaacaactacaagactaccccgcccgtcttggatagcgacggctccttctttctctactctaaactgacagtggacaagtcgcggtggcagcaagggaatgtattcagctgctccgtgatgcacgaggccttacataaccactatacccagaagtcactgagtctctctcctggaaaa

SEQ ID NO: 28231 - RNA, 1365 nt, synthetic construct; identical to SEQ ID NO: 28224
  misc_feature 1..1365: note = derived and/or modified sequence opt3 from anti-influenza_Chain
  source 1..1365: mol_type = other RNA

SEQ ID NO: 28232 - RNA, 1365 nt, synthetic construct; identical to SEQ ID NO: 28225
  misc_feature 1..1365: note = derived and/or modified sequence opt3 from anti-influenza_Chain
  source 1..1365: mol_type = other RNA

SEQ ID NO: 28233 - RNA, 1365 nt, synthetic construct; identical to SEQ ID NO: 28226
  misc_feature 1..1365: note = derived and/or modified sequence opt3 from anti-influenza_Chain
  source 1..1365: mol_type = other RNA

SEQ ID NO: 28234 - RNA, 1365 nt, synthetic construct; identical to SEQ ID NO: 28227
  misc_feature 1..1365: note = derived and/or modified sequence opt3 from anti-influenza_Chain
  source 1..1365: mol_type = other RNA

SEQ ID NO: 28235 - RNA, 1365 nt, synthetic construct; identical to SEQ ID NO: 28228
  misc_feature 1..1365: note = derived and/or modified sequence opt3 from anti-influenza_Chain
  source 1..1365: mol_type = other RNA

SEQ ID NO: 28236 - RNA, 1365 nt, synthetic construct; identical to SEQ ID NO: 23933
  misc_feature 1..1365: note = derived and/or modified sequence opt3 from anti-influenza_Chain
  source 1..1365: mol_type = other RNA

SEQ ID NO: 28237 - RNA, 1365 nt, synthetic construct; identical to SEQ ID NO: 28230
  misc_feature 1..1365: note = derived and/or modified sequence opt3 from anti-influenza_Chain
  source 1..1365: mol_type = other RNA

SEQ ID NO: 28238 - RNA, 1368 nt, synthetic construct
  misc_feature 1..1368: note = derived and/or modified sequence opt3 from anti-influenza_Chain
  source 1..1368: mol_type = other RNA
gaggtgcagctggtccaaagcggcgggggagttgtgcagcccagaaggtccctccggctttcttgcgccgcttcaggtttcacctttagtagctacgcaatgcactgggtacgccaggcccctggcaaggggctggaatgggtggcggtcatctcctatgacggacgaaacaaatactatgctgattctgtgaagggccgtttcacagtttcgagagacaattcaaagaacactttgtacttacagatgaatagcctgagggccgaggatacgagtgtgtattactgtgcacgggaactactcatggactattacgatcatattggttactccccagggccgacctggggacaaggcacactggtcactgtgtctagcgcctccaccaaaggcccctcagtatttcctcttgctccaagtagcaaatctacatccgggggaaccgcagccctgggttgcttggttaaggactatttccccgagcctgtgactgtctcatggaacagcggcgctctcacaagtggggtgcacacctttccagccgtgctgcagtcttccggactgtacagcctctcgtctgtcgttacggtgccctcctcaagtttaggcactcagacctatatatgtaatgtaaaccataagcctagcaatacaaaagtggataagcgcgtcgaaccaaaatcctgcgacaagactcacacctgtccgccctgccctgcgccagagctgcttggtgggccctctgtgttcttgtttcctccaaaacccaaggatacactgatgatcagcagaaccccggaggttacgtgtgtggtcgtggacgtatcacatgaagatcctgaggttaagttcaactggtacgtggacggagtcgaagtgcacaatgcaaaaactaagcccagggaggagcagtataacagtacataccgggtcgtgtccgttctaaccgtgctccaccaagattggctgaatggcaaagaatataagtgcaaagtaagcaacaaggcccttccagctcctattgagaaaactatctctaaggccaagggccagccccgcgaaccacaggtctacacactgcccccttcacgagaggaaatgaccaaaaatcaggtgagtttgacgtgtctcgttaaggggttttacccaagcgacattgcagtggagtgggagtccaacggacaaccggaaaataactataaaaccacaccccctgtcctggactctgatggttcgttctttttatacagcaagctgactgtggacaaatccagatggcagcagggcaacgtattctcatgcagtgtgatgcatgaggctctccacaatcattatacccaaaagtctcttagcctgtccccagggaag

SEQ ID NO: 28239 - RNA, 1371 nt, synthetic construct
  misc_feature 1..1371: note = derived and/or modified sequence opt3 from anti-influenza_Chain
  source 1..1371: mol_type = other RNA
atggtgatccagagaaacagcattctgctccttataatcattttcgcctcctctatctcaacctgcaggagtaatgtcattgacgataacctgtttaagcaagtttacgacaatatcttggagcaggagttcgctcacgattttcaggcatatttaagctacctgtccaaaaacatagaatctaataacaatatcgacaaggtggataaaaacggcattaaggtaatcaatgtgctatcgttcggggccaaaggagacggtaagacatatgataacattgcgtttgaacaggcttggaatgaggcctgttcaagccggactcccgtccaattcgtggttcctaagaacaaaaattacctcctgaagcagatcacgtttagtggcccatgccgctcctctataagcgtgaaaattttcgggtcccttgaagcatcaagtaagatcagcgactataaagatcgacgtctgtggattgcctttgactctgtccagaacttggtggtaggaggcggtgggaccatcaatggaaacggccaggtttggtggccgtcctcatgtaagatcaacaagagcctcccctgcagagatgctcctacagcactgactttctggaattgtaaaaacctgaaggtgaataacctcaaaagtaagaatgcccaacagattcatataaaatttgagtcttgcaccaacgtcgtggcttccaatttaatgatcaacgccagcgcgaagtcgccaaatacagacggcgtgcacgtctctaacacccagtacattcagatctccgatactataattgggacaggagacgactgtatctcaatcgttagtggtagccaaaatgtgcaggcaaccaacattacgtgcggccccgggcatggaatctccattggctctctgggtagcggaaattcagaggcctatgtaagtaacgtgactgtcaatgaagctaaaataatcggggccgagaacggcgtgaggattaagacctggcagggcgggtccggacaagcaagcaacatcaagttccttaatgttgaaatgcaggatgtgaaataccctatcattatagaccagaactactgtgatcgggtcgagccatgcatccagcaattttctgctgtgcaggtaaagaatgttgtgtatgagaacattaaaggtacatcagccactaaggtcgcgatcaaattcgactgtagtaccaatttcccctgcgaaggcattatcatggagaacataaatttggtgggggaaagcggaaagccttccgaggccacatgcaagaacgtccactttaataacgcagaacatgtgaccccacactgtacgtctctggagatctcggaggatgaagctctactctacaattat

SEQ ID NO: 28240 - RNA, 1371 nt, synthetic construct; identical to SEQ ID NO: 28239
  misc_feature 1..1371: note = derived and/or modified sequence opt3 from anti-influenza_Chain
  source 1..1371: mol_type = other RNA

SEQ ID NO: 28241 - RNA, 1380 nt, synthetic construct
  misc_feature 1..1380: note = derived and/or modified sequence opt3 from anti-influenza_Chain
  source 1..1380: mol_type = other RNA
atgaagctgtggctcaactggatcttccttgtgaccctgttgaatgacattcagtgcgaggtcaaattagttgaaagcggcgggggactggtgcaacccggtggctccctaagactctcttgtgccacatcagggtttactttcagtgattactatatgagctgggtaaggcagtcccctggaaaggctctggagtggcttggctttacgcggtctcgcgtgctgggttacaccacagactattcggcatcagtcaaagggcgattcactataagccgtgataacagtcagtccatcttgtacctccagatgaactctctgagaggagaagacagcgccacctattactgcgcgagggatcggccaatggactattggggccaaggcacatccgtgaccgtttcaagtgctaagactacaccgcccagcgtgtaccctctggccccagggtctgcagcccagaccaattccatggtcacgctcggatgtttagtgaaaggttactttcccgagcctgtaactgttacctggaactcaggcagcctgagttctggggtgcacacattcccagctgtccttcagtccgatttgtatactctgagctcgtctgtgaccgtgccctcctcaacatggcctagtgaaaccgtcacgtgcaatgttgcacatccagccagctccactaaggtggacaagaaaattgtaccgcgcgattgtggatgcaagccctgtatctgcacagtgcctgaggtctctagcgtgtttattttcccacccaaacctaaggacgttctaaccatcactctcacaccaaaagtgacctgtgtcgtggtagatatatcaaaggacgatcccgaggttcagtttagttggttcgtggacgacgtcgaagtgcacacggctcaaacccagccgagagaggaacagtttaattccacattcaggagcgtctctgagctgcctatcatgcatcaggattggcttaacggcaaggagtttaaatgccgggttaattcagccgcgttccccgcaccaattgaaaagactatcagtaaaaccaagggtcgccctaaagctccccaagtgtacacaattccaccccctaaggagcagatggccaaagacaaggtgagcctgacttgtatgatcaccgatttctttccagaagacataacagtagagtggcagtggaacgggcaaccggccgaaaattataagaacacccagcccattatggatactgacggatcctacttcgtctattctaaattgaatgtgcagaagtcgaactgggaggcaggcaatacgtttacatgcagcgttctccacgagggcctgcataaccaccacaccgaaaaatccttatcacatagtcctgggaag

SEQ ID NO: 28242 - RNA, 1380 nt, synthetic construct; identical to SEQ ID NO: 28241
  misc_feature 1..1380: note = derived and/or modified sequence opt3 from anti-influenza_Chain
  source 1..1380: mol_type = other RNA

SEQ ID NO: 28243 - RNA, 1386 nt, synthetic construct
  misc_feature 1..1386: note = derived and/or modified sequence opt3 from anti-influenza_Chain
  source 1..1386: mol_type = other RNA
atggagtggagctggatcttcctgtttctcctttccggcaccgccggggtgcactctgaagtccagctgcaacagtcaggacccgagttggttaagcctggtgctagtgtgaaaatgagctgcaaggcatccggctacacattcacttcttatgtaatgcattgggtgaaacagaagccagggcagggattagaatggattggctacataaacccgtataatgacggtacgagatacaacgagaaatttagggtcaaggccaccctgacatcggataagtcaagcagtactgcgtatatggaactatcctctctcaccagcgaggactccgctgtgtactattgtgcccggcgcgggctgatcacaacccccactcttgattactggggacaaggcacaaccctgacggtttcaagtgcaaaaactacccctccaagcgtgtaccccttggcccctggctctgctgcacagacaaattccatggtcactctcgggtgcctggtgaagggatatttcccagagcccgtaaccgttacatggaactcaggtagcctgagttctggcgtgcacacctttcctgccgtcctccagtccgacttatacacgctgagctcgtctgtgactgtgccatcctcaacatggccgagtgaaaccgtcacttgtaatgttgctcatcccgccagctccacaaaagtggataagaaaattgtacctcgagactgcgggtgtaagccatgcatctgtaccgtgcccgaggtctctagcgtgttcatttttcctccaaagcccaaagatgttcttacgatcaccttgacaccgaaggtgacttgcgtcgtggtagacatatcaaaagatgaccctgaagttcagttcagttgggtggatgacgtcgaggtgcacaccgcgcaaacacagccccgtgaggaacagtttaactccactttcagaagcgtctctgagctgccaatcatgcatcaggattggctaaatggaaaggaatttaaatgtagggtgaactcagcagccttccctgctcccattgagaagaccatcagtaaaacaaagggccggccaaaggcaccccaagtttataccattcctccaccgaaagaacagatggccaaggacaaagtgagcctcacttgcatgatcacggactttttccccgaggatataacagtagagtggcagtggaatggtcaacctgctgaaaactacaagaatacccagccaattatggacactgatgggtcctatttcgtctactctaaactgaacgtgcagaagtcgaattgggaggccggaaacacctttacatgtagcgttcttcacgaaggcctgcacaatcatcacaccgagaagtccttgtcacatagtcccggcaaa

SEQ ID NO: 28244 - RNA, 1386 nt, synthetic construct
  misc_feature 1..1386: note = derived and/or modified sequence opt3 from anti-influenza_Chain
  source 1..1386: mol_type = other RNA
caggtgcaactggtccagagcggcgccgaggttaagaaacccggggcttccgtgaaggtatcttgcaaaacctcaggatacacattcactgcatatacgatccactgggtgagacaggcccctggtcagaggctcgaatggatgggctggattaacgcggggaatggacataccaagtacagtcaacggtttaaaggccgcgtcacaataactcgagacaccagcgctcgtacaacctatatggagcttagatccctgacttctgaagatacagccttgtacttctgtgcaaggggtccagagacctattactatgacaagacgaactggttaaattcgcacccggatgaatactttcagcattgggggcacggaactcaggtgaccgtttcaagcgccagtacaaagggcccctccgtgttccctctggctccatctagcaaatccacttcaggcgggaccgcagccctaggatgcctcgtcaaggactactttcccgagcctgtgacagtaagttggaacagcggtgctctgacctctggcgttcatacgttcccagccgtgcttcagtcctcagggctgtatagcttgagttctgtcgtgactgtgccctccagctcgctcggaacacaaacctacatctgtaatgtcaaccacaaaccttctaatactaaggttgataaaaaggtggagccaaagtcctgcgacaaaacacacacctgtccgccctgccctgcgccagaactgctgggcggtccctcagtatttctcttccctccaaagcccaaagatacgttaatgattagtcggaccccggaggtgacatgtgtcgtggttgacgtgagccatgaagatcctgaggtcaagtttaactggtatgtggacggggtagaggttcacaatgcaaaaactaagccccgcgaggaacagtacaactccacctatagagtggtctctgtgctgacagtccttcatcaggattggttgaatggaaaagaatacaagtgcaaggtgagcaacaaagccctgccagctcctatcgagaagactatttcaaaagccaagggccagcccagggaaccacaagtttataccctaccccctagtcgggacgagctcaccaaaaatcaggtgtccctgacatgtcttgtaaagggcttctacccaagcgatatcgcagtcgagtgggaatctaacgggcagccggagaataactacaagactacgccccctgtgctggactcagacggaagtttctttttgtatagcaaactcacagttgataagtcccgctggcaacagggtaacgtgttttcttgctcggtcatgcacgaagctctgcacaatcattacacccagaaatccttaagcctgtcaccaggcaag

SEQ ID NO: 28245 - RNA, 1386 nt, synthetic construct; identical to SEQ ID NO: 28244
  misc_feature 1..1386: note = derived and/or modified sequence opt3 from anti-influenza_Chain
  source 1..1386: mol_type = other RNA

SEQ ID NO: 28246 - RNA, 1386 nt, synthetic construct; identical to SEQ ID NO: 28243
  misc_feature 1..1386: note = derived and/or modified sequence opt3 from anti-influenza_Chain
  source 1..1386: mol_type = other RNA

SEQ ID NO: 28247 - RNA, 1398 nt, synthetic construct
  misc_feature 1..1398: note = derived and/or modified sequence opt3 from anti-influenza_Chain
  source 1..1398: mol_type = other RNA
atgctgcccagcaccgtgcagacactcactcttctgttgacgtccggcggggtcttactgtctctatacgtttcagccagtctcagctatctgctttactccgacgtgctgttgaagttctcttcgaccaaaacaactgctcctaccatgtcactcgagtgcacaaacgcaagcaatgcccaaaccgtaaaccacagtgcgactaaggaaatgacatttccaccgcccgagcctgaatggacctatccaagactgtcctgtcagggatctacgttccagaaagctctgctcatcagcccccataggtttggtgagattaagggcaattccgcccctttaataatccgggaaccattcgtggcatgcgggcccaaagagtgtcgccactttgccctgactcattacgctgcacagcctggaggctattacaacggtacccgaaaggatcgtaataaacttagacacttggtctcagtgaagctggggaagattccaacagttgagaacagtatcttccatatggccgcttggagcggatctgcctgccacgacggcagggaatggacttatattggcgtggatgggccggacaatgatgcgctagtcaaaatcaagtacggagaggcatacaccgacacatatcactcctacgcccataacatactccggacccaagaatcagcttgtaattgcatcggtggcgattgttatctgatgattacggacgggagcgccagtggaatctctaaatgccgctttcttaagattagagagggcaggatcataaaggagattctgcccactggtcgggtggaacacacagaggaatgtacctgcgggttcgcatccaacaaaactatcgagtgtgcttgccgcgataatagctacacagccaagcgaccttttgtaaaattgaacgttgaaaccgacacggcggagattagactcatgtgcaccaagacatatctggatactccaaggcccgacgatggatcgatcgccggcccttgtgagtctaatggcgacaaatggttagggggaatcaagggtggcttcgtgcatcagcggatggcatccaaaattgggcgttggtactcacgcaccatgagtaagacaaacagaatgggaatggaactgtatgtcaagtacgacggcgatccatggactgacagcgatgctctcaccctttccggtgtgatggtgtctatagaggaacccgggtggtacagctttggcttcgagatcaaagacaagaaatgcgatgtcccgtgtattggaatcgaaatggttcacgacggcgggaaggatacatggcactcagccgctaccgccatatattgcctgatgggaagtggtcagttgctatgggacactgtgacgggcgtagatatggcactg

SEQ ID NO: 28248 - RNA, 1398 nt, synthetic construct; identical to SEQ ID NO: 28247
  misc_feature 1..1398: note = derived and/or modified sequence opt3 from anti-influenza_Chain
  source 1..1398: mol_type = other RNA

SEQ ID NO: 28249 - RNA, 1407 nt, synthetic construct
  misc_feature 1..1407: note = derived and/or modified sequence opt3 from anti-influenza_Chain
  source 1..1407: mol_type = other RNA
atggactggacctggagattcctgtttgtggtcgccgctgcaacaggcgttcagagccaagtgcagctcgtacagtccggggccgaggtgaagaaacccggatcttcagtcaaggtgagttgcaaagcgagcggtggcactcttaacaattacgctatctcctgggttaggcaggcccctgggcaaggactggaatggatgggcggtatttctccaatattcgggacgttgaactatgcagagcggtttcagggacgcgtgaccatcacagccgatgtcttcactaataccgtgtacatggaattatcgtcactgcgaagcgaggacacagctgtatatttttgtgcacgtggctgcggctacaactgttattacttcgatgggtggggacagggtaccctagttactgtgagttccgcctctacaaagggcccgagcgtctttcccctcgctccttcctcaaaaagtaccagcgggggaacggccgcgctgggctgccttgtgaaggactatttcccagaacccgtgactgtctcttggaactccggtgcactgacctcaggggttcacacatttcctgccgtgttgcagagcagtggactctactctctgtccagcgtagtgactgtcccatcgtcttccctgggcacccaaacatacatttgtaatgtgaatcataagccctcaaacaccaaagttgataagaaagtggagcctaagagttgcgacaaaacgcacacttgtccaccgtgccccgctcctgagctcttaggcgggccaagcgtcttcctgtttccccctaagccaaaggatacacttatgatctccagaacccccgaagtgacttgtgtagttgtggacgtctctcatgaggatccggaagtgaaattcaattggtatgtcgacggagtggaggttcacaacgccaagacaaaacctagggaggaacagtacaatagcacctatcgggtggtatcagtcttgacggtgctgcatcaggattggctaaacggtaaggagtacaaatgcaaggttagtaataaagcactccccgctccaattgaaaagaccatctccaaggccaaaggccagcctcgcgagccccaagtgtatacactgccacccagcagagacgaacttactaagaaccaggtctctctgacctgtttggtgaaagggttttacccttcagatatagcggtagagtgggagagtaatggacagccagaaaacaactataagacaactccgcccgtgctcgacagcgacggctccttcttcctgtactctaaattaaccgttgataagtcgaggtggcaacagggtaatgtctttagctgctccgtgatgcacgaggggctgcacaaccattacacacagaagtcactcagtctttctcctggcaaa

SEQ ID NO: 28250 - RNA, 1407 nt, synthetic construct; identical to SEQ ID NO: 28249
  misc_feature 1..1407: note = derived and/or modified sequence opt3 from anti-influenza_Chain
  source 1..1407: mol_type = other RNA

SEQ ID NO: 28251 - RNA, 1407 nt, synthetic construct; identical to SEQ ID NO: 28249
  misc_feature 1..1407: note = derived and/or modified sequence opt3 from anti-influenza_Chain
  source 1..1407: mol_type = other RNA

SEQ ID NO: 28252 - RNA, 1413 nt, synthetic construct
  misc_feature 1..1413: note = derived and/or modified sequence opt3 from anti-influenza_Chain
  source 1..1413: mol_type = other RNA
gacggcgtgaagcccctgatcctcagagattgcagcgtcgccgggtggcttctgggaaaccctatgtgtgacgagttcattaatgttccagaatggtcctacatagtggagaaagctaacccggcaaatgatttgtgctatcccggtaactttaatgactacgaagagttaaagcatctgctatctaggatcaaccacttcgagaaaattcagatcattcctaagtcaagttggagcgatcacgaagcctcctctggcgtatcgtcagcgtgtccatatcaagggacccccagctttttccggaatgtggtctggctcatcaaaaagaacaatacataccctactataaagcgcagttataacaatacgaaccaggaggacctgcttatcctgtggggcattcatcactccaatgatgctgccgaacagaccaaattgtaccagaacccaacaacttatatctctgtgggaaccagcacactcaatcaacgactggttcccaagattgcaacccgttccaaagtgaacggtcagaacgggagaatggactttttctggactatcctgaagcctaatgatgccataaactttgagtcaaatggaaacttcattgctccagaatacgcatacaaaatcgtcaagaagggctatattccggaggcccccagggacggccaggcttacgtgcggaaagatggggagtgggtactcttaagtacatttctgcgcagcgacaagacccatacgtgccctccatgtcccgcccctgaacttttgggaggtccatctgttttcctgtttcccccgaaacctaaggatactctaatgatctccagaacccccgaggtgacatgcgtcgtggtggacgtctcacacgaagacccagaggttaaattcaattggtatgtggatggcgtagaagtgcacaacgcgaagactaaacctagggaggagcagtacaatagcacctatcgggtcgtgagtgttctcacagtgctgcatcaagactggcttaacgggaaggaatacaagtgtaaagtctctaataaggcactgcccgccccaatcgagaaaaccatttccaaggctaaaggacagccccgcgaacctcaggtgtatacgttgccaccgagccgagaggaaatgactaagaaccaggtatcgctcacatgcctggttaagggcttttacccctctgatatagccgtggagtgggagtccaatggtcaacctgaaaacaattacaaaaccactccacccgtcttagactcagatgggagtttcttcctgtatagcaagctcacagtggacaaatccagatggcagcagggaaacgtcttttcttgtagcgtgatgcacgaggcacttcataatcactacacccaaaagtcactgagtttgtcccctggcaaa

SEQ ID NO: 28253 - RNA, 1413 nt, synthetic construct; identical to SEQ ID NO: 28252
  misc_feature 1..1413: note = derived and/or modified sequence opt3 from anti-influenza_Chain
  source 1..1413: mol_type = other RNA

SEQ ID NO: 28254 - RNA, 1416 nt, synthetic construct
  misc_feature 1..1416: note = derived and/or modified sequence opt3 from anti-influenza_Chain
  source 1..1416: mol_type = other RNA
atggactggacctggagattcctgtttgtggtcgccgctgcaacaggcgttcagtgccaagtgcagctcgtacagagcggggccgaggtgaagatgcccggatcctctgtcaaagtgtcatgtaagacgagtggtgttttctttagctcccacgcgatctcttgggtgaggcaggctcctggccaagggcttgaatggatgggaggcatttcgccaatgttcggtactacccattacgcccagaaatttcaggggcgggtcacaataactgcagatcagtcaaccacaaccgcctatatggagctgactagcttgacaagtgaagacaccgctgtgtactattgcgcacgcgatggagccggctcctactatccgttaaactggttcgacccctggggccaagggacgctggtaactgtttctagcgcttccaccaagggaccttcagtgtttccactagcccccagtagcaaatctacatccggtggcactgcggcactcgggtgtctggtcaaggattacttccctgagccagtgaccgtgtcatggaatagcggagcccttacaagtggcgtccacacctttcccgctgttctgcagtcttccggtttgtatagcctctcgtctgtggtaacggtgccttcctcaagtctggggactcagacatacatctgcaacgtcaatcataagccaagcaacaccaaagtggacaagcgagttgaaccgaaatcctgtgataagactcacacatgtcccccttgcccagcccccgagctgctcggaggcccttctgtgttcttatttccacccaaaccgaaggacaccctgatgattagccgtacgcctgaggttacctgcgtggtagttgatgtgtcacatgaagaccccgaggtcaagttcaattggtacgtggatggcgtcgaagtgcacaacgcaaaaacaaagccaagagaggagcagtataatagtacttacagggttgtgtccgtacttaccgtcttgcaccaagactggctgaacgggaaagaatataagtgtaaagtgagcaataaggctctacctgcccccatcgagaaaacaatttctaaggcgaagggacagccacgggaaccccaggtttacactctccctccatcacgcgatgagctgaccaaaaaccaagtgagtcttacatgcctggtcaagggtttttatccgagcgacatcgccgtggaatgggagtccaatggccagcccgagaacaattacaaaaccactcctccagtattggactctgatgggtcgttcttcctctatagcaagctgacggtggacaaatccagatggcagcagggaaacgtcttttcatgtagtgtcatgcatgaaggcttacacaatcattacacacaaaagtctctgagcctctcccccggtaag

SEQ ID NO: 28255 - RNA, 1416 nt, synthetic construct; identical to SEQ ID NO: 28254
  misc_feature 1..1416: note = derived and/or modified sequence opt3 from anti-influenza_Chain
  source 1..1416: mol_type = other RNA

SEQ ID NO: 28256 - RNA, 1416 nt, synthetic construct; identical to SEQ ID NO: 28254
  misc_feature 1..1416: note = derived and/or modified sequence opt3 from anti-influenza_Chain
  source 1..1416: mol_type = other RNA

SEQ ID NO: 28257 - RNA, 1419 nt, synthetic construct
  misc_feature 1..1419: note = derived and/or modified sequence opt3 from anti-influenza_Chain
  source 1..1419: mol_type = other RNA
atgaccgagagcgccatgacatccagagctggcagggggcggggagcagacctggtggccgcggtcgttcagggtcacgctgccgcatctgatgccgctggcgacctctcattccccgatgggtttatctggggagcagccactgctgcctaccaaattgaaggcgcgtggcgcgaggacggtcgagggctttgggatgtgttcagtcatacgcctggaaaggtagcaagcggccacaccggcgacatagcctgcgatcattatcaccgttacgctgacgatgtgagactgatggccgggttgggagacagggtctatcggttttccgtggcatggccacgcatcgttccggatggttctggccccgtgaaccctgctgggttagacttctacgatagactggtcgacgaactactcggacatggcattacaccatatcccactctgtaccactgggaccttcctcagaccctggaggataggggtgggtgggccgcgcgggacacagcctatcgctttgcagaatacgctttggccgtgcaccgaagactcggagatagggtacggtgttggatcaccctgaatgagccatgggttgctgccttcctggcaactcatcgtggcgcccccggcgctgcggacgtgcctcgctttagagcagtccaccatctcttactggggcacggacttggtttgaggctgcggtcggccggcgctgggcagctaggactcacactgtcacttagcccagtgattgaggcccgaccgggcgtgcgcggtgggggcagaagggtcgatgcactggccaaccggcagttcttggaccccgctctccgcggaagataccctgaagaggttctgaaaatcatggccggccacgcaaggttagggcatccaggacgtgatctggaaaccatacaccaacccgtggacctccttggtgtaaattattacagtcatgtgcggctggcggctgagggcgagcctgccaaccgattgccagggtccgaaggaatcagatttgagaggcccacggcagtcactgcctggccgggcgatcgccctgacggtctacggaccctgctcctgagactttctagggattatcccggggtgggcctgattatcacagaaaatggagctgccttcgacgaccgcgcagatggcgaccgagttcacgatccagagcggattcgttacttgactgctaccctcagagccgtgcatgacgcgatcatggccggggctgatctgaggggatattttgtctggagcgtgttagacaacttcgaatgggcatacggttatcacaagcgcggcatagtatacgttgattacacaaccatgcggaggattcctagagagtccgccctgtggtatcgagacgtggtccgccggaatgggctaagaaacggagag

SEQ ID NO: 28258 - RNA, 1419 nt, synthetic construct; identical to SEQ ID NO: 28257
  misc_feature 1..1419: note = derived and/or modified sequence opt3 from anti-influenza_Chain
  source 1..1419: mol_type = other RNA

SEQ ID NO: 28259 - RNA, 1422 nt, synthetic construct
  misc_feature 1..1422: note = derived and/or modified sequence opt3 from anti-influenza_Chain
  source 1..1422: mol_type = other RNA
ctgagcagaatcaaccacttcgagaagattcagataatccccaaatcctcttggtcagaccatgaagccagtagcggcgtgtcctctgcttgcccttaccaagggaccccatcgtttttcaggaatgtcgtttggctcattaagaaaaacaatacatatccgactatcaagcggtcatacaacaatacgaaccaggaggatcttctgattttgtggggaatccaccatagcaatgacgcagccgaacagaccaaattatatcagaaccccacaacttacataagtgtgggtacctccacactgaatcaacgcctagtacctaagatcgcgacccgatctaaggtgaacggccagaatgggcgtatggatttcttctggactattctcaaaccaaacgacgctatcaattttgagagcaacggaaatttcattgcccccgaatatgcatacaagatcgtcaaaaagggcgattccgccatagtgaaatcagaggttgagtatggtaactgtaacacaaagtgccagacccctattggggctatcaatagtagcatgccatttcacaacattcatcccctgacgatcggagaatgtcctaagtacgtgaaatctaataaacttgtcctggcaactggcttgagaaactccccactcggctacatcccggaggcccccagggacgggcaggcttatgtgcggaaagatggagaatgggtactgctgtcaaccttcctccgcagcgacaagacacacacttgccctccatgtcccgcccctgagttactgggtggcccaagtgtttttctttttcccccgaaacctaaggataccttgatgatttctagaacacccgaggtgacctgcgtcgtggtggacgtctcccacgaagatccagaggttaaatttaattggtacgtggacggggtagaagtgcataacgcgaagacgaagcctagggaggaacaatataatagcacttaccgggtcgtgtcggttctgacagtgctacaccaggattggctcaacggaaaagagtataagtgtaaagtctctaataaggcactgcccgccccaatagagaaaaccatctccaaggctaagggccagccccgcgaacctcaggtgtacactcttccaccgtcacgagaggaaatgacaaagaaccaagtaagtctgacctgcttggttaagggtttctatcccagcgacattgccgtggagtgggaatccaatgggcagcctgagaacaattacaaaacgaccccacccgtcctcgactctgatggcagctttttcctgtactcaaagttaacagtggacaaaagtagatggcagcaaggaaacgtcttctcctgtagcgtgatgcatgaggcactgcacaatcactatactcagaagtctctctcacttagtcctggcaag

SEQ ID NO: 28260 - RNA, 1422 nt, synthetic construct; identical to SEQ ID NO: 28259
  misc_feature 1..1422: note = derived and/or modified sequence opt3 from anti-influenza_Chain
  source 1..1422: mol_type = other RNA
